United States Patent 10,570,408 (TRANSGENIC PLANTS WITH ENHANCED AGRONOMIC TRAITS) - sequence listing, part 3

SEQ ID NO: 8368 - protein, 472 aa, Yersinia pestis
MDYLPLFADLKQRPVLIVGGGEVAARKIELLHRAGAQVWVVAQTLSSELEQQYQDGRIHWLAQDFLPEQLDNVFLVIAATNDTVLNAAVFAAADQRCILANVVDDQPLCSFIFPSIVDRSPLVVAISSSGQAPVLARILREKLEALLPTRLSDMAAIAGRWRGRVKQHMASMGERRRFWEHAFSGRFASLISRGQLTEAENELQLSLEGQHRALGEVALVGAGPGDAGLLTLRGLQVMQQADVVLYDHLVSPEVLDLVRRDAERICVGKRAGAHSVTQEATNQLLVTLAQQGKRVVRLKGGDPFIFGRGGEELQVVAQAGIPFQVVPGVTAAAGATAYAGIPLTHRDHAQSVTFITGHCRPDGDDLDWQTLARGRQTLAIYMGTVKAAAISQQLIAHGRSSTTPVAVIGRGTRVDQQVLIGTLAQLESLAQQAPTPALLVIGEVVNLHHQIAWFGQQPQTESAISPSVVNLA

SEQ ID NO: 8369 - protein, 379 aa, Nicotiana tabacum
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLCPKKDKVVSPPNELVDTNNPRIYPDFTWPTLLEFTQKHYRADMNTLQTFSNWLKQKTAQV

SEQ ID NO: 8370 - protein, 486 aa, Zea mays
PTRPGRGTFGHVYAGFNSDKGEMCAMKEVTLFSDDPKSKESAKQLCQEISLLSRLQHPNIVRYYGSETVDDKLYIYLEYVSGGSIHKLLQEYGQFGEQAIRSYTKQILLGLAFLHAKNTVHRDIKGANILVDPNGRVKLADFGMAKHINGQQCPFSFKGSPYWMAPEVIKNASGCNLAVDIWSLGCTVLEMATSKPPWSQYEGIAAMFKIGNSKELPPIPDHLSEEGKDFIRQCLQRDPSSRPTAVDLLQHPFVGNAPPLEKSSASHPLEQLTTISCRTNWKVVEHARNMSSLGLEGRYQSILQRRAAKFSLPNSDIRIQSNISCPVSPCGSPLLRSRSPQHQNGRMSPSPISSPRTTSGASTPLTGGSGAVPLNHLRQPAYRNEGFTVTSRGFDDHIPSRLVDPVHGRFIRVQQLSAGRQERVVSEADILSSQFGKMRHANVWDPHDRPLPSERSSQQCFGDHAKLKPSLDLRSGPLHPGRNHGH

SEQ ID NO: 8371 - protein, 104 aa, Staphylococcus aureus
MAIVKVTDADFDSKVESGVQLVDFWATWCGPCKMIAPVLEELAADYEGKADILKLDVDENPSTAAKYEVMSIPTLIVFKDGQPVDKVVGFQPKENLAEVLDKHL

SEQ ID NO: 8372 - protein, 659 aa, Schizosaccharomyces pombe
MVKRRLSAFGNAFLIYFIIFRLCCCSPQTSHWCKYPALCLKSPDTHNENLVCDAYLSVIATKSEEKEASNPTTWDFTPTNKYQEPSFHTKTSLNGSDTISSNFLSKYEYSNGTSTSEFIDSISPPLVNETSTISSSKKLEQNYSVTEVIDTNIITSSSVTLPISEDGSSTSAAATIDSNIDEKTVAFSEEKRFNFASTDCAAAVIKTNPEAVGSSSILTENKDKYMLNKCSAENKFVVIELCEDIYVDTVQIANFEFFSSIFRDFKVSVSGKYPKYESSWMELGTFTALNLRTLQSFHIENPLIWAKYLKIEFLTHYGSEFYCPVSLLRVYGKTMIEEFEEANEDFLEQKVNDGSAIKADEIRKPQESPIFVDEEDTDVQSKPVRKNPSVELNSTDTLLSSTVISKSLSTVVIGNETGKSESYPATSTRSFNDISPSSSSSYSTAQISTFPSNQESIYKNINKRLSTLEERKKAFDEIVEKILTNYGKHNAKNMNFTQLLHELNSTLQLEISKLSKSVVKPSLFALQAKLELLSAENEYFQSQITSLYQESSFQKRLLMLQLTVLIVLTVYMAVSRLPENLPTTRSSSNNPIEASRPPFSRDEQDISKANDFRVSASSAVYTVGPELLQRKKRDPNTSIRSIHEREQDKIIHSRSHSVC

SEQ ID NO: 8373 - protein, 472 aa, Bacillus cereus
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKEAEMKDHPFKMPFAPVTNYLTIAFLIMVLIGMWFNDDTRISLVVGIIFLVIVTISFYAFGIGKRTPLDVQNDQEISSK

SEQ ID NO: 8374 - protein, 995 aa, Listeria monocytogenes
MGAKVSVQINGVARDVVEGTRMLDYLNAEGIQHPHICYSEQIGPIQSCDTCMCEVDGELMRACSTNLTDGMEIKTNSELAKDAQLEAMDRILENHLLYCTVCDNNNGNCKVHNTTELLGVEKQERPYREKGYLNDFSHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEASMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSLGFISSSKTTNEENYLMQKLARQVFETNNIDNCSRYCQAPASDGLTRTVGIGADSGTVEDIESAGLVIIVGASPADGHPVLASRIKRAQKTRGQKLIVSDLRKHEMAERSDLFIHPKQGTDFVWLTAVAKYMIDQGWHDEVFMENRISNVADYLAFLEPFTLEYAEKETGLSVETLKKVAQMVHEADGTAVCWGMGVTQNIAGSHTSSAIANLLLVTGNFGRHGAGAYPLRGHNNVQGACDMGSLPNVLPGIQPLGNDEVRARFEEAYGVSISSEPGLKNNEMLDAIEAGTLHSMYVIGEEMAWVDSNSNHVQEILASLDFFVVQDVFLSKTAQFADVVFPAAPSLEKEGTFTNTERRVQRLYEVLEPLGDSKPDWWIIQEVARACGRTDWNYDHPSEIMDEIASLAPFFAGVRYDRMQGFNSLVWPVSADGKDMPLLYEERFNFPDGKAQFSTLPYIAPITFPEEYNLTLNNGRLLEQFHEGNLTDKSKGLDYKLPEVFVEVSHELAKERDLESGSLVRLSSPYGRIKLRAVVTDRMKGNEVYVPMHSVSSETAVNLLTSSAGDVRTKTPAYKQTKVNLTVLEKTGKNPLPDHNPRNRKRFPQNGAEVARKWSREDYQPISKVNCACGGNCGCGGKGRNH

SEQ ID NO: 8375 - protein, 463 aa, Pseudomonas putida
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQMEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVANAKAIIDFVVLTSVTSCLNSSLYTASRMVYSLSRRGDAPACAQVTSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGLLVTRRRARAVVVGGVGQGA

SEQ ID NO: 8376 - protein, 322 aa, Prochlorococcus marinus
MEIANDITSLVGNTPLVKLSRIRNYFNCYPEIIAKLESFNPSASVKDRIAYSMLCKAEEEGLITPDKTTLIEATSGNTGIALAMVAAAKGYKLILTMPDTMSIERRAMLRAYGAELQLTPGQEGMKGALDLANELSSSIANSYQFNQFENFANPDIHERTTAQEIWAQSNNNLDGLVTGVGTGGTITGCARFLKKVNPNCKIYAVEPRKSAVISGEKAGSHSIQGIGAGFVPKVLNTKLIDEIIKIDDDEAFYYGRLLARLEGLLSGISSGAALAATIKIGERKELINKRLIVILPSFGERYLSTAMFESNTSIQARTDGYL

SEQ ID NO: 8377 - protein, 531 aa, Oryza sativa
MEAVGVAPAPAGVPEKKLLEVKESRKAAPAAPSTSMAAKWAMKKKLVGGDAGYVLEDVPHLTDYLPELPTYPNPLQDNPAYSVVKQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPVKDSSKCNGTAAPV

SEQ ID NO: 8378 - protein, 567 aa, Zymomonas mobilis
SYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 8379 - protein, 865 aa, Anaerobranca horikoshii
MFKLRKLTPFVLLLFIMAFLAGCGGKDVTQPPPQEEEEDLSKYYPGPPPLPDFEVKTTLIINYHRYEGDYRPWDLWVWADGKEGKAYQFTELTDYGVRATIYFPEEYNRLGFIVRRGNWSAKDVDRDRFVDVVDGKAEIWLLQSDPNIYFSQDEVNKNPRIVSAYMDGKDEIIVSLTHQHKLTDGDNGFVIKGENKEYNVKKVEIVGSGSSGNVLKLTLEKELDITANYTIESPDYTGNYVIKRRVLDLPEFYYAGDDLGNTYTKNSTKFRVWAPTALNVKVRIYNTADAKEGKDYDMKKDVNGTWFLEIKGDLKNKYYTYIVDHGYIVNEAVDPYVRAVSLNSTKGMIVDLKETNPKGWDSFKKPEFKNYTDAIIYEMHVRDFSIYPQSGNKYKGKYLGLIEKGTTGPGGVKTGLDHLVELGITHIHLLPTYDFASIDDSRDDQYNWGYDPRLYNVPQGTYSTNAADGLTRIREYKEMVMGLNRAGIRVIKDVVYNHTYTVGDSPFDLIVPKYFYRTDDKGNYTNGSGCGNEIASERPMVRKFIVDSVKYWATEYKIDGFRFDLMALHDVDTMLEVQQALHQIDPSIIIYGEPWQAGGSPLPANLQFTKGKQRGTKIAVFNDHIRNAIKGDTDGATKGYAQGMVNQRNNVIKGIMGAIDDFAQEPTESIVYVTCHDNLTLWDKIEKSNPNDSEEDRIRMNLLSNAIVLTSQGVPFLHGGVEMMRTKYGDHNSYKSPDHINQIEWSRKHTYYEEFLYHQGLIRLRREHPAFRMPTAEMVRKHMEILDSPDGSIMFHLKDNANGDPWKDIVVIYNPNGHDITVNLPKGGTWNIVVKDKKAGVDTLETVNGSSVKVPRISMMVLYQN

SEQ ID NO: 8380 - protein, 234 aa, Debaryomyces hansenii
MSYREDRIICTFYTKIGACRHGEKCSRKHVKPSSSDTILLPNLYQNPKLNKNDGEELNPKQVQEYFDHFYKDIFLKFALFGEVYSMVVCENDNNHLNGNVYVKFANEDSAYNAVMLLNQEWFGGRPVHCELSPVESFHDANCRAYESSTCNRGDHCNFMHIHKPTPQLKSSLFKSQEKSTLTKQLQLLRGELTGSLENENVQQDAAGEQISKPAETTSTETVEKLFASSIPSHI

SEQ ID NO: 8381 - protein, 507 aa, Nicotiana tabacum
MENGTKKLNVSSLAVEQPLPKSKLWKIIMVASIAAGVQFGWALQLSLLTPYVQLLGIPHKFASFIWLCGPISGMIVQPVVGYYSDNCSSRFGRRRGFIAAGAALVTIAVFLIGFAADLGHATGDPLGKGSKPRAIAVFVVGFWILDVANNMLQGPCRALLADLSGGKARMRTSNAFFSFFMAVGNVLGYAAGSYSRLCKIFPFSKTPACDIYCANLKSCFFIAVFLLLSLTILALTVVRENELPEKDEHEIDEKAGARKSKVPFFGEIFGALKDLPRPMWILLLVTSLNWIARFPFFLYDTDWMAKEVYGGKVGDGRLYDLGVHAGALGLLLNSVVLGFMSLSVEFLGKKIGGVKRLWGILNFVLAVCMALTVLVTKMAEKSRQYDAHGTLMAPTSGVKIGALTLFAVLGIPLAVTFSVPFALASIFSSNAGSGQGLSLGVLNLAIVVPQMLVSIAGGPWDDLFGGGNLPGFIVGAVAAAASGILALTMLPSPPADAKPATTMGGFH

SEQ ID NO: 8382 - protein, 385 aa, Bordetella pertussis
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 8383 - protein, 546 aa, Glycine max
MVFEISTVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKHSFATLSFVAEIFIFLYVGMDALDIEKWKFVSDSPGTSVATSSVLLGLILLGRAAFVFPLSFLSNLAKKSPNEKISFRQQVIIWWAGLMRGAVSIALAYNQFTMSGHTSLRSNAIMITSTITVVLFSTVVFGLLTKPLIRLLLPHTPHHKESSITITTDPSTPSPKSVTVPLLGSAQESEVDIDGHDIHRPSSIRALLSTPTHTVHRLWRKFDDAFMRPVFGGRGFVPIEPGSPTERNGHQWR

SEQ ID NO: 8384 - protein, 371 aa, Unknown
  Dendrobium sp. XMW-2002-2
MWRHSCCYKQKLRKGLWSPEEDEKLLKHITKYGHGCWSSVPKLAGLQRCGKSCRLRWINYLRPDLKRGTFSQQEENLIIELHGVLGNRWSQIAAQLPGRTDNEIKNLWNSCIKKKLRLRGIDPNTHKPLAETEVQLAEIDSADQPAPEPEKHTVQQTETGVPNNSVRPGNSPAASYFSLPDLTYSPDCGGSIGQIQQFWLNQSGKFFSNNNSNSEFSFNSVSSLVPSVPRSTLSTSKELKPLTSLLMENSPSGFYWETGNSSNSSASSGSNDPLFDGSIFQWTQLIPERDINVQLHGETEDLKWSEYLNGSIPLSTELQSQNPELCNGMKAEEQFGIDGLSIWLQNHQQQQQQQQQASNNYGKDSQRDIIC

SEQ ID NO: 8385 - protein, 224 aa, Oryza sativa
MGRRPARCYRQIKNKPYPKSRYCRGVPDPKIRIYDVGMKKKGVDEFPYCVHLVSWEKENVSSEALEAARIACNKYMTKNAGKDAFHLRVRVHPVHVLRINKMLSCAGADRLQTGMRGAFGKPQGTCARVDIGQVLLSVRCKESNAKHAEEALRRAKFKFPGRQKIIHSRKWGFTKFSRVRVLKLKAEGRIMSDGVNAKLLGSHGRLAKRAPGKAFLAETIQRSA

SEQ ID NO: 8386 - protein, 766 aa, Saccharomyces cerevisiae
MSEEETVSAPAPASTPAPAGTDVGSGGAAAGIANAGAEGGDGAEDVKKHGSKMLVGPRPPQNAIFIHKLYQILEDESLHDLIWWTPSGLSFMIKPVERFSKALATYFKHTNITSFVRQLNIYGFHKVSHDHSSNDANSGDDANTNDDSNTHDDNSGNKNSSGDENTGGGVQEKEKSNPTKIWEFKHSSGIFKKGDIEGLKHIKRRASSRNNSSINSRKNSSNQNYDIDSGARVRPSSIQDPSTSSNSFGNFVPQIPGANNSIPEYFNNSHVTYENANHAPLESNNPEMQEQNRPPNFQDETLKHLKEINFDMVKIIESMQHFISLQHSFCSQSFTFKNVSKKKSENIVKDHQKQLQAFESDMLTFKQHVMSRAHRTIDSLCAVNAAATAASVAPAPAPTSTSAYAPKSQYEMMVPPGNQYVPQKSSSTTNIPSRFNTASVPPSQLLYNTNRSRNQHVTYASEPAHVPNFINQPIPIQQLPPQYADTFSTPQMMHNPFASKNNNKPGNTKRTNSVLMDPLTPAASVGVQGPLNYPIMNINPSVRDYNKPVPQNMAPSPIYPINEPTTRLYSQPKMRSLGSTSSLPNDRRNSPLKLTPRSSLNEDSLYPKPRNSLKSSISGTSLSSSFTLVANNPAPIRYSQQGLLRSLNKAANCAPDSVTPLDSSVLTGPPPKNMDNLPAVSSNLINSPMNVEHSSSLSQAEPAPQIELPQPSLPTTSTTKNTGEADNSKRKGSGVYSLLNQEDSSTSSADPKTEDKAAPALKKVKM

SEQ ID NO: 8387 - protein, 668 aa, Unknown
  Synechococcus sp. WH 7805
MAAPQANRVELLIFSSGDAPSPDRIIDLDVHTHRSGDYWHAEVEGLKAGCLYGYRVFGPLAPGGHGFRPAKVLLDPCARGIDGWSVYQREMATGASPNTDCCLKGVVCERDAFDFDAHPRPRHDWQQTVIYEMHVGGFTRRSDSGVAPERRGTLLGVIDKIPYLKDLGVTTIELLPVQAFDPDDAPPGRDNAWGYSPLSWFTPHQGYICGGDPLEARKQMRELVAACHDAGLEVLLDVVYNHTTEGNRNGPTLSWRGLGDQIYYHQTSKGDYLDVSGCGNSIAAHQPLTRALILESLRCWAIELGVDGFRFDLGIELSRGEGLKPLEQPPLLEAMEADPLLSDLKMVSEPWDCGGLYRLNDFPAQRIGTWNGRFRDALRGFWKGDEDSTWAMGQRLRGSPDLYEGKPVNLGRSVNLLTAHDGFTLMDLVSFNGKHNLANGEDNRDGENHNISWNHGVEGPTTDHAVTALRRRQQRNMLSTLLLARGVPMLLMGDEVGRSQGGNNNTWCQDTPLSWMIWSDDHCDMELLTYVKRLLVVRRQLADLFNPLVGHSEKPQRFSSDTDGYWRQWHGVELGKPDWASWSHCLALSVHKGNQGAVLWAGLNAYFKAMHFDLPEATTPWHRLIDTALPPGQDLPAHPEPWTPPGVPLEARSLVVMVAGEYANSLRL

SEQ ID NO: 8388 - protein, 292 aa, Coccidioides immitis
MTEITHPTIKDGWFSEISDMWPGQAMTLRVNQILHHEKSKYQDILIFESTDHGTCLVLDNVIQCTERDEFSYQEMITHLAMNSHPNPKKVLVIGGGDGGVLREIVKHESVEEAILCDIDEAVIRASKKYLPGMSIGFQHPNVKVHIGDGFKFLEERKNEFDVIITDSSDPEGPAEVLFQKPYFELLYGSLREGGVISTQGSENQWLHIKLITDLKKLMKEVFPVVEYAYTSIPTYPSGQIGFLVACKDPNRNIREPVRSWTREEEDKLCRYYNQDIHRASFVLPGFARKALE

SEQ ID NO: 8389 - protein, 218 aa, Oryza sativa
MGRRPARCNRQIKNKPYPKSRYCRGVPDPKIRIYDVGMKKKGVDEFSHCVHLVSWEKENVTSEALEAGIACNKYMTKSAGKDAFHLRVRVHPFHVLRINKMLSCAGADRLQTGMRGAFGKPQGTCARVDIGQVLLSVRCKPNNAVHASEALRRAKFKFPGRQKIIESRKWGFTKFSRDEYVRLKSEGRIMPDGVNAKLLGCHGRLSARAPGKAFFSAA

SEQ ID NO: 8390 - protein, 338 aa, Ostreococcus tauri
MIYAFLLSAIFIYPTYCVFGHATWMRNAFLGYIGWYVLLDRRSDSSGTRFVAWSRRLPFWRILADYFPVRLYKSGELDPKGNYLFGYHPHGVIGVGALMTFATEATGFYEAFPGLDLRLLTLSVNFKFPFTREVLMALGINSVTKASVMTNLTRAPGASVAIVIGGAAEALDARPGSATLTLARRKGFVKMALRTGASLVPVFAFGENDIFEQVENPDGGRLRKFQTYIKQLIGISPPAFYGRSLSRGVWRRIFGRKGVLPKREPIEVIIGNPIHVPQVDDPSPDVIDKYHQLYTVGLKELYELHRRQFHQLNRGGSSDDLLSDLIKRKNNLQAMTFK

SEQ ID NO: 8391 - protein, 628 aa, Neisseria polysaccharea
SPNSQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLYLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSQAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQDLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 8392 - protein, 535 aa, Oryza sativa
MGMEVAAARLGPLYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIRAIFPATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKRTWRQQVVIWWAGLMRGAVSIALAYNKFTRSGHTQLHGNAIMITSTITVVLWSTMVFGMMTKPLIRLLLPASGHPVTSEPSSPKSLHSPLLTRMQGSDLESTTNIVRPSSLRMLLTKPTHTVHYYWRKFDDALMRPMFGGRGFVPFSPGSPTEQSHGGR

SEQ ID NO: 8393 - protein, 184 aa, Brassica napus
  misc_feature (11)..(11): Xaa can be any naturally occurring amino acid
LLSTPFTVKEXGWASMVILLLFAVICCYTATLMKDCFEAKTGIITYPDIGEAAFGKYGRILICVILYTELYSYCVEFIILEGDNLTGLFPGTSIDWLGIRIDSKHLFGIFTALVVLPTVWLKDLRIISYLSAGGVIATVLIAVSTFFLGTTGGIGFHHTGPAVKWNGIPFAIGIYGFCYSGHSV

SEQ ID NO: 8394 - protein, 323 aa, Triticum aestivum
  misc_feature (85)..(85): Xaa can be any naturally occurring amino acid
  misc_feature (95)..(95): Xaa can be any naturally occurring amino acid
  misc_feature (121)..(121): Xaa can be any naturally occurring amino acid
  misc_feature (141)..(141): Xaa can be any naturally occurring amino acid
  misc_feature (152)..(152): Xaa can be any naturally occurring amino acid
  misc_feature (241)..(241): Xaa can be any naturally occurring amino acid
  misc_feature (268)..(268): Xaa can be any naturally occurring amino acid
MAVSAIGFEGYEKRLEITFSEAPVFTDPNGRGLRALSRAQIDSVLDLAKCTIVSELSNDKMDSYVLSESSLFIYPYKVVIKTCGXTKLLLAIPRXILRLAEELALATAAVKYSPGDFIIPXGQPFSHNNILLIRVASLNGXWGGLKFGGHGXVPMVHPAKPGQKWHVYYATQQPEQPVVNLEMCMTGLDKKKASVFFKTSADGHTSCAKEMTKLSGISDIIPEMEICDFDFEPCGYSMNAXIHGSAFSPIHVTPEDGFSYASYEVMGXDPASVAYGDLVQRVLRSFGPSEFSVGGDHPWAAPAWLPPGGERLNVGVYDSTSCS

SEQ ID NO: 8395 - protein, 623 aa, Ostreococcus tauri
MMSRARRAIVGRGGGSAEVARNASAQSASGRDAQTTSAETNASGGGGEGASIDGEISAPRLPGLRLTPAGRVLAAAAAAAASGRDRGPDAEMNDEFGGMRGDPEVEETPLPLPPPLGDIPRAHGGVVGKIKGQILPSSGYVPLEVQTHAEKVRLIQQQERTRRSHSITDAAVTTTAKTAGAAVGAISKMAAKLKESRHFKSASAPLTAVEIADDAPAARESHAEEAGEANARSAHTEPTSNPFVQDESRRPGRNSSELSDSGVPSSPHHRRASSAGNWSDMSYTTSDDGMLRMCHTSLAPTKPRRWTKGDNLGEGSFGSVWLALNGDTGELFALKEVRFGSSDKHREESIEQLEQEVDVLSRLVHPNIVRYIGVTREEAALYIFLEYVPGGSIASLVHRFGKFEENVIRVYTRQLLIGLSYLHSQRVLHRDIKGANILVEKSGRIKLADFGMAKVLENVSHGKSFKGSACWMAPEVIRQKNVGFEADIWSVGCTVYEMATGAPPWSDCSTQVQIIFKIASSEEIPVIPEHLSPDGQDFLRLCLQRDATRRPEAVALLDEPFVVDAHRSSNATNIPGLQYDTWASSSVLSFRDDEASVRSGDGTVGGMRSNQSSMRHVAWGDLE

SEQ ID NO: 8396 - protein, 520 aa, Oryza sativa
  misc_feature (29)..(29): Xaa can be any naturally occurring amino acid
  misc_feature (346)..(346): Xaa can be any naturally occurring amino acid
  misc_feature (450)..(450): Xaa can be any naturally occurring amino acid
MVGAGEGDRVGGGAAVGGGQQFVDRSKVXILLCDSDPSSSREVLRLLCNCSYQVTCAKSPRQVINVLNCEAGEIDIILAEVDLPVSKCFKMLKYIARNKELRHIPIIMMSNRDEVSVVVKCLRLGAAEYLVKPLRMNELLNLWTHVWRRRRMLGLSEKNFFNDNFELALSEPSDANTNSTTLLSDDTDDKPKENINQETSTSNQHEYESNPSDAEPKQKGTPEGLLVSTEGGDQASSPGVMFSRPIKTNLRVAESSAFLAYVKSSTPTTSSFDSELQKGGNRLDSSDHRGNFSSTTDRSDTGTDVNIRDKEAFEMPVQYPVVCFSSSNLHLERSNEGQNDASGTPXPVYHFPFYYPGMMDHGMTHPPVQNFQGNINNAQVHTPQTLLPQYNVYPQCHGVSMMPPFQYNPAGMSIQSNQLPTQNMWPQASSTPMPEETCSRSERRAAALAXKFRLKRKERCFDKKVRYVNRKKLAETRPRVRGQFVRQANYTDITSTGDDISEDEDDDPSSREVEMVSSPE

SEQ ID NO: 8397 - protein, 174 aa, Lactuca sativa
MASISSSAIATVNRTTSTQASLAAPFTGLKSNVAFPVTKKANNDFSSLPSNGGRVQCMKVWPPIGLKKYETLSCLPPLSDEALSKEIDYLIRNKWIPCLEFELEHGFVYREHHHSPGYYDGRYWTMWKLPMFGCTDSAQVMKEVGECKKEYAGTEFAKGSLKVKLLKWPRSPLQ

SEQ ID NO: 8398 - protein, 435 aa, Ralstonia eutropha
MSSAAPTHTAGQKHALPSYLNADNLGPWGIYLQQVDRVTPYLGSLARWVETLKRPKRAMIVDVPIELDNGTIAHYEGYRVQHNLSRGPGKGGVRFHQDVTLSEVMALSAWMSVKNAAVNVPYGGAKGGIRVDPRTLSHAELERLTRRYTSEINIIIGPSKDIPAPDVNTNAQVMAWMMDTYSMNSGSTATGVVTGKPISLGGSLGRHEATGRGVFVVGSEAARNIGLEIKGARVAVQGFGNVGAVAAKLFQEAGAKVVAVQDHRVSLYNPAGLDVPAMMEYASHSGTVDGFQAETISSEQFWQVDCDILIPAALEGQITAKNAPQIKARLVIEGANGPTTPEADDILRERNILVAPDVIANAGGVTVSYFEWVQDFSSFFWTEEEINERLVRIMQEAFRAIWQVAQDNKVTLRTAAFIVACTRILQAREMRGLYP

SEQ ID NO: 8399 - protein, 594 aa, Gibberella zeae
MTVVTLPEPFASIPRENFLFGASPLQPLPRISAALGGKVNVYAKREDCNSGLAYGGNKVRKLEYLAAEAQAEGCDTLVSIGGVQSNHTRAVTAVASKLGLKAATVQEHWVDWEDPGYEKVGNIQLSRLMGGDVRLDPSTFGIEHKTTLAKLKDELKSNGQKPYYIPAGASDHPLGGLGFARWAFEVEAQEKELGIFFDTVIVCAVTGSTFAGMIAGFKLAQKKNGSPARKIIGIDASGKVQQTFDQVLRIAKNTAAKIGLSEDDITADDVILDPNYNAKVYGIPDETTLEAMRFGAATEAFITDPVYEGKSLAGMMDLIKTGKIAGGNVLYAHLGGQLALNAYSKFFNLSSKHHQLPQYAHDYLIQDSYVIQSSPDTLENTTLGDLFSGQKSPKQQIDWAIDEPQEIFVHEKLAAVWTGWSIRADDGSIISHKKGLVGLAFTQGRWKVSGLASTERSIDIPNPKDETHLEQDIMKPINALLNDFSHPDWDTLKEWFLPDAGVTLYRPPSEPAPMTLEQSIRRLQNMIKSGITMQEKLHHAQVRKHGDLALVWAPFVVEINGQAMHHGVNAFTLFKKSDKWCFGGCQDYGVPISG

SEQ ID NO: 8400 - protein, 166 aa, Unknown
  Shewanella sp. ANA-3
MAIERAVLAGGCFWGMQDLIRKRPGITSTRVGYTGGEVANATYRNHGNHAEGIEIMFDNEITSYRQILEFFFQIHDPSTVNRQGNDKGTSYRSAIYYTSEAQHAEAVKTIADVDASGLWPGKVVTEVEPASDFWEAEAMHQDYLELRPNGYTCHFPRPDWKLPSSQ

SEQ ID NO: 8401 - protein, 360 aa, Prochlorococcus marinus
MKTWVIKIGTSILRGTEETSTEEVIETLCRSFTSFLLKGNKLILVTSGAVGLGCQKLNIKTRPNDLSTLQATAAVGQVNLMSLYDKIFNKLGHNIAQILITKADFNSRESFNNASKTLKKLIDLNVIPIVNENDTVANEELKYGDNDTLSALVALAINANKLILLTDIENLYSKDPRKNKDAHPIKEVHNSELKEIKNKNNQNSNNEWGTGGISTKLISAEIATKGGVEVQLVDGTNKKNLIEIFNDNKIGTLFYPLEKPIGNKKSWLSHAIHTVGKITLDDGAFFAINKKGASLLAVGVKNVEGNFTVNQAVKIVNTDNKEVAKGLVSISSDNLRSILNNKDNNNSSIIVVHRDVLALS

SEQ ID NO: 8402 - protein, 133 aa, Prochlorococcus marinus
MQLLHTMLRVKDLEESICFYTQILGMRLLRQKDYPSGRFTLAFVGYGAESEHSVLELTHNWDKNNYQLGDGFGHIAIGVKNIYKTCMNIRNNGGRVTREPGPMKHGQTIIAFIEDPNGYKIELIDISSREIKD

SEQ ID NO: 8403 - protein, 1290 aa, Oryza sativa
MSGLDLREMLSSAARRHTWRRSGWGAEWGGGDDARSAALPARCPPPPPPRRPAAAGGRGDEGSGGLRGRGEEGTSRGGSGARREDAAGTGRNAVAVVAGGSATSGAERVAARAEDGRRSMDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGTLVAKEKRNGGGELGTKRGLEKRAPLPPPKRRVVSAKRQFPPDFGRDSAVPLGRGRGRGGGVRPSDGAPARAVLGEKVASAGNGDSMANVHHHAVMDTVLMKSSHASDENLVAFKVGSPENGAEGAARGKGAHNGELLGKREVLAQAVNLLPMRRTVSATHRFTAGCGRDAAAPLARREEGKVGSGLEVMPVDVGGGVSKEVMATDGSKHSVNQCTANIVGAVGVLDGTVQYQELEEGEVADEAYCDVESQKVVGCDSFDDSAGERHEGVVPETFAVTEVLTSHAYDEMMQIKALQEGGSDAAQETEHDLPMGGKCETILPDASPKCSFGGPSNEIVHGKRVLGSHGMKGEVPSLAIEDNGGIAQIDQELEDVEMTTGEYRVQDAQIATHVIPHESTTGRHEGGLCASAAAEDVKVMNKYKGTLPKAAAKSSMNIATGVFGDGIMRSKILSTARKVVKPPVRASHKPPLNTLHRPFSTNSASFGHKKLKVKRPDQSKDIPMKIASTSGLAGKDNLTDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFLSRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 8404 - protein, 337 aa, Erwinia carotovora
MHLARFPRLSLGHFPTPLEVLPNLSAYLGGPTIYIKRDDATGLATGGNKTRKLEFLLADAQQQGADVIITQGATQSNHVRQTIAAAAKLGLKTKVLLEKRVEDYGEDYQRSGNVLLDNLLGGDIIDHLPAGTDMQQAMETLAESLRKEGFKPYVIPGGGSSPVGALGYVACAEELLFQSSQQRLRIDHIVHATGSTGTQAGLVTGLAATHSQIPLLGISVRAPKAKQEENVYALAQRTWQLLGIPGELPRSAVRVNSDYVGKGYGIPTEGTLEALRLLAQLEGILLDPVYSGKGMAGLIDLIRQGHFRADENIVFIHTGGSAGLFGYRQLFEQTAAQ

SEQ ID NO: 8405 - protein, 241 aa, Prochlorococcus marinus
MPSDTSASANIAIEELLEKFSSGTLRQRRRLVDEVESRSDELKGLGSKLFETLPKESDDWSKGWILQVLNRHHNDYLKDLLAKDSSILFDVPSSSDIDYGPLQQSLIEERFEEADRITSETLRCLAGPSSLERGYVYFSEVEAMSEVDLISLDLLWNAFSQDKFGFSVQARLLESLGGRYDKLWSRIGWKVDGTWTRYPIAFTWSLKAPEGHMPLVNQLRGVRLMDAYLNHPFLKSRLKKS

SEQ ID NO: 8406 - protein, 305 aa, Arabidopsis thaliana
  misc_feature (175)..(175): Xaa can be any naturally occurring amino acid
  misc_feature (179)..(179): Xaa can be any naturally occurring amino acid
  misc_feature (192)..(192): Xaa can be any naturally occurring amino acid
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAXVLPXPIETSSSSDDPPXSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 8407 - protein, 169 aa, Nicotiana tabacum
MASQSSKPQSIYDFTVKDAKGNDVDLSIYKGKVLIIVNVASQCGLTNSNYTDMTEIYKKYKDQGLEILAFPCNQFGGQEPGSIEEIQNMVCTRFKAEYPIFDKVDVNGDNAAPLYKFLKSSKGGFFGDSIKWNFSKFLVDKEGNVVDRYSPTTTPASMEKDIKKLLGVA

SEQ ID NO: 8408 - protein, 72 aa, Chromobacterium violaceum
MAKEDTIQMQGEVLENLPSATFKIKLENGHVVLGHISGKMRMHYIRILPGDKVTVELTPYDLSRARIVFRAK

SEQ ID NO: 8409 - protein, 968 aa, Unknown
  Azoarcus sp. EbN1
MLIKKNAAPGNAFRQLASPMARHLGATMDRRAFLRRSGLGAGAGVLAAQLPYNLIGSADAASAGGQSATGGEEVRRTVCTHCSVGCAIDAIVKNGVWVRQEPVFDSPINLGAHCAKGASVREHGHGEHRLKYPMKLVDGKYQKISWEQAINEVGDRLLKIREESGPDAVYWIGSSKHSNEQSYLMRKFVSFFGTNNMDHQARICHSTTVAGVANTWGYGAMTNSYNDMQNARAMLFIGSNAAEAHPVSLLHILHAKETGAKMIVVDPRFTRTAAKADYYARIRSGTDIPFIWGMLYHIFENGWEDREYIRQRVYGLDKVREEVMKWTPDKVQEVTGVPEEQVYTIAETLAKNKPSTVVWCMGQTQHTVGNGNVRAMCILQLVLGNVGVSGGGTNIFRGHDNVQGATDVGPNPDSLPGYYGLAAGSWQHWCRVWGVDYEWVKGRYASEELMTKSGITVSRWIDGVLENPADIDQPGGNLRAVVYWGHAPNSQTRGAEMVEAMKKLDTLVVIDPYPSATAAMAAMVRKDGVYLLPAATQFETSGTATASNRSLQWREKVIEPLFESKPDQTIMYAFAKKFGFADELVKNIKLVKDKQGWDEPEPEDILREINRGTWTIGYTGQSPERLKLHMQNMHTFDVKTLRANGGPCDGDYFGLPWPCYGNPELKHPGTPNLYDTSKHVMEGGGNFRANFGVEKDGVSLLAEDGSASKGAELQMGYPEFDDVLLKKLGWWDELSDAEKAAAEGRNWKTDLSGGIMRVAMQNHGMHPFGNAKARALVWNFPDPVPLHREPIYSPRPDLVEKYPTHDDKMKFWRLPTLYKTLQDKVRDISKEYPLIMTSGRLVEYEGGGEETRSNPWLAELQQEMFAEVNPKDANDAGFRNGDYIWVESPTKAKLKVRAQVTQRVAPGTVFLPFHFSGWWQGRDMLEYYPEGAAPIVRGEAVNTATTYGYDSVTMMQETKTTLCRVAKA

SEQ ID NO: 8410 - protein, 174 aa, Aeropyrum pernix
MPLRPARCYTHFSGPPYTRREYIHGVPPPKITRFEMGNREMMEKWEIKGELVMLEAGQIRHNALEAARIAVNKYLATTIGDKNFYFRIRVYPHHVIRENKMMAFAGADRLQDGMRQAFGKPVGTAARVYPGTVVLEVWARKGDEENVKEALRRGASKFPLPSRIVIRTRGAQAS

SEQ ID NO: 8411 - protein, 418 aa, Photobacterium profundum
MNLEHMGKAAQEAAFELATVATAQKNQALAIIADELEANKDAILAANAKDINAARESGMTDALIDRLLLNEERLTGIANDVRNVISLNDPVGAELDSRVLENGMRLSRRRVPLGVVGVIYEARPNVTIDIAALCLKTGNASILRGGRETFHSNVELVKVIQVALKKADLPAASVQYIEKPDRELVSQLLRLDQYVDMIIPRGGAGLHKMCKENSTIPVIIGGFGISHIYVDHSADISRSIDVVENAKAQRPSACNALDTLLVSEKVAETFLPRLAERLNKSNVEFVADDAAYSFLEGKAATLRHAADGDFDTEWLSFTLGVKVVADVAEAIAHMRKHNASHSDAILTNDIQSAERFVNAAGSAAVYVNASTRFTDGAQFGLGAEVAVSTQKLHARGPMGLEELTSYKWVGQADYLVRP

SEQ ID NO: 8412 - protein, 930 aa, Yersinia pestis
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELDILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRETLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKDCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTASTASTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 8413 - protein, 439 aa, Glycine max
  misc_feature (426)..(426): Xaa can be any naturally occurring amino acid
MKTFSSIQPPHHFRCTRFFSNTTTRAQLPFPAKVFFCQAKSDLHGGAFYSGIDGSLNLKVVSPTLLVAEKEEAKAVLTLFLKKQGLSNAIAARTSKKSDHFIDHLVSRLHSKHKSWYLAGRELTTLEIRDTLIPYLESLFEEHGDILVNVVENYPNPPGKDKSAVLVPPSNPVLDSKKLKAVSRVSETDPDGGNLRPHIVYLMELGMDIEQIRSITRRFPSFAYYSLEGKIKPVVEFFLELGVPKENIPTILTKRPQLCGISLSENLKPTMKFFESLGVDKNQWPKVIYRFPALLTYSRPKVMESIDFLLELGLSEEGIGKILTRCPNIVSYSVEDNLRPTAKYFHSLGVEVGVLLFRCPQNFGLSIENNLKPATEFFLERGYTLEEIGTMISRYGALYTFSLTENLIPKWDFFLTTGYPKSELVXVPSIFWVQFRGKD

SEQ ID NO: 8414 - protein, 98 aa, Arabidopsis thaliana
MAKYNEIAKKKREAKADRKRAIHGDPLTNKLKTRTPVPSVSGKRQRKLLRKWRREQKDMVEKGLVTMEDVEMASAQAASEDSKKSPRKFSVKKSLKLN

SEQ ID NO: 8415 - protein, 335 aa, Prochlorococcus marinus
MNKTILITGGTSGIGFQAAKLLLKAGCRLIIICRNQERSKELLLRFKNDNSIGKESILKNLDLRIADLADLNSLEKLTNKLIREDILIDIIILNAGLQYTGSKDIRLSKQSIELTFAVNHLSHQYLIQRLMKLVIKSEFPRIIVTASEVHNPLLAGGKVGRPAGLGNLLGLSSLKKVCMIDGTSIFNADKAYKDSKLCNVIFSRELYRRLKLRGLNIPIICWAPGLVIPRSKGGFFRYSRKYNELGQIVFSFIARDLLRITESVEKAGQILFNLAINSEYANPGFSYYSNRLKLFASSSLEESEISEEAKDDKKAFELWNLSNQLLIKYCTLETM

SEQ ID NO: 8416 - protein, 479 aa, Pyrococcus abyssi
MCLIAGGFNVSREDAIKIINLGKHRGPDSFGFWSERQMLKSDNFSDVSEIEGGEIALIQCRLAMTGSKSYTQPFYNEIILVHNGEIYNHESLRKYLIERGVAFETDVDSEVILRLLEYLVFDRKLKVEEAIKLSMKMLRGDYAVAFFFNGKFYLFRDPLGVRPLYYSSRGHFASEKKVLWGLGEDAEPVLPGEIVSISKHGITRVRGFNVFSIRTQGKDYFNGLQNLLIDSVKVRASKKVGVLFSGGVDSSLIALIASRYSDVILYTSGTEDSKDVEWARRVAEELGLKLRESLFSREDIENEIERIMFAIEEPNPMNLAIAIPLYFSTKRAREDGVKVLLSGQGADELFGGYAKYLQNPGLMLKDVEELGERNLARDDKVAMLNGVETRYPYLDLPFAILALNVPLELKIRDGKRKFILREIAKSLGLPEWVAEREKKAAQYGSNAQKILEKIAKSRGVKLKGLADILFSKVFHGIQN

SEQ ID NO: 8417 - protein, 184 aa, Colwellia psychrerythraea
MTDQRNDKAVQTATLAGGCFWCIESALNMVKGIITAKPGYMGGQSTAPTYEEVCTGSSGHAEVVQLEFDSEVISYREILEIFFSLHNPTQLNRQGNDIGTQYRSEVFTHDALQQKIALAIIEEINQEQLFDDSIVTEVSPAVTFYCGEDYHQNYFKNNPENQYCQAVVSPKLAKFRKTFVAKLK

SEQ ID NO: 8418 - protein, 279 aa, Oryza rufipogon
QPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPQYAAAAAAPSSVQYGGGVGAAPHIGSYGHHHHHHHHHGHGAASGASSVGECSTMPVMVPVDPHRSSMSSSMLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDS

SEQ ID NO: 8419 - protein, 347 aa, Bacillus cereus
MKDLIIIGAGQAGLTMGYYLKQEGYNFLLLEAGNRVGDSWRNRYDSLQLFTPRSYSSLPGMALIGEKNEFPYKDEIATYLEEYARHFQLPVQLQTEVLKIRKEKGIFELHTSTEILQTKKVIIATGGFQQPFIPSVSANLSSHVFQIHSSQYKSPSQIPKGKALVVGGGNSGMQIAVELAKTHEVTMSISHSLTFLPLHFFRKSIFNWLEKLGLLYAEVSTKRGKWFQKRKDPIFGFEGKELIRNGAIQLQEKVVSASENNIMFQNGETYSAESIIWSTGFIQNYNWIEIEKAVNENGLPNHIKGISPVRGLYYIGLPWQSQRGSALICGVGKDAAYLLSEIKKIDQ

SEQ ID NO: 8420 - protein, 301 aa, Candida albicans
MSNQVLKSPLSKSIKIALIQLKAGADKAANLTKVTKFIDDAVTKSTGVNLVMLPECFNSPYAVDQFRNYAEDIPQGETTQLLSSLAQKYKIYIIGGSIPEKGENDKIYNTSLTFNPQGEIIAKHRKAHLFDIDIPNGITFQESLTLSGGDKATVFKLGEYGNVGLGICYDIRFPELASIASRYPYNSFAMFYPGAFNTTTGPLHWHLLARARAVDNETFVVLCSPARDVEGGGYQAYGHSLVADPFGNIIAEAGEGEEILYAELDPALLPKARDGIPVHYQRRFDIYGDFVGEGKAKVSDK

SEQ ID NO: 8421 - protein, 755 aa, Sinorhizobium meliloti
MMRSVTSFNDSWVFSEGFDAADAGTLRAGQPISLPHNAVELPFNYFDERCYQRAFTYQRVLAWRPDFSGREVSLVFDAAMADAVVYLNGEEIVAHRDGYTPFEARLTDRLLEGDNLITVKIDGSENPEIPPFGGRIDYLTYAGIYRDVWLKVTDPVSIANIKIETRDVLSDTKAVSLRCDLSNPQGLSFSGTISALLKNAAGEVLAEVAGETTGQSLAFEMDGLKGLSLWDIDDPVLYVIEVELRTGQGSDCFAAHFGFRTAEFTTEGFRLNGRPLKIRGLNRHQSFPYVGYAMGRTAQERDADIMKHRLHCNLVRTSHYPQSKWFLDHCDRIGLLVFEEIPGWQHIGGEEWKQEAIRNVRRMIERDWNHPSIVIWGVRINESQDSHDFYAETNRLARELDPTRQTGGVRYITDSEFLEDVYTMNDFILGNEELPGANRPRTALRPQQECTGLPRKVPYLITEFGGHMYPTKIYDQEQRQAEHVRRHLEVLNAAYGDPGISGAIGWCMFDYNTHKDFGSGDRICYHGVMDMFREPKFAAYVYASQCDPSEEIVMKPVTFWARGERNIGGVLPLIVLTNCDEIELKYGSLTKRVGPDRENFPHLPHPPVVIDHRHFTKDELGVWGMKWESAEFTGFIAGKPVADLRMAADPVPTTLQVEADSKTLRAEGRDSVRLILRALDQAGNVQPFLNDAVDIEIHGPARLVGPARIVLQGGSAGFWLESTGAAGAIVVSVASSRLGAAKLDLVALADGAASA

SEQ ID NO: 8422 - protein, 435 aa, Leptospira interrogans
MSETPIVSNHDLGKYVDQKVVIQGWVHGIRGSNARQFLSLRNSGKILQVLAEKEILGEEVFQTVKHLRQETSVTVIGNLVKNEKSPIGFELVMESIQIVGESENYPITPKEHGIDFLISQRHLWLRSSKQLAILRVRDSLSFAIRKYFHERDFLLIDTPILTGSVGESAGTLFSTEYFDLGNAYLAQTGQLYLETAIFAHNKVFCYGPTFRAEKSKTRRHLTEFWMVEAEVAFATHAENLKLQEDFVKTVIKETVQNSFQDLKVLERDPAPLLAYLEKDFPVIDYTKALEILQSKGEDIVWGDDINSEREQLLTVEFGGPVFIQKYPREAKAFYMKVNPEDPRTVLNADLIAPDGVGEIIGGSEREENYENIVQRLKEEKLPVESYDWYLDLRKYGSVPHSGFGLGSERLIAWICGLAHVRECIPFPRMMERLYP

SEQ ID NO: 8423 - protein, 621 aa, Magnetospirillum magnetotacticum
MCGIAGLSAARPEILDEMVRRLAHRGPDGHGTFVCERTGFGLAHARLAVIDLTEGGRQPMHSPCGRWTIAFNGEIYNHAELRLELEGRGHTFRSSSDTEVLLALLAEKGEAALERLVGMFALALLDRADGSVLLARDRVGIKPLVWAGLPGGGLAFASEIKALKAVPGVDLSLDREALSQFLACLYVPAPYSIHAGIRKLAPGHLLRWKPGAAPEIACWWRPAFTAERALSVDDATEELMPALRDAVRSCMVADVPVGCFLSGGIDSSVIAALMAEARREQGASAPASFTMTFDEAAYDERVAARAVSDHVGTLHTELPASARLVDGLERMIAAFGEPFGNPTALLIGDLSAKARQHVTVALVGDGGDEVFGGYPRYQGGLLAAKWRKIPAFLRNGLIEPIVALLPESTSGRHTWRRIREFVAGAGLSDAEMYASWVEYFDPAQRRALLGGGTPPRPVADIYRATGRVHPLDAMQETDLLSFLPGNLMAYGDAMSMMHALELRLPLLDHRLIERVQAISAATRFQAGKKTLLKAAARRLLPAEIVDRPKLGFNPPMGLWLKNELAPMVAERLIPARMADLGLEWKGVEALLAEHRAGRRDLSLPVWALLVLERWQGLEASA

SEQ ID NO: 8424 - protein, 550 aa, Gloeobacter violaceus
MASSVLTVGEYLIERLYSHGVHHIFGVPGDYVLGFFKQLCDSPIKVINTCDEQGAGFAADAYARVRGLGAVCVTYCVGGLKVANTTAQAYAEKSPVVVISGAPGTNERHKNPLLHHKVREFDTQLKVFEQLTVAATVLDDPQTAFCEIDRVFEAALRYRRPVYIELPRNVARATGSACHLRELPQETSDPATLGEAVKEAVARINASRQPVILAGEELHRFALQPLLAQLIEKTNIPVASTILGKSVFPESHPRYLGVYEGAMGREDVRDYVEASDCLVLLGALMTDMNLGIYTANLDPRRSIYCATEKLTIGYHSYEDVRLQDFAAGLLAGEIERRVDGPTPHPLPLAQFQPVQDRPMTVLRLFQQLNAFLDDETIVVADPGDALFAGADLFIPGKTRFLAPAYYASLGFAVPAALGAQMADARLRPLVLVGDGAFQMSGLELSTIARFGLDPIVVLLNNRGYGTERPMQDGSFNDVLNWNYSRLPELLGTGRGFEVSTEDQLAAALHEARRHRGSFSLIDVHLEPGDLSPALRRMTDSMGQRVRPAAV

SEQ ID NO: 8425 - protein, 318 aa, Prochlorococcus marinus
METIEADVVIVGGGPAGCSCALYSSRADLKTVILDKNPAVGALAITHQIANYPGVPTDISGEDLLNLMRDQCIQYGTDYRRAQVFGVDVNGDWKTVYTPEGTFKGRALVLASGAMGRPASFKGEAEFLGRGVSYCATCDGAFYKGREVAVVGVNKEAIEEAQVLTKFASIVHWITSSDPKQEDVHAQTLINEPNVRHWSRTRLLQIEGADAGVTGITVKNRIQEDKQLLPVEGVFVYMAGSKPITDFLGDQIALKEDGGVVVDDFMSTTSEGVWAIGDIRNTPFKQAVVAASDGCIAAMAIDRFLNSRKSIRVDWVHS

SEQ ID NO: 8426 - protein, 293 aa, Methanocaldococcus jannaschii
MNQNNDFKCHIWFTEYHNNNVALSVRVKDILYREKSGFQEIEIIDTYDFGKALILDNTFQTTERDEFIYHELISHIPLFTHPNPRNVLVIGGGDGGTVREVVKHKSVETVDFVELDEKVIEACKKYMPKLSCEIDNEKVNLIITDGIKYVAETEKKYDVIIVDCPDPVGPAKGLFEKEFYKNVFKCLNDDGIMVQQSESPLYNLDLIQNICRYLKDAGFKIIMPYTYPMPTYPSGFWSFTLASKKYNPLEVDEARIKEALKDMETKYYDEEVHKGIFLAAPKFLKDAVKKALE

SEQ ID NO: 8427 - protein, 715 aa, Crocosphaera watsonii
MQEFDKSISFDGRDIRLKLGLLAPQAGGAVLIQSQDTAVLVTATTTKGREGIDFLPLTVDYEERLYAAGRIPGGFLRREGRPPERAILISRLIDRPLRPLFPNWWRKDIQIIATTLSMDEEVPPDVLAVTGSSIAVIQAGIPFYGPMAAVRVGLIGDDFIINPTYREVENGDLDLVVAGSPDGVVMVEAGANTLPEQDIIEAIDFGYEAVRDLIGAQYDIMEELGMEIGKAEPPSTNEVLEKFIEKQAADSIKKVLVQYDLSKADRDTALDNIKETAIEEAISELSEEDPIKVATTEDPKAVGNLYKGLTKKLMRSQIISEGIRVDGRKLDEVRPIACRVGLMPPRVHGSALFTRGLTQVFSLATLGTPGDAQDLGDDLHPEDEKRYLHHYNFPPFSMGETKPLRSPGRREIGHGALAERAILPVLPPQEEFPYVVRVVSEVVSSNGSTSMGSVCGSTLALMDAGVPIIKPVSGAAMGLIREGKEVRILTDIQGIEDFLGDMDFKVAGTDSGITALQMDMKITGLTMDIVAKAIQQALPARLHILDKMLATIAQPRRDLSPFAPRLLTMKIDPEQIGLVIGPGGKTIKSITEQTGSKIDIADDGTVTIAAIQARKAEKARDLIFNMTRKLKEGEVYLGRVTRIIPIGAFVEVLPGKEGMIHISQLAERRVGKVEEEVAVGDEVVVKVREIDNKGRLNLTRLGIHPDEAAAVRRTF

SEQ ID NO: 8428 - protein, 465 aa, Magnetospirillum magnetotacticum
MPFYVLPISLAYLAANLSERHTVKVVDCSADQIPEDSEEFRQIIRDFAPDMVGSSATYVTYNYAVMALKTAKAVSPDIITIMGGAHPSIYPDRIITTDREIDYLMCGEAERSFPRFVDALADGTGFEDVAGLVYRRGDDIVKNPLDLNAELDTLRRPDYDVMGLEKYIAHDYSYGGLYGRSAPIWFTRGCPFACTFCSAYLITGKKVRHHSMDYMVEWIDHLYHQYGIRQFAFIDDGLTVFPDIPKQFCRTIIDLRRKGHWAEPIYFTSPNGTRMEKLDDELLRLMKEAGWQGLTIAPESGSRRVLKQIKKSLDPDIVPDVVRRIKAAGLGVRGFFIFGFPGETREDIDETIGLIRRCDFDTFNIGRFLPIPGTPIFNQMVADGEISADHIPGQVFEYVTASEAGLGTYTPATLKDVNLNLLALREQIYLYLRKPSSIVYFARYYGIGRVLSYILFMVRKRFKAA

SEQ ID NO: 8429 - protein, 162 aa, Unknown
  Shewanella sp. ANA-3
MKLDYVIVAGGCFWGLEDLLRSLDGVTSTKVGYSGGDFDDPTYADIITGKTGHAEAVRVEYDQDEISLEEILHYFFKIHDPTTKNRQGNDVGTSYRSAAFYRDDAQKAIIENVIDEVNEIGRFENEVVTTVTLETEFYDAEAYHQNYLQRNPSGYSCHFERD

SEQ ID NO: 8430 - protein, 237 aa, Unknown
  Acidovorax sp. JS42
MAGILLSPDPGRRTDLSMKAQTKSKKVNKAWLHDHVNDTYVKLAQKEGYRARAAYKLKEIDEQLGLIKPGHVVVDLGSSPGAWSQYVRRRLSPDGAAVGQLNGVIIALDILPMEPIEGVTFLQGDFREEEVLAGLQEAVQARPVDVVVSDMAPNLSGVESVDAVRIAHLIELAVDFAVHHLKPEGALVVKLFHGSGYSQLVQLFKDTFRVVKPMKPKASRDKSSETFLVGMGLKRQG

SEQ ID NO: 8431 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETAKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 8432 - protein, 428 aa, Clostridium tetani [sequence omitted]

SEQ ID NO: 8433 - protein, 471 aa, Unknown
  Rhodococcus sp. RHA1
MSGTTDPQLQHTLKKRHLSMIAIAGVIGAGLFVGSGVAIRETGPGVLVAYALAGIVVILVMRMLGEMSTANPETGSFSAYADRAIGRWAGFSIGWLYAWFWIIVLGIEATAGAVIMNRWIPDVPQWSWALILMVLLTLTNIASVKSFGEFEFWFASIKVAAIVIFLVLGVLAICGALPGVEAPGLTNLTGHGGFFPNGAGAVFAAVLVVVFSFFGAEIATIAAGESANPVAAVRNAVRSVVWRILIFYIGSIAVVVTLLPWDDASVALSPYVAVMDSFGIPAAGNIMDVVVLTSVLSCLNSGLYTASRMIFSLSRRGDAPASLSKIGSSGVPRQAVLVSTVVGFLTVGLNYLYPDTVFLFLVNSSGAIALFVWLAISVSQLRMRRSLEAEGKDLSLKMWLFPYLTWCTIAAIIALCVGMLVLSETRSQMYVSMGLAVVVVGIGIYRQHTRGTTDETPDPSPSGEEVDALRP

SEQ ID NO: 8434 - protein, 279 aa, Clostridium tetani
MFIIKRGLIMERMQFNRKEYLKDVKNIVVKVGSSTLTYENGLLNLFHIEHLVRQLVDLHNRGYNVILVSSGAIGAGVGKLGLSEKPKSIPEKQAAAAVGQGILLHTYEKIFAEYGKTIGQILLTKEDMIDEVRSCNATNTFNALLDKRVIPIINENDAVVVDEIKVGDNDTLSAFVSKLVKADLLILMSDIEGLYSCDPRINNDAELINFVEKITKDIISCAGGAGTDLGTGGMATKIKAAKIATSAGIPMLIVNGATNEVLQDVVEGKSVGTWFNAIK

SEQ ID NO: 8435 - protein, 216 aa, Unknown
  Dendrobium sp. XMW-2002-8
MGRSPCCEKAHTNKGAWTKEEDERLVAYIKVHGEGCWRSLPKAAGLLRCGKSCRLRWINYLRPDLKRGNFTEEEDELIIKLHSLLGNKWSLIAGRLQGRTDNEIKNYWNTHIRRKLLSRGIDPTTHRPLHGQADASFVNEVEKVVSFRRREDENKSSNSSSSNSRSNSEEAKRWRCPDLNLELCISPPLQKQEDSEEDMMREEFGLCFTNGLLEFR

SEQ ID NO: 8436 - protein, 657 aa, Medicago truncatula
MACISIHNFMLLLLFLFHFTPTSAQVPIFLYSFCQNSTEKSLTASYKSNVNKLLLWINSDSAAGTEFNNNKIGSNNTTSDDVYGNYDCRADVTGSFCQFCINTAVKEIAQRCLNSDTAVIFYDVCIIRYSNKNFFGNVSITPSWNVTGSKKIKDSTELTKVEDYIGILIRKVTVETNQSWGASEFNSNETGKRYGFLQCARELDKEGCRQCLEAVLDLVPKCCGTKVAWEVVVPSCGIKFDDQKFFQLNDQSGSSSLKPNQAKQEGASNKKTLIIILVSVLMAVALLCCCVYYYWRKNGLCKASLVGGFLLRKTLNIDDTLNGDLPTIPFSVIQHATNYFSSSSKLGEGGFGPVFKGTLPDGTEIAVKRLAETSGQGSEEFKNEVIFIAKLQHRNLVRLLGCCIEGNEKILVYEYMPNSSLDFHLFDEEQHKKLDWTLRLSIINGIARGLLYLHQDSRLRVIHRDLKASNVLLDDEMNPKISDFGLARKFEKGQSQTKTKRVIGTYGYMAPEYAMAGLFSVKSDVFSFGVLVLEIVYGKRNGEFILSEHRQSLLLYTWKLWCEGKSLELIDPIHKKSYIESEVMKCIHIGLLCVQQDAADRPTMSTVVAMLGSDTMPIPKPKQPAFSVGRMTEDDPTLKSYKDNYVDEVPITIVSPR

SEQ ID NO: 8437 - protein, 535 aa, Unknown
  Rhodococcus sp. RHA1
MTAENRGDRTDVDKALLGHTTYRSLGEQHLSPAEERFEKGRRTIGLFLAPLITIAFLALPIDIPPNQQTLAGVLLGVIVLWVTEAVPIPIGGLLGVAVVVFLGVAPADEVLAAFGSSTIFTFIGAFILAQAMLKHGVARRFAFRILTLPRVGQSTTGVIVAFGAITCGLSAFVSNTATVAMLLPTALGILGVVAKLMQRRGVVAEDFDPLRLRVGAAIMLMLAYSASVGGLLTPVGSPPNLIGRGLIEEATGERISFGQWMVMAIPICLLMFIALAIILLRLNKPEIRRIEGVADYLAEQRAEMGPLSRAEKNTLIAFGVTVTLWILPGVVAVVAGNDSDLYGTISDRLDEGMVAVFGAALLYLLPTDWENREFTLTWRDAAKIDWGTIVLFGSGIIFGALLADTGLAETIGTSVADSLGLTSVVAITVFAVLLAIAVSETTSNTASAAVVVPIVIPVALAAGVNPFVPALAATFAASFGFMLPVSTPQNAVVYGSGAVRITTMIRSGITFDIVGAILIIVFLPLMIGVVGLGGG

SEQ ID NO: 8438 - protein, 402 aa, Desulfovibrio gigas
MQATKIIDGFHLVGAIDWNSRDFHGYTLSPMGTTYNAYLVEDEKTTLFDTVKAEYKGELLCGIASVIDPKKIDYLVIQHLELDHAGALPALIEACQPEKIFTSSLGQKAMESHFHYKDWPVQVVKHGETLSLGKRTVTFYETRMLHWPDSMVSWFADEKVLISNDIFGQNIAASERFSDQIPVHTLERAMREYYANIVNPYAPQTLKAIETLVGAGVAPEFICPDHGVIFRGADQCTFAVQKYVEYAEQKPTNKVVIFYDSMWHSTEKMARVLAESFRDEGCTVKLMWCKACHHSQIMSEISDAGAVIVGSPTHNNGILPYVAGTLQYIKGLRPQNKIGGAFGSFGWSGESTKVLAEWLTGMGFDMPATPVKVKNVPTHADYEQLKTMAQTIARALKAKLAA

SEQ ID NO: 8439 - protein, 220 aa, Unknown
  Dendrobium sp. XMW-2002-10
MGRSACCEKAHTNKGAWTKEEDERLIAHIRTHGEGCWRSLPKAAGLLRCGKSCRLRWINYLRPDLKRGNFTDEEDELIIKLHSLLGNKWSLIAGRLPGRTDNEIKNYWNTHIRRKLLNRGIDPATHRPVSTATASNLTMSFSSGSSVKDKRTSSSSSSSRVGRISALLPRCPDLNLDLCISPSLEEQMPQDLLVEESNCGGEFLRLGSSFLLDYRSLEMK

SEQ ID NO: 8440 - protein, 292 aa, Zea mays
NNLFRTPLEAGGGAPWAERARVVGTQIRNRFRVAPVDHRSLWLRADGRVATEAVRRWSDRVRALLQRGRSADRNSTSTETSPEAVAKPSSSVLRFYRKRVGKEVNGIEDSVIFRSLQALAVPLIGNACYVFMHGLNSVQVYGVEKLHQALHGRPKGKALLTVSNHVAAMDDPFVIASLLPPSVMLEAQKLRWTLCATDRCFTNPVLSTFFRSVKVLPVSRGDGIYQKGMDMALSKLNSGGWVHIFPEGSRSRDGGKTIAPAKRGVGRLVMDADSLPVVIPFVHTGMQDIMPV

SEQ ID NO: 8441 - protein, 179 aa, Staphylococcus aureus
MHNDLKEVLLTEEDIQNICKELGAQLTKDYQGKPLVCVGILKGSAMFMSDLIKRIDTHLSIDFMDVSSYHGGTESTGEVQIIKDLGSSIENKDVLIIEDILETGTTLKSITELLQSRKVNSLEIVTLLDKPNRRKADIEAKYVGKKIPDEFVVGYGLDYRELYRNLPYIGTLKPEVYSN

SEQ ID NO: 8442 - protein, 828 aa, Photobacterium profundum
MKMTRRAFVKANAAASAAAVAGITLPASAANLIVSSDETKIKWDKAPCRFCGTGCSVLVGTQNGRVVATQGDPEAPVNKGLNCIKGYFLSKIMYGKDRLQTPMLRMKNGEYNKEGDFAPVSWDQAFDVMAEKFKKALKEKGPTSVGMFGSGQWTVMEGYAASKMMKAGFRSNNIDPNARHCMASAVGGFMRTFGIDEPMGCYDDFEHADSFVLWGSNMAEMHPVLWTRITDRRLSHPHVKVNVLSTYYHRSFELADNGMIFEPQTDLAIANFIANYIIQNDAVNWDFVTKHTHFKRAETDIGYGLRDDNPLQMKAKHPNSGALHPMDFEQYKASVAEYTVEKASQMSGVSEEKLIEMAKQYADPKVKVMSLWTMGMNQHTRGVWMNSLVYNIHLLTGKISQPGNSPFSLTGQPSACGTAREVGTFSHRLPADMVVANPKHRAIAEKIWKLPDGTIPAKPGYHAVQQDRMLKDGKLNAYWVMCNNNMQAGPNINEERLPGYRNPENFIVCSDPYPTVTAQASDLILPTAMWVEKEGAYGNAERRTQAWYQQVKSQGDSKSDLWQLMEFSKRFKIEEVWGEDLLAQMPEYRGKTMYEVLFRNGQVDKFPLSEAQELNDDAKAQGFYLQKGLFEEYAAFGRGHGHDLAPYDVYHQVRGLRWPVVDGKETLWRFVEGSDPYVPEGEGFRFYGKPDGKANIIFAPFEPAPEEPDQEYDMWLCTGRVLEHWHTGTMTRRVPELYKAVPDALCFIHPDDAQKRGLRRGDEVLLESRRGEVRCRVETRGRNRPPVGLVFVPFFDARVLVNKLILDATDPLSKQTDYKKCPIKITKV

SEQ ID NO: 8443 - protein, 177 aa, Trichodesmium erythraeum
MLDTIVLGGGCFWCVESVFLSVVGVKEVESGYAGGNTKNPDYRSICSGKTGHAEVVKVSFDTEKISLSQILEIFFATHDPTTPNRQGNDVGTQYRSVVMCHSQEQKDIAQEVISTLGNNGTFENPIVTEVVDLKDYYRAEEYHQNYFNKNPYQPYCVFSIPPKLQKLKKYFPDQVSA

SEQ ID NO: 8444 - protein, 789 aa, Coccidioides immitis
MTSQGSSRKRPAPGTVPISQHPIAPSHNYPVSDSQLSNDQFLQWGQAGPPLVNPPGNSPIDPYQSVPHPADMGSIQAASQQLARRPGNQLIGRPRKNEQGVMTLMEPPPRPGEVIDPATGETEEQLEQRALAAKKEAQAKRKQIPPFVQKLRSFLDESKNTDLIRWSEDGRSFIVLDEDQFARTLIPELFKHSNYASFVRQLNMYGFHKKVGLSDNSMRASERKNKSPSEYSNPYFRRGHPDLLWLIQKPKNVSQSKAAAKGPSRMKTEGEGDDGENEEYVEDGGSREDRSRFRGQLSISPGDAALAKEQFANVYRELQNIRHQQQVISNTISKLRREHEQLYDQALNFQEQHNRHENSINAILTFLATVYNRSLQGHDGAQGMINSFAAGTMPQEQGQGNIIDVGDYLGNVESNLNPAQRPTKKQPLLLKAPPAGGQEPSPSRASTSSPANNQYDIQQGTNNGHGHRPSTRAGSVEELFESVSPQHTGQPPHQQPYTPVSHARSPSDAKYPPQRDIMSLIQSSNARSNMQPGAADFPSVLSSLENAGGHVPLTATQRADMLRLIANESHASDPSAISSPNNALITPNPPPMPHSYSTRLANTRAEIDNLVKMQAEQDRNVPPPTLDLDQIFHSGDYFSDYANMEPIKGGMASGYGSNQGAQTNTQDDHNNENSGDSLVAQAHDLFDFDKLQSDHVGELFADGNTDPKQAQTNSFFDAYGSGNEGGNLRQTGAGDLSGNGGNRITETFTSSEATSPANTSVDENLQALDNSNGSSFGARSPVKRRKRAQ

SEQ ID NO: 8445 - protein, 263 aa, Campylobacter coli
MVSMRDLLECGVHFGHQTRRWNPKMKKFIFGERKGIYVIDLQKTLRYFRYTYNIVRDAAAEGKTILFVGTKKQAGGAIKEYAEKCGMPYVNHRWLGGMMTNFGTIRQSIRKLEVIEKMEEDGSIKLLTKKEALMLTRKKEKLLAYLGGIRYMKTQPDMIFVIDTVKEKIAVQEANRLRIPVVAPLDTNCDPDLVTYPIPGNDDAIRSVQLFCQEMAEAINEGKALREQDGEALPSEEKEITDEEKKEVLDEAMSEEDFNGEQE

SEQ ID NO: 8446 - protein, 310 aa, Staphylococcus aureus
MAQKPVDNITQIIGGTPVVKLRNVVDDNAADVYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEVHELTTGPELLQQFEGKTIDAFLAGVGTGGTLSGVGKVLKKEYPNIEIVAIEPEASPVLSGGEPGPHKLQGLGAGFIPGTLNTEIYDSIIKVGNDTAMEMSRRVAKEEGILAGISSGAAIYAAIQKAKELGKGKTVVTVLPSNGERYLSTPLYSFDD

SEQ ID NO: 8447 - protein, 340 aa, Psychrobacter arcticus
MQNKSIPSLPSMNRQPLGFFPTPLIELTRLSKALNGPKIYMKRDDNTGLALGGNKTRKLEFIIGDALAQGADTIVTAGAAQSNHCRQTAAAAASLGLECHLVLGGQEPDQLNGNLLLDKIFGCHIHWAGNNRKGEDIPDIVEQLENAGKKPYVVPYGGSSELGAFAFIEAFKELESQRQEMDISFTHIVFASSSGGTQAGLMLGNKIFNSPYQIVGINIDKGETDKVPFDQYIVSLANSTAALIGADYSFSETDLMLNSDYVGDGYGVIGALENEAIAMTAQTEGILLDPVYTGRAMGGLIDMIRTGKIKKTDSVLFWHTGGAPALFAYASALAVSQSDS

SEQ ID NO: 8448 - protein, 436 aa, Bacillus cereus
MIGRGWDDMFCYQCEQTPTGGCKVMGVCGKNETIASLQDTIVFGLKGIAAYRTHAAQLGYTDAFVDATTQEALYMTLTNSNFNEQEHVDMAMKVGKSALRVMELLDEAHTNHFGVPEPVQITQNRVEGKAIVVTGHNLFALEELLKQTEGKEINIYTHSEMLPAHGYPQLKKYKHLKGNIGKAWYDQRRLFEKFTGAILATTNCVMPIKGSYSDRFFSYDIAGLEGVQKIENDNFAPLIQKALELPEVHMESDEQLVTGFHHNTVLSLAPEIIEAVKEGKIKRFFVIAGCDAPGKGGEYYRELATSLPPETVILTTSCGKFRFNDVDYGVVPGTEIPRYIDLGQCNNSISTVKIAAALADAFQCEVNELPVSIVLSWFEQKAVAILLGLFSLGIQDIRIGPKAPEFISAGVLDVLQETFGLKLITTAAEDMEMMLS

SEQ ID NO: 8449 - protein, 1201 aa, Oryza sativa
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYHGFYSDEVVPLDPAGGEHWHKAGGAGLGTLRGGVYAVGGDGTMRGAARIHREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWSFVVYLGGHSHGRGGAALASSQERAKNSHHEFLGSFLGSKEKARDAIFYSYTKYINGFAATLEEEEAMEISKHPSVISVFPNRGHRLHTTRSWEFLGMEKDGRIRANSIWAKARFGEGVIIGNLDTGVWPEAGSFSDDGMGPAPVRWRGICQDQASDDAQVPCNRKLIGARYFNKGYLSTVGQAANPASTRDTDGHGTHTLSTAAGRFVPGANLFGYGNGTAKGGAPGAHVAAYKVCWRPVNGSECFDADIIAAFDAAIHDGVDVLSVSLGGAPAGYLRDGVAIGSFHAVRRGVTVVCSAGNSGPGAGTVSNTAPWLVTVGASTMDREFPAYLVLGNNKKIKGQSLSPVRLAGGKNYPLISSEQARAANATASQARLCMEGSLERGKVEGRIVVCMRGKNARVEKGEAVRRAGGAGLVLANDEATGNEMIADAHVLPATHVTYSDGVALLAYLNSTRSPSGFITVPDTALDTKPAPFMAAFSSQGPNTVTTQILKPDITAPGVSILAAFTGQAGPTGLAFDSRRVLFNAESGTSMSCPHVAGVAGLLKALHPDWSPAAIKSAIMTTARVKDNMRRPMSNSSFLRATPFSYGAGHVQPGRAADPGLVYDMNDTDYLGFLCALGYNSSVIATFMASGSGAQPPYACPPARRPEDLNYPSFALPHLSPSGAARTVTRRVRNVGAAPAAYVASVAEPRGVSVAVRPSRLEFTAAGEELEFAVTFRAKKGSFLAGEYEFGRLVWSDAAAGGRHRVRSPLVVRVVDKKGKNGLPIS

SEQ ID NO: 8450 - protein, 582 aa, Unknown
  marine gamma proteobacterium HTCC2080
MIYAATLILAACSLLYELLIAQALATFAANTVTWYSVTVGLYLAGMGLGALLHDQHPTDNLWARFFKVEIALSAAGAIAVPLLHFSHTGALLLELYGLTFLGEVLFFGTGFLSITTIGILTGFELPVLIDLANTAKDKRRLTNRVLASDYTGSLLGGLAFPLILLPKLSLVAIGLIAATLNVFLAILALYFFLPKLHRSSFGFIVSGSLVIMLGLGLSLAPSLDRYFTKLYYFYWDQSEDFKQLFASMDNTEDVFRVRSPYQRIDLVHDKNGSGPSPVDDFYSSKFVDNPQQPKNYSLFLNGDFQLASNYEEYYHEFFAHIPIMTNGAVPRHVLVMGGGDGLLLRELVKYSDIKTIVHVDLDRELIEQATTHPVLLAMNEGALSDPRITRHFDDAYRFIRNSSEQFDAIYLDFPDPRDYNLSKLYSREFYHFVRQRLTSDGFIALDSPGLRHNKERREIYTSTLAAAGYKFVTPYISKIETINEAAYEFLLASGYEEEKARRLLASHAASMRLGFITARDNWPDRPIYQDPRVKLHVINDTRLYLTLRNLIPSLAPTDPDKINSIFRPTLPSGNIWHVRDPW

SEQ ID NO: 8451 - protein, 546 aa, Rhodobacter capsulatus
MYCIQCEQTLHTATGTGCRFARGDCGKTAAISDQQDALVAALLAVSSHADAARKVGLIDAEVDAFVPQALFATLTNVNFDPERLAGYIRKAQELRNRLQLALAGKPLALPALADADWPFAAAQQAEAGKIVALNRDAARIGEDVLGLRLLCLYGLKGIAAYMEHARVLGQTDTQVAAGFHAHMAYLASEPTDAKGLFAEALAIGTLNFRVMEMLDAGATGTFGDPQPTPVNRRPVAGKAILVSGHDLHDLLRILEQTAGRGINVYTHGEMLPAHGYPAFHAHPHLIGNYGSAWQNQQAEFAAFPGAIVMTSNCLIDPRTGAYQDRIFTRSIVGWPGVRHIEGEDFAEVIACAEALPGFAATEAPVTQLTGFGRNALMTAAPAVIERVKVGKIRHFYLIGGCDGARAERAYYADLARMLPQDTVVLTLGCGKFRLDGIDFGAVDGLPRLLDVGQCNDAYAAIRLALALAEAFDCGVNDLPLTLVLSWFEQKAIVILLTLLALGVKDIRVGPTAPGFLTPNLIATLNAQFGLRLISTPEETMAETLSA

SEQ ID NO: 8452 - protein, 300 aa, Solanum lycopersicum
MAEKNRLVTVAALQFACTDDVSTNVATAERLVRAAHQKGANIILIQELFEGYYFCQAQKEEFFHRAKPYPGHPTIVRMQNLAKELGVVIPVSFFEEANNAHYNSVAIIDADGTDLGLYRKSHIPDGPGYQEKYYFNPGDTGFKVFQTKYAKIGVAICWDQWFPEAARAMALQGAEVLFYPTAIGSEPQDDGLDSRDHWRRVMQGHAGANVVPLVASNRIGKEIIETEHGNSEITFYGYSFIAGPTGELVAAAGDKEEAVLVAQFDLDKIKSKRHGWGVYRDRRPDLYKVLLTLDGSNPVK

SEQ ID NO: 8453 - protein, 210 aa, Arabidopsis thaliana
MMEVKLWNDKREREMYENFAELFAIIKATEKLEKAYIRDLINPSEYESECQKLIVHFKTLSATLKDTVPNIERFADTYKMDCPAALYRLVTSGLPATVEHRATVAASTSNSASIVAECVQNFITSMDSLKLNMVAVDQVYPLLSDLSASLNKLSILPPDFEGKTKMKEWLSRLSKMGAADELTEQQSRQLHFDLESSYNSFMAALPKAGN

SEQ ID NO: 8454 - protein, 164 aa, Brassica napus
SRSPPERPGFTCENGQCPHSKINLGFQDRSSRDNHQMVCPYRDNRLAYGVRPVVVSQQSQPFPQPVQPIDLSGYGVPKNGQKMITELMAMYDRNVQSSQASNQSMIIDSTAAQNYQEQQLCFNRNQMFMQQGNSEINNQSQMVFDSTSFDISSFDYKNDWQAGV

SEQ ID NO: 8455 - protein, 276 aa, Bacillus subtilis
MSELWYTEKQTKNFGITMKVNKTLHTEQTEFQHLEMVETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVDVQVDDGFMHIAKSENQYDVIMVDSTEPVGPAVNLFTKGFYAGIAKALKEDGIFVAQTDNPWFTPELITNVQRDVKEIFPITKLYTANIPTYPSGLWTFTIGSKKYDPLAVEDSRFFDIETKYYTKDIHKAAFVLPKFVSDLIK

SEQ ID NO: 8456 - protein, 467 aa, Unknown
  Bradyrhizobium sp. BTAi1
MTQTPAAPRTDRSNLAPIPFECDAPFLEISGELPRELNGTLYRNGPNPQFSSPGAHWFVGDGMLHAFHLENGRASYRNRWVRTPKFEAERRAGRALFGGFGRKLPDAPADVTDGGVANTNIIAHAGRLLALEEAHLPTEIEPGTLATSGYHDFGGRLRGAFTAHPKTDPVSGELLFFGYNAAGPLTPALTYGTVDASGRLTRLDRFDAPYASMVHDFVVTADHVLFPIMPLTGSLERAMSGRPPYAWEPDKGAYVGIMKRGGAVKDIVWYRGEACYVFHVMNAWEDGHHIIADVMQFDEPPLFPHPDGRPTDPAKSRARLCRWSFDLAGTSERFTQTYLDDLTGEFPRIDDRRAGLPSRHGWYACANPDGPLFGALSGLAQVDGAAGTRRATYLLPDGDSLSEPVFVPRRADAAEGDGWLLTVVWRAATNTSDLAVLNATDIASGPVALVHLGHRVPDGFHGNWVGA

SEQ ID NO: 8457 - protein, 713 aa, Bacillus anthracis
MLKVKRPFDAYLDEMNKITILLPHAYGTSRTFRLQEGSNVKDLPIAHTIALPDATKYECFIEEPLDVGKYYTVRDERNEETDLQIGAVIRTEIFDEKYYYEGTDLGAVYQKEATTFKVWAPTARLAKVRIYKSDKEYTDHEMHREENGVWAHTLQGDLAGEKYTFLVCINLIWNEAVDPYAKSVTVNGKYGVVIDLEKTNVTKQEQLPPLQAMTDAILYELHIRDATIHEGSGVSKKGTYKGLMEEGTTGRNGTLTGLSHIKDLGVTHVELLPLYCFGGVDEANPSSAYNWGYNPLYYNAPTGFYATNPSDPYNRILECKQLIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNANKMPHIAQFNDQFRDGIKGSTFHINKRGFAFGGHVDRNHLRYIASGSLLSMKETGLFLEPVQSINYVECHDNMTMWDKLMRSNEESEEILKKRHVLATAMVILSQGIPFLHAGQEFYRTKQGNENSYNANDEINQLDWDRKEKEIETVNYIKGLIAIRKEHGAFRLQNADLIKKHMTFLQTSPEVLAYHLEHVESFGPWKEIVVLFNSSLEAKTVQLPKEETWHVLVNEKQAKIEPISSFRGKELRLSPISTYILTIM

SEQ ID NO: 8458 - protein, 303 aa, Escherichia coli
  misc_feature (41)..(41): Xaa can be any naturally occurring amino acid
MSTLEQTIGNTPLVKLQRMGPDNGSEVWLKLEGNNPAGSVXDRAALSMIVEAEKRGRIKPGDVLIEATSGNTGIALAMIAALKGYRMKLLMPDNMSQERRAAMRAYGAELILVTKEQGMEGARDLALEMANRGEGKLLDQFNNPDNPKAHYTTTGPEIWQQTGGRITHFVSSMGTTGTITGVSEFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 8459 - protein, 441 aa, Unknown
  Rhodococcus sp. RHA1
MTVDTAHLTEAAAANPTLTHSLADLDPAVHQAIAAELGRQQGTLEMIASENFAPLAVMQAQGSVLTNKYAEGYPGRRYYGGCEHVDVIEQLAIDRLTALFGAKFANVQPHSGAQANAAAMSALLEPGDGILGLDLAHGGHLTHGMKLNFSGKLYDVAAYHVREDDHLVDMDEVEHLAREHRPKLILAGWSAYTRQLDFAAFRRIADEVGAYLMVDMAHFAGLVAAGLHPSPVPHAHVVTSTTHKTLGGPRGGVILTNDEALAKKFNSSVFPGQQGGPLEHVIAGKAVSFKLAAEPEFRERQERTLAGAKILADRLLKDDSRQAGINVVSGGTDVHLVLVDLRESELDGKQAEDRLHRVGITVNRNAVPFDPRPPMVSSGVRIGTPALATRGFDLDAFTEVADIISYALRPATDEAGLDELRGRVDALALRFPLYPDLTEAN

SEQ ID NO: 8460 - protein, 334 aa, Prochlorococcus marinus
MASRIFITGATSGIGYQCSLRLIKAGHQLIIPCRDIDRREFVLRSFARDQINISEVEELVSLPILDLGDLNNIEKFANEFVSNNSRIDTIILNAGLQYTGDKQIRRSSQGIELTFAVNHLSHQYLIQALLDILLKSDFPRVVITSSEVHNPDSPGGKIGESASLGNLEGIKASRYFKMIDGSYTFSADKTYKDSKLCNILFAKELNRRLTLRNLSMPVICWAPGLVIPRTQEGFFRYSRKNNELGQRLFALFARDIFRITESPERAGEILKNLAISDRYLTNGFNYYSNKIQGFSRMKFENTNVSEEANEEIKAKELWELSNKIILNSVNLNTI

SEQ ID NO: 8461 - protein, 303 aa, Agrobacterium sp.
TRQMILAVGQQGPIARAETREQVVVRLLDMLTKAASRGANFIVFPELALTTFFPRWHFTDEAELDSFYETEMPGPVVRPLFEKAAELGIGFNLGYAELVVEGGVKRRFNTSILVDKSGKIVGKYRKIHLPGHKEYEAYRPFQHLEKRYFEPGDLGFPVYDVDAAKMGMFIANDRRWPEAWRVMGLRGAEIICGGYNTPTHNPPVPQHDHLTSFHHLLSMQAGSYQNGAWSAAAGKAGMEENCMLLGHSCIVAPTGEIVALTTTLEDEVITAAVDLDRCRELREHIFNFKQHRQPQHYGLIAEL

SEQ ID NO: 8462 - protein, 434 aa, Unknown
  Nostoc sp. PCC 7120
MTTLQVASSLNDIAQQTRQAASLLAMLSTEAKNQAIAAVAQALESAKEEILQANIDDCEAATAEGIAKPLYKRLQLDEHKLRDAIAGVRDVGKLADPIGQVQIQRELDTGLVLKRITCPLGVLGIIFEARPEAAIQIISLAIKSGNGVILKCGKEAVRSCEAIVKAVKQGLSTTDVNPEVVQLLTTREETLELLRLDKYVDLIIPRGSNSFVRFVQENTRIPVLGHADGICHVYIDKSADIEKAIAVSVDAKVQYPAACNAIETLLVHQSIAAEFLPKVAQALAEREVELKGDERTLQILPEIAAATAIDWETEYSDFILSIKIVDSLTEAIAHINQYGSRHTDAIITEDVAAVKTFFGLVNSAGVFHNCSTRFADGFRYGFGAEVGISTQQMPPRGPVGLEGLVTYKYQMTGAGHIVATYTGENAKPFTHKDF

SEQ ID NO: 8463 - protein, 418 aa, Vibrio fischeri
MNLTTMGQAAKAAAFDLAVAPTAQKNKALAIIADELEANKDAILAANEKDIKAAVEAGISEAMQDRLLLTEERLVGIANDVRNVINLNDPVGSEIDSKVLENGMSLSRRRVPIGVIGVIYEARPNVTIDIASLCLKTGNASILRGGKETFFSNMELVKVIQVALEKAGLPAASVQYIEKPDRELVSQLLTMDDYVDMIIPRGGAGLHKMCKENSSIPVIIGGFGISHAFVDESADLERALVVVDNSKAQRPSACNALDTLLVHEAVAPQFLALLANNMAGRVELVAEPKAYGLLKEFEGVSLREAQEGDFDTEWLSYTLGVKVVADVNEAAAHMQKHNASHSDTILTNNIESAEKFINTAGSAAVYVNASTRFTDGAQFGLGAEVAVSTQKLHARGPMGLEELTSYKWVGKADYLIRS

SEQ ID NO: 8464 - protein, 267 aa, Clostridium tetani
MQFNRKEYLKDVKNIVVKVGSSTLTYENGLLNLFHIEHLVRQLVDLHNRGYNVILVSSGAIGAGVGKLGLSEKPKSIPEKQAAAAVGQGILLHTYEKIFAEYGKTIGQILLTKEDMIDEVRSCNATNTFNALLDKRVIPIINENDAVVVDEIKVGDNDTLSAFVSKLVKADLLILMSDIEGLYSCDPRINNDAELINFVEKITKDIISCAGGAGTDLGTGGMATKIKAAKIATSAGIPMLIVNGATNEVLQDVVEGKSVGTWFNAIK

SEQ ID NO: 8465 - protein, 478 aa, Streptococcus pneumoniae
MDDNGYDIADYQAIAAIFGTMEDMDQLIAEAKKRDIRIIMDLVVNHTSDEHAWFVEACENTDSPERDYYIWRDEPNDLDSIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKDLLTVGETWGATPEIAKLYSDPKGQELSMVFQFEHIGLQYQEGQPKWHYQKELNIAKLKEIFNKWQTELGVEDGWNSLFWNNHDLPRIVSIWGNDQEYREKSAKAFAILLHLMRGTPYIYQGEEIGMTNYPFETLDQVEDIESLNYAHEALEKGVPIEEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 8466 - protein, 355 aa, Glycine max
MAMAVSAIGFEGFEKRLEISFFQPGLFADPEGMGLRALAKSQLDEILTPAACTIVSSLRNDHVDSYVLSESSLFVYAYKIIIKTCGTTKLLLAIPPILKFAEMLSLNVRSVNYTRGSFIFPGAQPYPHRNFSEEVAILDGYFGKLSAGSNAYILGGQDKSQNWHVYSASADSVTPCDNVYTLEMCMTGLDREKAQVFYKEQSASAAIMTVNSGIRKILPDSEICDFDFEPCGYSMNSVEGAAVSTIHVTPEDGFSYASFETVGYDFKVVNLNEMVKRVLACFLPTEFSVAVHVDGASKLFDQTCFLDVKGYCREERSHEGLGMGGSLVYQKFAKTCDCGSPRSTLKCWKEEDEEE

SEQ ID NO: 8467 - protein, 396 aa, Methanococcoides burtonii
MSTTRDYYEILGVSKDASDTELKKAYRKLAMKFHPDKNKEADAEEKFKEISEAYAVLSDAEKKAQYDRFGHAGIDGRYSTEDIFRNADFGDFGDLGDIFGSIFGGGGGFGGFGGGGRRRQGPTRGSDLRYDLGVTLEQAAFGEKVHINVPRAENCETCGGTGAKEGTSPKTCATCRGSGQVTHARRTPLGNFMTTTTCDACHGKGQVIESPCPVCRGSGKQKKVRKMGVSIPKGADTGLRLKMSGEGEAGSPGAPSGDLYIVIHVKQHDEFERIGDDIVYGIPISFSQAALGAEIKVPTLHGKVKMKIKPGTQTHSILRLKGKGMPRLHGHGQGDQLVKVIVETPTDLTGKQKELLDEFDRLSTGNSKGSKGKGFFDKVKDTFESAISTISPGTVE

SEQ ID NO: 8468 - protein, 247 aa, Bacillus cereus
SLPEESVQLIEDTTRDSAKQLFTMNDYLDVLIPRGGKQLIDTVVREASVPVLETGAGNCHIFIDETADKQMAIDIIINAKTQRPSVCNAIETIVLHEKWAQQHGSELFSSLKERGVELRGDQRALALDSSIVLASEEDWGTEFLSLTLAVKVVSSIEEAIHHINTYGSMHSEAIISENEENVSKFFVSVDAAALYHNASTRFTDGSEFGFGAEIGISTQKLHVRGPMGLPALTSTKYVIRGNGQIRK

SEQ ID NO: 8469 - protein, 741 aa, Trichodesmium erythraeum
MLPKPNKIWNPKIWASWKPFGIGEQYPNNYWELIRAGIENIDQLPYAWNILNKGVCDGCSLGTTGMKDWTLDGFHLCNVRLRLLRLNTMPAFNPEILANISQLQNKSSGDLLQMGRLPYPMRRDKGDKGFRRISWDEAMAVISDRLKTTHPDRIGFYLTSRGTVNETYYATQKAARAIGTNNIDNAARICHSPSTGALKTTIGAAATTCSYKDWIGTDLLVFIGSNVANNQPVTVKYLHWAKKAGTKIVVINTYREPGMERYWVPSIPESALFGTKFAEDFFLVNVNGDMAFINGTIKHLIANDWIDKHFIDNYTNQFEELKASLDAQSWSELERFSGSTQDEMYAFAKMVGKAKKAVFVWSMGITQHECGEDNVRAIINLALTKGFVGREGCGLMPIRGHSGVQGGAEMGCYSTVFPGGRKINPENAEVMSKFWGFSVPNNPGLTTSEMIDNASEGKLDVLFSVGGNFLEVLPDPDYVKAAMKRVPLRVHQDIICSNQMLVEPGETVILLPTTTRYEIPGGVTETTTERRVIFSPEVPGQRIGEARPEWQVFMDLAKLVRPELADKLEFKNTGEIRQEIALVISQYSGIQHLKEPGDNFQYGGAHLCFGWNFPTPDKKAKFSILSPPKEELSKGYFLVATRRGKQFNSMVQSQKDAITGALREAILINPFDAQELGLKDGDNVRLKNDFGLFSGKVFLAPMKPGNLQVHWPEGNVLLDKGKRSVEGVPDYNALVCLEKLG

SEQ ID NO: 8470 - protein, 414 aa, Candida albicans
MIFPTGKETGSYLAIDLGGTNLRVVLVKLAGNRDFDTTQSKFALPAHMRTATSDELWDFIAKCLKEFVDEIYPDGCSEPLPLGFTFSYPASQNRINEGILQRWTKGWSIDGIEGKDVVPMLQKAIKKVGVPIDVVALINDTTGTLVASMYTDPEAKMGLIFGTGVNGAYFDVVKDIPKLEGKCPSDIPPESPMAINCEYGSFDNEKYILPRTKYDVQIDEESPRPGQQTFEKMISGYYLGEVLRLILLEFAEEKKLIFKGQNLDKLKVPYVMDASYPSKIEEDPFENLSDVADLFREKLGIETTEPERKIIRRLAELIGERSARFSVCGIAAICQKRGYETAHCAADGSVYNKYPGFKERTAQALRDIYEWPADVKDPIIIVPAEDGSGVGAAVIAALTEKRLKEGKSVGLLGA

SEQ ID NO: 8471 - protein, 475 aa, Escherichia coli
MSIRLEGYMQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 8472 - protein, 322 aa, Photobacterium profundum
MSKIYEDNSLTIGNTPLVRLNRVSNGNVLAKIEARNPSFSVKCRIGSNMIWDAEKKGTLKEGIELVEPTSGNTGIALAFVAAARGYKLTLTMPESMSLERRKLLKALGANLVLTEAPKGMKGAIEKAEEIVASDPSKYLLLQQFNNPANPEIHEKTTGPEIWDATDGEIDVFVSGVGTGGTLTGVSRFIKHQKGKAITTVAVEPTESPVITQTLNGDDVKPAPHKIQGIGAGFIPGNLDLTLIDEVELVSSEDAIAMTRRLMEEEGILAGISSGAAVVAANKIAARPEFAGKKIVVVLPSSGERYLSTALFAGIFTEKENQQ

SEQ ID NO: 8473 - protein, 323 aa, Hyphomonas neptunium
MAETQHAEILIIGSGPAGWTAAVYAARALRDTLVVTGMQPGGQLTITTEVENWPGESHIQGPELMVKMQEHAEKMGAKVANDHIASVDFETRPFKAVGESGTVYTADSVIISTGAQAKWLDLPSEEKFKGFGVSACATCDGFFYRGKEVLVIGGGNTAVEEALFLTNFASKVTVIHRRDHFRAEKILQDRLFKNPKVEVIWNHALEEVVGDENPLGVTAARIKDVTTGAIRELPVHGVFVAIGHAPSTELFVGKLPMRESGYLITEPGSPRTAIPGVFAAGDVTDETYRQAVTAAGMGCMAALDAERFLSEQEAHVEAAVPAE

SEQ ID NO: 8474 - protein, 394 aa, Bacteroides fragilis
MAEKRDYYEVLEVTKESTVEEIKKAYRKKAIQYHPDKNPGDKEAEEKFKEAAEAYDVLSNPDKRARYDQFGHAGMSGAAGNGGPFGGFSGGMSMDDIFSMFGDIFGGHSGGGFGGGFGGFGGFGGGGSQQRKFRGSDLRVKVKLNLKEISTGVEKKFKLKKYVPCSHCHGTGAEGNSGSETCPTCKGSGSVIRNQQTILGTMQTRTTCPTCNGEGKIIKDKCKVCGGEGIEYGEEVVTVKIPAGVAEGMQLSMGGKGNAGKHNGIPGDLLILVEEEPHPELIRDENDLVYNLLLSFPTAAIGGAVEIPTIDGKVKVKIEAGTQPGKVLRLRGKGLPSVNGYGTGDLLVNVSVYVPETLSKEEKSTLEKLEESKNFKPSTSIKEKIFKKFRSLFD

SEQ ID NO: 8475 - protein, 242 aa, Prochlorococcus marinus
MPSDKSDSTNLTIHELLEKFSSGSLRQKRRFVKLVEERSSDFKELGEDLLKNFDPESDNWCAGWLLQVCQRHQPQLISKLIDPDSSGWFRTHSGSGVNYAALQQALLEERFEDADRMTSSTLRELAGPSAVERGYVYFSEVTSITEVDLITLDRLWIAYSQGKFGFSVQARLLEALKGRYEMLWPKIGWKENGVWTRYPNAFTWSISAPEGHMPLINQLRGVRLMDALINHSAFNPRRSIKT

SEQ ID NO: 8476 - protein, 71 aa, Glycine max
  misc_feature (32)..(32): Xaa can be any naturally occurring amino acid
ERTDECLYHACDIAHDAGSAGRQSLSGGTQKXATVLITLAGIRASCHYVTKLWIASMCTNWCTTGARLQKF

SEQ ID NO: 8477 - protein, 485 aa, Cunninghamella elegans
MVEAVADIGLIGLAVMGQNLILNMNDHGFVVCAYNRTTSKVDDFLANEAKGTNVVGAHSVEELCAKLKRPRKVMLLVKAGSAVDAFIDQLLPHLEEGDIIIDGGNSHFPDSIRRTKELEAKGILFVGSGVSGGEEGARYGPSLMPGGNSKAWEHIQPIFQAIAAKAPDGASCCEWVGETGAGHYVKMVHNGIEYGDMQLITEVYQILHEGLGLSHDEMADIFEEWNKGDLDSFLIEITRDILRFKDTDGQPLVTKIRDTAGQKGTGKWTAIDSLDRGIPVTLIGEAVYSRCLSSLKDERVRASKILQGPSSSKFTGDKKTFIAQLGQALYAAKIVSYAQGYMLMRQAAKDYEWKLNNAGIALMWRGGCIIRSVFLGKIRDAYTKNPELENLLFDDFFKDATAKAQDAWRNVTAQAVLMGIPTPALSTALNFYDGLRHEILPANLLQAQRDYFGAHTYELLHTPGKWVHTNWTGRGGNVSASTYDA

SEQ ID NO: 8478 - protein, 809 aa, Rhodobacter capsulatus
MKQRLVVIGAGMASGRMLEHIFEAAPEAFDVTLFNAEPRGNYNRLMLSPVLSGEKTYAQIVTHDAEWYETQGITCRFGEPVVKIDRAAKTVTSAAGSVAYDKLVVATGSAPFILPVPGKDLPGVVAYRDLEDTNAMIAASAPGARAVVIGGGLLGLEAAAGMAARGAEVTVIHLMGHLMERQLDPAAGYLLQRDLERRGIRVHCKGATKAILGIDRVEAVLLDDGTTYPADLVCMAIGIRPETRLANDAGLEVNRGLVVSDQMQTSDPAIFALGECVEHQGQLFGLVAPLYDQAKVLAATLLGTEAAFRPVQTATKLKVTGVDLFSAGDFADAPGREEVVFRDPGRGVYKRLILEGERLIGAVMYGDTADGAWFFDKIKSGEDVTSARDTLIFGPAFAGGAAADPLAAVAALPPEAEICGCNGVCKGKITEAVAGGAVTLDAVRAVTKASASCGTCTGLVEKVMALTLGAAFKPVENPPMCKCTDHTHEDVRRLIKARRLKSIPAVMQELGWKTSGGCASCRPALNYYLLCDWPFDYKDDRQSRFVNERNHANIQKDGTYSVVPRMWGGVTTPSELRAIADAAEKYSVPMVKVTGGQRIDLLGVRKEDLPAIWSDLNAAGMVSGHAYSKGLRTVKTCVGEQFCRFGTQDSTGLGIKLEQLLWGSWTPAKLKLGVSGCPRNCAEATCKDIGVVCVESGYQISVAGAAGLEVRETELLVTVATEAEAMEAIAAFTQLYRENARYLHRVYKWVAKVGLDWCRAQIEDPQTRKALADRFEASQSIYRVDPWAELAAKPADWAPVADLTLRAAE

SEQ ID NO: 8479 - protein, 178 aa, Yersinia pestis
MRHTVEVMISEQEVKTRIAELGRQISEHYRDSGSDMVLVGLLRGSFMFMADLCRAIDVSHEVDFMTASSYGNGMSTTRDVKILKDLDEDIRGKDVLIVEDIIDSGNTLSKVREILQLRGPKSLAICTLLDKPERREVHVPVEWVGFTIPDEFVVGYGIDYAQRYRHLPYVGKVVTLDE

SEQ ID NO: 8480 - protein, 361 aa, Saccharomyces cerevisiae
MTTAVRLLPSLGRTAHKRSLYLFSAAAAAAAAATFAYSQSQKRSSSSPGGGSNHGWNNWGKAAALASTTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHALGKTHLKNSGYEGPWGAANNVFTNEFYLNMLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 8481 - protein, 299 aa, Campylobacter coli
MSKIAIIGAGKWGSALYSALSINNTCFMTSRTQRDLPYFVSLEQALNCEYLVFALSSQGIYSWLKQNFVNKGQKILIASKGIDTSTCKFLDEIFSEFIDRDKLCVLSGPSFAAEVMQNLPCALVVSGIKEELCKKFASFFPDFIKVYTDDDVRGAEICGAYKNVLAIASGISDGLGLGNNARASLISRGLIEMHRFGKFFGAKEETFLGLGGAGDLFLTATSVLSRNYRVGLALAKEKKLDDILQELGEVAEGVKTAYAIAKISKDKAIYTPIVNEIVQILQGKNVKQAVQNLLKTKDN

SEQ ID NO: 8482 - protein, 863 aa, Rhodobacter capsulatus
MIRTTCPYCGVGCGVIATPDGRGGATIKGDPDHPANRGRLCVKGTALGETIATAGRLTTPRIDGAEASWGTALDLIARRFSETIAEHGPDAVAFYVSGQLLTEDYYVANKLMKGFIGSANIDTNSRLCMASSVAGHRRAFGSDTVPGQYADLEEADLVVLVGSNLAWCHPVLFQRIMAAKATRPGLKIVVIDPRRTATCEGADLHLSLAPGADAHLFNLLLAHLPETGRIDPAFLRHLSGLPEALVAARTSTPAATDLEPADLDAFLRLWAETEKVVTVYSQGINQSETGTDKVNAILNCHLATGRIGRPGMGPFSVTGQPNAMGGREVGGLANMLACHLEIENPDHRAAVADFWAAPRIAEKPGLKAVDMFRAVEEGRVKALWVMHSNPAVTMPEADRVARAIAGCDFTVVSDLWAETDTARRAHVLLPATGWGEKSGTVTNSERCISRQRPFLAPPGQARPDWWALAQVAKRMGFSGFDWESPADIFAEYCALSGVAGGLGSDFDISGLEAADYDALPPTYWPQAAQKGGRFFGTGQFHTPDGKARMIPVTARLPDPVTPAHPYRLNTGRIRDQWHTMTRTGQSPRLAAHLGEPFLEIHPDDAAQLGFATADLAEVTNAHGRALLRVMISDRVAPSHPFAPMHWTGETAPSGRVDALVTATTDPVSGQPASKSAAVAIRRFEVRWHGFAITRSDLRPGCEYWAKAPIPGGWRAELAGTTPPEDWALWAENLLRLGPATLQVSDPSRGLYRFAFFEGDRLCAAIFIAPGPVALSRSHLVTQLGSTARSILAGQPEAARPDPGPTVCACLNVGMNTILRAIADQGLASVEAIGRALGAGTNCGSCRPELATLLSRFSSREAAQ

SEQ ID NO: 8483 - protein, 269 aa, Rhodobacter capsulatus
MSFLTRPEDLTPALGTDRKGKISLVGAGPGAADLLTMRAIRCLGQADVICYDRLVDPDVLAFARPGARRVATGKEVGAHSWPQERIDAFITAEALAGNHVVRLKSGDPSVFGRAGEEIAAARAHGIAVEIIPGITAASAAAAALCEPLTERGVTDRLVLATATCRPGELPTDIAEIARPGTALVFYMAMAQLERLSAELIAAGTAPDQPVTIARNVEKAGAETLRTTVATMAKDAVAAGVTNPALLMIRLAKDSVLQVPAKCATMPASI

SEQ ID NO: 8484 - protein, 145 aa, Actinidia deliciosa
MEQDFHAERIKEFLREVAIMKRLRHPNIVLFMGAVTQPPNLSIVTEYLSRGSLYRLLHKPGAREVLDERRRLSMAYDVAKGVNYLHNRNPPIVHRDLKSPNLLVDKKYTVKVCDFGLSRLKANTFLSSKSAAGTPEWMAPEVQRD

SEQ ID NO: 8485 - protein, 486 aa, Bradyrhizobium japonicum
MLPRSAGAGRNKVAVARCPFGQPTGALVMSMQNVAAPALQFTAPRRNELTHIPGDEGWPVIGKTFQVLADPKGHIEANGAKYGPVYRTHVFGETNVVLLGPEANELVMFDQQKLFSSTHGWNKVLGLLFPRGLMLLDFDEHRLHRKALSVAFKSGPMKSYLSDLDRGISARVAQWKAKPGEMQLYPAMKQLTLDLAAASFLGADIGPEVDEINRAFVDMVAAAVAPIRRPLPGTQMARGVAGRKRIVAYFRQQIPLRRGNHGGDDLFSQLCRATHEDGALLSEQDIIDHMSFLMMAAHDTLTSSLTSFIGELAANPDWQDRLRAEVLALGLAPGAPSSFDDLEKMPLSEMAFKEALRIKPPVPSMPRRAMRDFTFKGFRIPAGTAVGVNPLYTHHMKDIWPEPDRFDPLRFTEEAQRNRHRFAWVPFGGGAHMCLGLHFAYMQAKCFARHFLQNIEVSLAPGYKPDWQMWPIPKPRDGLKVRVKAV

SEQ ID NO: 8486 - protein, 178 aa, Xanthobacter autotrophicus
MTLPNVTVLYDENRIAARNHSLAVEIAATNPERLLAVAVLKGSFMFAADLLRALHGSGLEPEVEFMHVSSYREATVSSGQVEILRDVQSDVRDRDVLLIDDILESGRTLAFAKDLLMARGARRVLVCVLLEKPGKRAVHIDPDFVGFTCPDVFVVGYGMDVAHAFRQLPFIGHIKGLG

SEQ ID NO: 8487 - protein, 154 aa, Oryza sativa
MAASGFLLRCPAAPSAVPLWGRSGRGGGGGLAFSASSSNGRFLVRFVLAFVFPFATSGAAVPSSLSDSEKKGPVVMEIPLDKIRRPLMRTRANDPAKVQELMDSIRVIGLQIDVLEVDGVYYGFSGCHRYEAHQRLGLPTIRCKVRRGTKETLR

SEQ ID NO: 8488 - protein, 373 aa, Mannheimia succiniciproducens
MEQKQNSQKTIVVKFGTSTLTQGTPKLNRAHMIEIVRQLAQLHQEGYRLVIVTSGAMAAGRHYLNHPKLPPTIASKQLLAAVGQSQLIQTWEQLFAIYDIHIGQLLLTRADIEDRERFLNARDTLHALLDNRIIPVVNENDAVATAEIKVGDNDNLSALVAILVQAEQLYLLTDQQGLFDSDPRKNPQAKLIPVVNEITDHIRSIAGGSGTTLGTGGMSTKITAADIATRSGIETIIAPGNRENVIADLAHGEAIGTKFTVQTDKLESRKQWLFAAPSAGILTIDQGAENAILEQHKSLLPAGIVNIEGRFSRGEVVKIRTQQGKDIALGMPRYNSDALYLIQGKKSQNIEKILGYEYGSVAIHRDDMIVLNK

SEQ ID NO: 8489 - protein, 569 aa, Oryza sativa
  misc_feature (11)..(11): Xaa can be any naturally occurring amino acid
  misc_feature (38)..(38): Xaa can be any naturally occurring amino acid
  misc_feature (526)..(526): Xaa can be any naturally occurring amino acid
  misc_feature (561)..(561): Xaa can be any naturally occurring amino acid
MASSHIILPPXDDDEEQRRLEEEEDEDPWARSGPPPAXAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGFIAMYATLASRDVDCCLIPESPFYMDGEGGLLQYVERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPTFITXKREIDEPKENDRTTNKPPLPTGPSHHVPKSFDQSXNYSSNSQI

SEQ ID NO: 8490 - protein, 112 aa, Glycine max
SLCISKQAPSLKVTNKLCFFNAAGSINVSNILTGKCLAARGASNGLPMVKECSCSDDNCSSSACNSGKRKRSSRIRSTVAEALEDITALFYDEERNEIYTGNRLGLVHVWSN

SEQ ID NO: 8491 - protein, 553 aa, Unknown
  Rhodococcus sp. RHA1
MSARTEVDARANRIGDVDAVVVGAGFAGLYAVHKLRSLGLTVQGVEAAGGVGGTWFWNRYPGARCDVESVDYSYSFSRELEQEWDWSEKYATQPEILAYINHVADRFDLRDRFLFGTRVTSAELDEESLRWEVRTDRGDVLSARYCIFATGALSTANMPNIAGRESFTGDTHHTGQWPHEGVDFTGRRVGIIGTGSSGIQSIPLIAEQAEHLYVFQRSANYSVPAGNQAWDDEMRRAIKAGYEERRRLSRESGGGSPYNAHPKSALDVSDEERREAYETRWKLGGVLFAKTFPDQTKTEAANATAREFAEEKIRLLVDDPAVADKLIPNDHPIGTKRIVTDTHYFETYNRPNVTLVDLKAAPIESITPSGITTADADYALDTLVFATGFDAMTGALDRMRIVGRGGVPLSEYWSEGPKTYLGLGVPGFPNLFVVTGPGSPSVLANMVLGAEQHVDWIADCIEHLWEKDYDAIEASVPATEQWVEHCRDLAAQTLFPLANSWYMGANIPGKPRVFMPYLGGFGAYGRICADVAEEGFRGFEFSRSRTRLADPVG

SEQ ID NO: 8492 - protein, 85 aa, Unknown
  Azoarcus sp. EbN1
MAKEELIEMSGMVVEVLPDSRFRVTLDNGHNLVAYSAGKMRKHHIRILCGDKVSLELSPYDLSKGRITFRHLEGRGPLGPQRRRR

SEQ ID NO: 8493 - protein, 445 aa, Triticum aestivum
MVLDLNVESPADSGTSSSSVLNSADAGGGGFRFGLLGSPDDDDCSGEPAPVGPGFVTRQLFPASPPGHAGAPGVTMGQQAPAPAPMAPVWQPRRAEELLVAQRMAPAKKTRRGPRSRSSQYRGVTFYRRTGRWESHIWDCGKQVYLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMVSSQPMSSSSSQWPVHQHGTAVAPQQHQRLYPSACHGFYPNVQVQVQERPMEARPPEQPSSFPGWGWQAQAMPPGSSHSPPPAASSGFSTAAAGANLAPPPPYPDHHRFYFPRPPDN

SEQ ID NO: 8494 - protein, 447 aa, Triticum aestivum
MVLDLNVESPADSGTSSSSVLNSADAGGGGFRFGLLGSPDDDDCSGEPAPVGPGFVTRQLFPASPPGHAGAPGVTMGQQAPAPAPMAPVWQPRRAEELLVAQRMAPAKKTRRGPRSRSSQYRGVTFYRRTGRWESHIWDCGKQVYLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMVSSQPMSSSSSQWPVHQHGTAVAPQQHQRLYPSACHGFYPNVQVQVQERPMEARPPEQPSSFPGWGWQAQAMPPGSSHSPLLYAAASSGFSTAAAGANLAPPPPYPDHHRFYFPRPPDN

SEQ ID NO: 8495 - protein, 327 aa, Nocardia uniformis
MGALPRVPLITAPTRLHPVDGLAPRRVLVKRDDENSPVFGGCKTRALEFVLGAARAAGATAVLTSGTAGSNHVAATALHAGRLGFRVTALVLPQEPGALVARNLRLAAGAGARLEPVPDGVSVHPDRERHRAAVAELRERGERVHVIPFGGADPVAGVAHALAGLELAEQARGLPGPLRVHLPAASTLTAAGIAAGLALSGLPFQVTAVDVVGSSSTLGPGLLGRAREVAALLGGPADAVRPEHVRHVGYAGAPYGVPDPEAGRCADLLREAADVRVDECYGAKAFHHLLGEVGDADGTHLFWHTGSTREAGEVFGPVPPELLCYVE

SEQ ID NO: 8496 - protein, 487 aa, Yersinia pestis
MSTHLVWFRNDLRVTDNLALHAACQDPQASVIAVFIATPVQWAAHGMAPRQAAFLRQNLQHLQAALAARGIPLHYHQCDDFQASNTWLVDFCQQQQVDSLFYSQQYELNERLRDDALAVQLSERAITCQSFHDSVLLAPGTVLTGNNEMYKVFTPFRRAFIQRLLMSDNHCVPAPKARHAPPVLLSPLPFDYPQQSVDSQLFPAGEDAALQRLRRFCREQVQDYRQYRDLPAVPGTSCLSPYLVLGVLSPRQCFNRLWAESPEMLENADSGAFTWLNELIWREFYRHLLVAYPRLCQHHPFIGWTDGLVWNRSESQLKAWQQGQTGYPIVDAAMRQMNETGWMHNRLRMISASFLVKDLLIDWRQGERYFMSQLVDGDLAANNGGWQWAASTGTDAAPYFRIFNPTTQGERFDKDGVFIRRWLPELAAVPDSDIHQPWRWAERQQQHLDYPVPLVDHKQARLATLAAFEAAKRDSTRIPNRKEPSCY

SEQ ID NO: 8497 - protein, 177 aa, Aegilops tauschii
MAGRDRDPLVVGRVVGDVLDPFIRTTNLRVTFGNRTVSNGCELKPSMVAQQPRVEVGGNEMRTFYTLVMVDPDAPSPSDPNLREYLHWLVTDIPGTTGASFGQEVMCYESPRPTMGIHRFVLVLFQQLGRQTVYAPGWRQNFNTRDFAELYNLGPPVAAVYFNCQREAGSGGRRMYN

SEQ ID NO: 8498 - protein, 866 aa, Colwellia psychrerythraea
MNTDKQLLTKTNIVVVGNGMVGHHFVEEMAKNPNYQITVLSAESRLAYDRVHLSEYFGGKTADDLAMTTPEHYEALGVTFKTNAKVILIDKIVQYVTTESGETYHYDKLILATGSYPFVPPIPGKDQDHCLVYRTIDDLEDIAASAKESKVGVVIGGGLLGLEAANAIKQLGLQTHVVEFAPQLMGVQIDGGGGRLLRQKIEDLGVQVHTSKATSVIEKGNTSRYKLCFSDETELETDLILFSAGIRPYDNLAREFDLTLGERGGIVVNNQCQTSDENIYAIGECALWNNFIFGLVAPGYAMAKVVAKHIAGFTNEGNGENGEIAEFTGADMSTKLKLMGVEVGSIGDAHGKTEGALTYTYENQPEGVYKKIVVSSDKKSLLGAVLIGDTSEYDTLLQYMLNAIELPESPEGLILPMAADKPTLGVDALPDTATICSCHNVTKGDIIASIDAGAMTVGDVKSCTKAGSGCGGCAALVKSVADNEFEKRGVEVKKDICEHFAYSRQEIYDIVSVGKIKTFDELLEKHGRGLGCEICKPVAGSVLASVWNDYILKKPHLSLQDTNDTYLGNMQKDGTYSVVPRIAGGEITPDKLIVLGEVAKKYNLYTKITGGARVDLFGARVEQLPPIWKELVDAGFETGHAYGKSLRTVKSCVGSTWCRYGVQDSMSMAIDLEHRYKGLRAPHKIKFGVSGCTRECAEAQGKDIGIIATDNGWNLYVAGNGGMKPRHGDLFATDLDDETLVKYVDRILMFYVQTGDRLQRTSTWIDNLEGGLAYLQDVIINDSLGLNDALETQMKAIVGTYQCEWKTTIEDPEALKRFQPFVNSDKSDSNIQFVTEREQIRPARGQEKIDVKFIDATEKEAVAEEA

SEQ ID NO: 8499 - protein, 246 aa, Oryza sativa
RPGIEKAPTTPHWSLPSFLAFSPDYSCCWLRLPVPALPFVGVIDVAAAEGAAGTTRLPEWLETLLSTRFFLACGAHPASPRNECNMFCLDCPSPSPPFCYYCRSHRHQSHRVIQIRRSSYHDVVRVTEVEDVLDISGVQTYVINSAKVLFLNERPQPRGAGAAAGKAAASPYNCQICARALLDPFRFCSLGCKLVDTKTGGRGATVQPGDATNDDAAAAGGSSKNGGARPQGRRRKGIPQRAPFGS

SEQ ID NO: 8500 - protein, 611 aa, Pyrococcus abyssi
MCGINGFSWGDEELVKRMNDAIRHRGPDDEGVYVDDNVSLGHVRLAIIDLSPKGHQPMKYEKDGKEVWIVYNGEIYNFMEIRKELEEKGYTFTSNTDTEVILAAYLEWGFDCVERFNGMWAFVIYDKSKNILFLSRDRFGIKPLYYYYDGKNIIFSSEIKGILQHNIPRKPNDAVIFDFLYYNLLDHTEDTFFEGIKRLMPGYNAVFDLNTRKFEAWKYYDLRERIEKRKEISDPQGFKDLFLRAVKMRLVADVPVGSCLSGGLDSSSIVCAMRHLLPDGEIKVFSLVFPGKEIDESKYQRIVVDECRVSWYRTTFNVEDVLADIIDLIRTQEEPFSTLSIYGQYRVMKLARENGMKVLLDGQGSDEILAGYHYFFGYYFVELLRKFKWGKLLREILAYKRIHGSLVPLKNMVLYILPVWVTKRLWRRRFPYLREEFIEKFKKRPSKELIWKIKTLNEALLLAETYYSLPHLLRFEDKNAMRWSIESRVPFCDHELVEYVLSLPPESKVSAGITKVLLRKGLKGILPDEIRNRASKVGFATPDKDILKTNEGQKFALAVIDSESFKKRPYWDYRKVLRMFEEHVSGKKNWSQELWKVIIMELWLREWMDNG

SEQ ID NO: 8501 - protein, 337 aa, Unknown
  marine gamma proteobacterium HTCC2080
MERAVAYKIAVMGGGSWGTTVASLVSRNADIMLWARDAATVDDINGNHKNSRYLGDAPLNPKLQATLDPAEAIAGADAVVMGIPSNNFRSVLTDIAPDLPDGAPLISLTKGLERGSRLRMTEICREVAPGRPIGVLTGPNLAREIVAGQAAAGVLALDDPSPQHWLQPVLNVGLFRVYTNPDHIGCELGGVFKNIIAIAVGMGDGLGAGDNTRAALITRGLAEMTRLGTALGGRAETFSGLAGMGDMIATCTSPQSRNRHVGIELAKGRSIEDIIASMHMVAEGVKSAPTVMELAAEHGVDMPISSDVFKVVTGASNARGVYRGLLRTRAAAESEPG

SEQ ID NO: 8502 - protein, 296 aa, Yersinia pestis
MSQKELWYETLHANFGQYFSVENVLFREKTEHQDLVIFENPELGRVMALDGVVQTTERDEFIYHEMMTHVPLLAHGQAKKVLIIGGGDGAMLREVSRHKNIEQITMVEIDAGVVEFCRQYLPNHSAGAYDDPRFKLVIDDGVNFVNQTTEKFDVIISDCTDPIGPGESLFTSVFYEGCARSLNEGGIFVAQNGVCFLQQDEAVNSHNKLSHYFSDVSFYQAAIPTYYGGIMTFAWATQNPALRQLDLATLQNRFAQAGLACRYYNPAIHVGSFALPQYLLDALTTIPKVIGVDSSE

SEQ ID NO: 8503 - protein, 701 aa, Dunaliella salina
MLLQKGNIGKGIAQPVQRRGVPSALRHAPLANKVATPAVAPQGLLRPILSERGSPALLKRQRALDVVLRAAETEQEAENAGTVVPGDGWESFPPPPYEPSEQVLDLWQQADAVCFDVDRTVTTDASVGLLAKFMGIEDEAQSLTEQANRGEINLTKAFEDRLAKLNFTPTDIDRFLEEHPAHTRLVPGVENLIAALKARGVEVFLISGGFREMALPIASHLKIPAKNVFCNTMSWQLDDHGEPVRLQGLDMTRAAESHFKSRAIERIRRKYPYNNIIMVGDGFSDLEAMQGSPDGADAFICFGGVMQRPAVASQADWFVRSYDELMAKLKRYKVTMVGSGAWACTAVRMVAQSTAEAAQLPGSVFEKEVTMWVHEEKHSGRNLIEYINENHENPIYLPGIDLGENVKATSDLIEAVRGADALIFCAPHQFMHGICKQLAAARVVGRGVKAISLTKGMRVRAEGPQLISQMVSRILGIDCSVLMGANIAGDIAKEELSEAVIAYANRESGSLWQQLFQRPYFAINLLADVPGAEMCGTLKNIVAVGAGIGDGLGVGPNSKASILRQGLSEMRKFCKFISPSVRDDTFFESCGVADLIASSYGGRNRRVAEAWAQKRIAGDDQVTFEKLEKEMLNGQKLQGVLTSDEVQEILHARGWELEFPLFTTINRIIHGEVPPTMILRYRVACSMPSMPPARRVVNDYY

SEQ ID NO: 8504 - protein, 356 aa, Lotus japonicus
MSLLSDLINLNLSETTDKIIAEYIWIGGSGLDMRTKARTLPGPVSDPSQLPKWNYDGSSTGQAPGEDSEVILYPQAIFRDPFRRGSNILVICDAYTPAGEPIPTNKRHAAAKVFSHPDVVAEVPWYGIEQEYTLLQKEVNWPVGWPIGGFPGPQGPYYCGIGADKAFGRDIVDAHYKACLYAGVNISGINGEVMPGQWEFQVGPSVGISAGDEVWVARYILERITEIAGVVLSFDPKPIKGDWNGAGAHTNYSTKTMREDGGYEVIKKAIDKLGLRHKEHIAAYGEGNERRLTGRHETADINTFLWGVANRGASIRVGRDTEKEGKGYFEDRRPASNMDPYVVTSMIADTTILWKP

SEQ ID NO: 8505 - protein, 297 aa, Bordetella pertussis
MTTASLRFGLAANRLHHETPDAALFTWLRACSATIREMGIQLHTVGRTHDAIVREGMLQGYSGLVRYPYGREGGLMKLVARVTEGRDGDAPFDGAIYLIDPVDPSSIFPEALALKRQCITHGRPFISTLAGAIEWIEVERVLAGLAPDATAARLFDFTGQTLALISHDALKEDMVAFAAEHFDLLSQFARRVATGTTGGLLNDLAWSRGWPKDRPWVHRYLSGPLGGDAQIAELVLEHQCQRVIFFEDPHVARQHEADIQLLERAVRVVTASATCATSPSVARRWAQAVQRRQAGRA

SEQ ID NO: 8506 - protein, 271 aa, Oryza sativa
MDHEEIKNVVRKFPAFAYYNVDRKIKPLVALLLELGVPRSNIPGIIKKRPQLCGISLSDNLKPMMTYLENVGINKDKWSKVLSRFPALLTYSRQKVETTVSFLTELGVPKENIGKILTRCPHIMSYSVNDNLRPTAEYFQSIGADAASLIQKSPQAFGLNIEAKLKPITEFFLERDFTMEEIGTMANRFGIIHTLSMEDNLLPKYEYFLTMGYPRNELVKFPQYFGYSLEQRIKPRYARMIDCGVRLILNQLLSVSDSRFEDILRKRMDGI

SEQ ID NO: 8507 - protein, 600 aa, Dunaliella salina
  misc_feature (276)..(276): Xaa can be any naturally occurring amino acid
MLRCAQPKYAPLKRQAFNQKLNRLVAAARTPSKSSSTSRMASTSSGQQGRSILWFRKGLRLHDNPALRDACTGSAAVFPIFIIDPYFLQKSNNKVGVNRYQFLLESLSDLNSSLTSLGSQLLVLRGTPEEVIPRVLRDWSIKKLCYEIDTEPYAKARDARVDDMAREAGVEVKKHWSHTLYDTDMLVRENKGKAPLTMQAFEKLVDRVGHPLTALPAPTARLPPVDVSLPGIKDAEVGVPTWQEMGFKEAPTAIFKGGETEALKRLEHYMKDTKWXASFEKPSTDPSAFTEPSTTALSPYLKFGCLSARFFHQRLLDVYRLHPKHSQPPMSLRGQLLWREFFYTLGSHTPNFDRIAGNPICRQITWDTNPALLKAWRDGATGYPWIDAAMTQLREWGWMHHLARHSVACFLTRGDLYLSWESGKEVFEELLLDADYFINAANWMWLSASAFFAQYFRVYSPVVFGKKYDKEGAYIRKFLPVLKDMPAKYIYEPWTAPKEVQQRANCIIGRDYPAPIVDHAVASKECIARMGAAYKATNTGGSAGKASPAKAASSGDAGTSASAGAPSSSKKTTGKRAASADQGGKRQKTLEESMTKKRCQ

SEQ ID NO: 8508 - protein, 673 aa, Kineococcus radiotolerans
MVDNSTPYPLGVTVREDGLNVAVYSETAEAVDVAVFDDGSETTHRLDQRTGHVFHGIVPGGVGTRYGFRVHGEWEPAEGLRHNAAKLLLDPYARAVEGQWGAGEETFGHLFADPEQRNDADSAPSVPRAVVVDPAFDWAGDRAPRTPLADTVVYEVHVKGFTQQHPDVPEEIRGTYAGLAHPAAIQHLLDLGVTAVELLPVHQFVQDSHLAEKGLRNYWGYNSIGFFAPHNEYSAAGDDGSQVREFKEMVKALHAAGLEVILDVVYNHTAEGNHMGPTLSLKGIDNGSYYRVVEEEPENYFDTTGTGNSLNVSHPAALQLILDSLRYWVSEMHVDGFRFDLATTLTRQWGDAHVHSAFLDIVHQDPVLAPVKLIAEPWDTQGYQVGGFPARWSEWNGKYRDDVRDFWRGQGSLGALTQRLTGSPDVYEADRRSPLCSVNFLTAHDGFTLADLTAYDEKHNEANGENSQDGESDNRSWNCGAEGPTDDEAVNALRDRQRRNLLTTLLLSAGVPMLLGGDEFGRTQGGNNNAYCQDDEISWFDWAGADRELLGFTRELLRLRRETSALRGAWYRGDGLDGSPDAVLSLRADGEPMTQAEWDDGNARAYGVQFSAEGSATVLLLVNGATNPVEFTVPKAPAGPWKLVVSSDPQQEVGREVADLLVGEWSTTVLRSA

SEQ ID NO: 8509 - protein, 77 aa, Panax ginseng
MKEQKWIHEGLITESLPNGMFRIRLDNEDMILGYVSGKIRRSFIRILPGDRVKIEVSRYDSTRGRIIYRLRNKNSKD

SEQ ID NO: 8510 - protein, 259 aa, Bacillus cereus
MKVACIQMNIVFGDVEKNIENAKNKISEAMKERPDVIVLPELWTTGYDLTRLSEIADRDGLETKEKLIEWSKQYGVHIVGGSIAKQTEQGVTNTMYVVTNKGELVNEYSKVHLFQLMDEHKYLIAGNSTGEFKLDDVECAGTICYDIRFPEWMRVHTAKGAKVLFVVAEWPLVRLAHWRLLLQARAVENQCYVVACNRAGKDPNNEFAGHSLIVNPWGEVVVEANEEESILFGELTFEKIEEVRKGIPVFADRRPELYK

SEQ ID NO: 8511 - protein, 565 aa, Bradyrhizobium japonicum
MIDDLWYKNGVIYCLSVGTYMDADGDGVGDFKGLLRRLDYLHGLGITTIWLMPFQTSPGRDDGYDIADYYSVDSRYGTLGDFVEFAHGCKQRGIRIIIDLVVNHTSDQHRWFKDARRDKNSPYRDWYVWSDTKPANANKGMVFPGVQKSTWTRDKDAGAWYFHRFYDFQPDLNTSNPHVQAEILKIMGFWIQLGVSGFRMDAVPFVIATKGAKVKKPVEQYDMLRAFREFLQWRQGDAIILAEANVLPETDMEYFGRDADRMHMMFNFHVNQHLFYALASADSRPLAKALKATKPRPGSAQWGLFLRNHDELDLGRLTPAQRDTVFKSFGPDKDMQLYDRGIRRRLAPMLGGDRRRLELAYSLMCTLPGTPVIRYGDEIGMGDDLSLPERNCARTPMQWSTEPHGGFTKNDKPACPVIDKGPYGFPHVNVAKQRRDANSMLNWTERIVRMRKEVPEIGWGDFAVIATRDPAVFIMRYDWRNNSVLFVHNLDEKPREIAFSTGLPDDAGAHLINLLAEDHSHADKRGQHRVVLEPYGYRWYRVGGLDYLLKRSDIDGDTAGNKHPG

SEQ ID NO: 8512 - protein, 248 aa, Campylobacter coli
MLARLIVLPELYDSAYCVEDQDEKFSLNLHQAHPNLDALQKLAKNYQAYIVACSIEKDTQLYDSAYIISHKGLLGVYRKIYLWGNEKERFARGDKYPIFELEFENFKLKLGLQICYEIGFSEGSRFLALQGAEIICFPSAFGKARTYVWDLASRSRALENGVFVLAANRSGSEISKINNETLTFAGKSKIINPKGEIIKEILEEEGFIIAELDLEEVQIQRKNLPYLKDLNLKLNQEILTNIHLNTKE

SEQ ID NO: 8513 - protein, 834 aa, Unknown
  Synechocystis sp. PCC 6803
MQINNHVFKGLADFRSVSWQRQIIVAIAIYGTIYISQLFITYAGTASSPIWIPTGMAVGFLSIWGYQVWPGMVGGLLLGEIMALHGLESAANFILTVAITGVVSLVNLFSVYLSDILTANNYLFSKIKNIIRFIVFVCFGSRLPAAIICPFLLYLFEKISFGLYSEIAYTWLLSDAFALLIVTPFIIACNHNFKVFIKLLQEQWLEAASIIFFILLIVKIIANGYPIEYLLIPFLLWSAFRFTEVGSSLLTIVVSALLVLILALDQEKAAIKDQLLLLQSILACISMTTLVLNAVLSENERSKNQLFTTNQILIEQNQKLQELYQQRELERAQREKILIEYNESLQKQVDLVRAKEIAESEAKAKSTFVANMSHELRSPLNAIIGFSQLMLRTKNLPMEQYENAGIIQRSGEYLLNLINNILDFSKIEAGKTHLNRHNFDLYLLLDDLEDMLHLKAANEGIELIFIRDHDLPRYVYGDEIKLRQILLNLLSNAIKFTTEGEVVLTSNFRNAEQQEVINPETSTEPKNKYWLDFTIKDTGKGISEVELSHLFEAFSQTESGRNAQEGTGLGLAITRQFIKLMGGDINVSSVVDQGTTFSFSILVDLGEITLSREPNSAKKVLALTPGQPVYKILVVDDKSVNRQLLIKLLAPFGFEIEEASNGQEAIALWESWEPHLIFMDMRMPVMDGYEATKYIKGQVKGNATAVVALTASVLEEEKAIVLSAGCDDFLRKPFRENTIFDSLTKHLGVTYVYESAPNKNDNHEDTALKPESFLIMSQDWLTQLSHYLLEADTEQVMKLIAEIPASESELEQNLTKLVRRFEFEKILDLIEPLS

SEQ ID NO: 8514 - protein, 475 aa, Unknown
  Sulfitobacter sp. EE-36
MAADLKTADIGVYGLGTMGSALSLNLAEQGFRVAVSNREADWIAPFLEEAGPLAGQLSGHATLEDFVDSIAQPRSILFMIPSGAPMDAMIDAVMPLLDEGDTIIDGGNADFHDTRRRAAAFDGTGRHFVGMGVSGGEEGARHGPSMMVGGTDHSWTQLRPMLSAIAAKFQGAPCVDHLGPDGAGHFVKTVHNGIEYADMQMIAEVYGLLRDAGGQTAPQIGALFESWQKGPLSSYLIEVSAAALQTVDAESGAPMVDLILDKAGQKGTGRWTLIEALKLGQSVSTIEAAVGARGWSSEKALRVAAAPLLPDAVTGGTLPTEDEMKSALLAARILGHAQGFRVLSAASDEFGWQLDMARIAEIWRAGCIIRSALLDDLADAFHAGLPEGALILAPAIRDMLGDHLAGLRKTVAAGVSLGVPMPALSASLAWYDSIRTARGSANLIQAQRDFFGAHGFERGDIAGAHHGTWNAIRRD

SEQ ID NO: 8515 - protein, 709 aa, Haemophilus influenzae
MNPIVKQFKYGQHTVTLETGAIARQATAAVMASMDDTTVFVTVVAKKDVKEGQDFFPLTVNYQERTYAAGKIPGGFFKREGRPSEGETLIARLIDRPIRPLFPEGFFNEIQVVATVVSVNPQISPDLVAMIGASAALTLSGVPFNGPIGAARVGFIDNQFVLNPTMAEQKQSRLDLVVAGTDKAVLMVESEADILTEEQMLAAVVFGHQQQQVVIEAIKEFAKEAGKPRWDWVAPQPNTDLINKVKAIAEARLGDAYRITEKQLRYEQIDAIKADVIAQITAEDEEISEGKIVDIFTALESQIVRGRIIAGEPRIDGRTVDTVRALDICTGVLPRTHGSAIFTRGETQALAVATLGTERDAQIIDELTGERQDHFLFHYNFPPYSVGETGMIGSPKRREIGHGRLAKRGVAAVMPSLAEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKSARMHILGVMEQAIPAPRADISDYAPRIYTMKIDPKKIKDVIGKGGATIRSLTEETGTSIDIDDDGTVKIAAVDSNAAKNVMGRIEEIVAEVEAGAIYKGKVTRLADFGAFVAIVGNKEGLVHISQIAEERVEKVSDYLQVGQEVNVKVVEIDRQGRIRLTMKDLAPKQETEINQEDPVEEQE

SEQ ID NO: 8516 - protein, 341 aa, Unknown
  Bradyrhizobium sp. BTAi1
MRIPLAASSISPFFQRVIVPMQAPIHAKVVIIGSGPAGYTAAIYAARAMLEPVLIQGIQPGGQLTITTDVENYPGFADVIQGPWLMEQMEKQATHVGAQIKIDLVTRLELAQRPFRLTCDSGDVYLAETVILATGAQARWLGLPSEETFKGFGVSACATCDGFFYRGKEVIVVGGGNTAVEEALFLTNFASTVTVVHRRDHFRAERILQERLFKHPKIKVVWDSALDEICGASNPSKVTHVRLKNVKTGAVSELPADGVFVAIGHAPATELVAGQLKLKPSGYVEVVPGTTATSVPGVFAAGDVADETYRQAITAAGMGCMAALEAERFLAHAASERAAAE

SEQ ID NO: 8517 - protein, 613 aa, Haemophilus influenzae
MTDKITFNDLGLPEFILKAVSDLGFETPSPIQQSCIPHLLSGNDVLGMAQTGSGKTAAFALPLLAQIDPSEKHPQMLVMAPTRELAIQVADACELFVKYAQGTRIVTLYGGQRYDIQLRALKQGAQVVVGTPGRILDHIRRGTLNLSELRFIVLDEADEMLRMGFIDDVETVMAELPENHQTALFSATMPEPIRRITKRFMNDPQEVKIKVNNENAPDIDQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQEDIAAAMLMLLQGKQKLILPPDPPMEKRRREHNERGDRRENPRSAERRGERKGYGNPRPMDLYRIEVGRADGVEVRHIVGAIANEGDINSRYIGHIKLYDDYTTVELPQGMPKELLQQFGKTRVLNKQMQMSFLGAVKSDNSRGGDDFNGKRKGRGGDFRGERGRERGNDNRGNRKFNEKSNRTFSDKPRRDRRSSF

SEQ ID NO: 8518 - protein, 173 aa, Brassica napus
  misc_feature (158)..(158): Xaa can be any naturally occurring amino acid
MESVSDLGKLFIGGISWDTDEERLREYFSKYGDLVESVIMRDRTTGRARGFGFIVFADPSVAERVILEKHIIDGRTVEAKKAVPRDDQQVLKRHASPMHLISSPSQHGGGSNRTKKILVGGLPSSITEAEFKNYFDQFGTIADVVVMYDHNTQRPRGXGFITLDSEESWTGSS

SEQ ID NO: 8519 - protein, 351 aa, Unknown
  uncultured bacterium
MEMLLNFQQMIIDLTGMDISNASLLDEPTACAEAMMMAKRANRKNKSNKFLIDSNTNIQTITILQTRAKPLGIELVVEDIQNNDFSDCFAALLQSPGANGEVRDLTSDTAKAKDNGVLTIVACDVLALALIKTPAEMGADIAVGNSQRFGVPMGFGGPHAAYLATRDEFKRMVPGRIIGVSQDVLGNPAMRMSLQTREQHIRRDKATSNICTAQVLLAVLAAAYGVYHGAAGLKKIASKVHAKASNLAASLSVAGFELAATQFFDTITIKTDKAQDLFTSAQKMGINIRLLNDAQLSMSVDETTTKAQLLALISILPASSHLTITTFIPAITALAGLVPCADEGIKHILRS

SEQ ID NO: 8520 - protein, 470 aa, Bacillus subtilis
MQNHKNELQRSMKSRHLFMIALGGVIGTGLFLGSGFTISQAGPLGAIAAYIIGGFLMYLVMLCLGELAVAMPVAGSFQAYATKFLGQSTGFMIGWLYWFSWANTVGLELTSAGILMQRWLPSVPIWIWCLVFGIVIFLINALSVRSFAEMEFWFSSIKVAAIILFIVIGGAAVFGLIDFKGGQETPFLSNFMTDRGLFPNGVLAVMFTLVMVNFSFQGTELVGIAAGESESPEKTLPKSIRNVIWRTLFFFVLAMFVLVAILPYKTAGVIESPFVAVLDQIGIPFSADIMNFVILTAILSVANSGLYAASRMMWSLSSNQMGPSFLTRLTKKGVPMNALLITLGISGCSLLTSVMAAETVYLWCISISGMVTVVAWMSICASQFFFRRRFLAEGGNVNDLEFRTPLYPLVPILGFCLYGCVLISLIFIPDQRIGLYCGVPIIIFCYAYYHLSIKKRINHETIEKKQTEAQ

SEQ ID NO: 8521 - protein, 273 aa, Thermoplasma acidophilum
MKLIENWFSERYSDNLQLSFRVSDQLLSIKTDYQRIDLFDTYDFGKLLAIDGTVQLTERDEFIYHELITMVPYHLTPRPPENALIIGGGDGGAARRLIDLGLKHIVNVEIDDQVVEVSKRFFPSLSSAFNDSHVKLLIQDGIKYVKNTSEKFDLIIIDSTDPEGPAEGLFSKDFYNDTRKIMNEGAVIVSQSGSPFYQPKAIKLAYSGMREVFSDVRVYTGFIPTYPSGFWSFTVASPWTMKPRPVNMSGKYFNADVMEGSFRLPQFVKELIT

SEQ ID NO: 8522 - protein, 245 aa, Zea mays
MDNQPLPYSTGQPPAPGGAPVAGMPGAAGLPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAPGTGVVGAGAPGGAPAAGMPYYYPPMGQPAPMMPAWHVPAWDPAWQQGAADVDQSGSFSEEGQGFGAGHGGAASFPPAPPTSE

SEQ ID NO: 8523 - protein, 199 aa, Unknown
  Burkholderia sp. 383
MRAGCRHQRGTDFMVNEMLETATLGGGCFWCTEAVFLDVDGVTAVQSGYAGGHTRNPGYRDICEGDTGHAEVVNVTFDPARIGYREILEIFFATHDPTQLNRQGNDVGTQYRSVVFTHSDAQRDTALDVIRELEREQVFGQPIVTQVVPLDGNYWPAEDYHQNYYARNPGQGYCSVVIGPKLAKFRQKFSHRLKSLRGA

SEQ ID NO: 8524 - protein, 447 aa, Triticum urartu
MVLDLNVESPADSGTSSSSVLNSADAGGGGFRFGLLGSPDDDDCSGEPAPVGPGFVTRQLFPASPPGHAGAPGVTMGQQAPAPAPMAPVWQPRRAEELVVAQRMAPAKKTRRGPRSRSSQYRGVTFYRRTGRWESHIWDCGKQVYLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMVSSQPMSSSSSQWPVHQHGTAVAPQQHQRLYPSACHGFYPNVQVQVQERPMEARPPEQPSSFPGWGWQAQAMPPGSSHSPLLYAAASSGFSTAAAGANLAPPPPYPDHHRFYFPRPPDN

SEQ ID NO: 8525 - protein, 415 aa, Sorghum arundinaceum
PVGSHLAPAPLGHRRSAQLHRPRRALLATVRCSVDAAKQVQDGVATAEAPATRKDCFGVFCTTYDLKAEDKTKSWKKLVNIAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASKNVKVLVVGNPCNTNALICLKNAPDIPAKNFHALTRLDENRAKCQLALKAGVFYDKVSNVTIWGNHSTTQVPDFLNAKIDGRPVKEVIKDTKWLEEEFTITVQKRGGALIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAYCDVPEDT

SEQ ID NO: 8526 - protein, 411 aa, Corynebacterium glutamicum
MSTPQSIVIIGGGLAGAKTAEALRVNGYEGSITLIAAEDYLPYERPPLSKEYMAGKVGFDKAIVHPAEWYKENNVTLRQGVRATAIDAGSRQVTVDDGGNTETINYDKLVLATGSAVRKLPIPGADASNVHYLRTVEDSDAIKATFGEGKKLVLIGGGWIGLEVASAARGAGTDVTVLEGGKLPLLKVLGETVAQVFADLHVANGVDLRTEVKITDIVTEDGRAVGVRLDDGEVVPADAVVIGIGVTPVIDLAETAGLEIDNGVLVDAALRTSDPDIYAVGDIANHDHPVLGHRIRVEHWATALNQPAAAVKSLLGKDAEFTNLPYFFTDQFDLGCEYVGHATGSQEKVFIRGNLETREFVAFWVDTENRILAAMNVNVWDVPDQIKPLIASGKSVDTEKLVDPEVPYSEL

SEQ ID NO: 8527 - protein, 447 aa, Triticum turgidum
MVLDLNVESPADSGTSSSSVLNSADAGGGGFRFGLLGSPDDDDCSGEPAPVGPGFVTRQLFPASPPGHAGAPGVTMGQQAPAPAPMAPVWQPRRAEELLVAQRMAPAKKTRRGPRSRSSQYRGVTFYRRTGRWESHIWDCGKQVYLGGFDTAHAAARGYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMISSQPMSSSSSQWPVHQHGTAVAPQQHQRLYPSACHGFYPNVQVQVQERPMEARPPEQPSSFPGWGWQAQAMPPGSSHSPLLYAAASSGFSTAAAGANLAPPPPYPDHHRFYFPRPPDN

SEQ ID NO: 8528 - protein, 713 aa, Bacillus cereus
MLKVKRPFDAYLDEMNKITILLPHAYGTSRTFRLQEGSNVKDLPIAHTIALPDATKYECFIEEPLDVGKYYTVRDERNEETDLQIGAVIRTEIFDEKYYYEGTDLGAVYQKEATTFKVWAPTARLAKVRIYKSDKEYTDHEMHREENGVWAHTLQGDLAGEKYTFLVCINLIWNEAVDPYAKSVTVNGKYGVVIDLEKTNVTKRGQLPLLQAMTDAILYELHIRDATIHEGSGVSKKGTYKGLMEEGTTGQNGTLTGLSHIKDLGVTHVELLPLYCFGGVDEANPSSAYNWGYNPLYYNAPTGFYATNPSDPYNRIVECKQLIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNANKMPHIAQFNDQFRDGIKGSTFHINKRGFAFGGHVDRNHLQYIVSGSLLSMKETGLFLEPVQSINYVECHDNMTMWDKLMRSNEESEEILKKRHVLATAMVILSQGIPFLHAGQEFYRTKQGNENSYNANDEINQLDWDRKEKEIETVNYIKGLIAIRKEHGAFRLQNVDLIKKHMTFLQTSPEVLAYHLEHVESFGPWKEIVVLFNSSLEAKTVQLPKEETWHVLVNEKQAKIEPISSFRGKELRLSPISTYILTIM

SEQ ID NO: 8529 - protein, 472 aa, Unknown
  Rhodococcus sp. RHA1
MNTVHEPPKSTGLQQAMKPRQLVMMSLGGAIGAGLFVGSGAGIAVAGPAVLVSFLIAGFLVVLVMRMMGEMVAADPDSGAFSVHAENAMGPVAGRTIGWLYWVQVVIVVAAEATAAAAITAASIPAVPQWAAALAYMSVLTAVNLAGVSRFGEFEFWFAALKIVAIVAFLAVGSAMILGWIPSFDAPGLSNLTGHGGFAPNGVTGIAAGLLIVVFAFGGTEVMAIAAAETSEPRRNVSRAVRSIVWRILVFYVGSVLIMVTVLPWTADELATGPFVAVLNAAHVPGAGAVMTVVVVIALLSSLNAMLFSGSRMIYSLSERGAAAKVFGRVSGNGVPRVAVLASVTFGFVTVVLNYLAPDRVLPLLLNAVGSTILVLWTFVTVSQIVLRRRAERSGRTDLPLKMWGFPYLSYVALALLAAVAVLALFDDAAGNQLFATLTFTCAITVACWVLGRRQRGAAADSTPEKTPETVG

SEQ ID NO: 8530 - protein, 447 aa, Triticum aestivum
MVLDLNVESPADSGTSSSSVLNSADAGGGGFRFGLLGSPDDDDCSGEPAPVGPGFVTRQLFPASPPGHAGAPGVTMGQQAPAPAPMAPVWQPRRAEELLVAQRMAPAEKTRRGPRSRSSQYRGVTFYRRTGRWESHIWDCGKQVYLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMVSSQPMSSSSSQWPVHQHGTAVAPQQHQRLYPSACHGFYPNVQVQVQERPMEARPPEQPSSFPGWGWQAQAMPPGSSHSPLLYAAASSGFSTAAAGANLAPPPPYPDHHRFYFPRPPDN

SEQ ID NO: 8531 - protein, 174 aa, Neurospora crassa
MGNTTSSVPDNIVQGSNFDREEVDRLRKRFMKLDKDNSGTIEREEFLSLPQISTNPLATRMIAIFDENGGGDVDFQEFVSGLSAFSRKGNKEQKLRFAFKVYDIDRDGYISNGELFIVLKMMVGSNLKDQQLQRIVDKTIMEADLDKDGKISFEEFTKMVENTDVSMSMTLDQF

SEQ ID NO: 8532 - protein, 416 aa, Vetiveria zizanioides
PVGSRLVPAPLGAARRRSAQVRRPRRDTVRCSVDAAKQVQDGVATAVAAEAPASSFKECFGVFCNIYDLKADDKTKSWKKLVNIAVSGAAGMISNHLLFKLASGEVFGQDQPIALKLLGSERSFQALEGVAMELEDSLYPLLREVSIGIDPYEVFQDVDWALLIGAKPRGPGMERAALLDINGQIFADQGKALNAVASRNVKVLVVGNPCNTNALICLKNAPNIPAKNFHALTRLDENRAKCQLALKAGIFYDKVSNVTIWGNHSTTQVPDFLNAKIDGRPVNEVIEDTKWLEEEFTMTVQKRGGALIQKWGRSSAASTAVSIVDAIKSLVTPTPEGDWFSTGVYTTGNPYGIAEDIVFSMPCRSKGDGDYELATDVKMDDFLWDRIKKSEAELLAEKKCVAHLTGEGDAFCDLPE

SEQ ID NO: 8533 - protein, 465 aa, Yersinia pestis
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 8534 - protein, 416 aa, Themeda quadrivalvis
PVGSGLAPAPLGIGAAHRRSSAQQLHRPRRALLATVRCDAAAAKDGVATAEAPASNANCFGVFCTTYDLKADEKTKSWKKLVNVAVSGAAGMISNHLLFKLASGEVFGQDQPIALKLLGSERSFTALEGVAMELEDSLYPLLREVSIGIDPYEVFQDADWALLIGAKPRGPGMERAASLDINGQIFADQGKALDAVASKNVKVLVVGNPCNTNALICLKNAPSIPAKNFHALTRLDENRAKCQLALKAGVFYDKVSNVTIWGNHSTTQVPDFLNAKIDGKPVKDVIKDTKWLEEEFTITVQKRGGALVQKWGRSSAASTAVSIADAIKSLVTPTPDGDWFSTGVYTTGSPYGIAEDIVFSMPCRSKGDGDYELATDVSMDDFLWERIKKSEAELLAEKKCVAHLTGEGNAYCDVPD

SEQ ID NO: 8535 - protein, 136 aa, Picea abies
  misc_feature (125)..(125): Xaa can be any naturally occurring amino acid
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDXQLARRIRGERA

SEQ ID NO: 8536 - protein, 227 aa, Rickettsia typhi
MTNNLSGYRNKIVRVKTAKKRPISSSNWLRRQLNDPYVAKARLEGFRSRAAYKLLEIHDKFRLFTPNMKIVDLGAAPGGWSQVASKLIKASDNNLNNKIISIDLLKIEPIVGVEFLQKDFFEKDTEELIIHGLDGKADLVMSDMASNTIGHKATDHIRTLLLCEQAFEFALKVLKPSCHFIAKIFRGGAETALLNKVKREFRTVKHFKPVSSRSESTEIYLVALNKK

SEQ ID NO: 8537 - protein, 348 aa, Bordetella pertussis
MSFQVTIEPSKHQFQAEAGQTVLDAALAAGIVLPYSCRTGACSTCKGKVVAGEVDAGPYPAQILSPEDLAQGYTLFCQAKPQSDLVVESTEVRLASDIQIRKLPSRVQTIERVAPDVAVLKLQLPASEQFRYYAGQYIEVILKDGKRRSYSMAGAPHTGSPLELHIRHMPGGLFTDHVFGAGDTQMKEREILRLEGPFGSFFLREDSDKPIVLLASGTGFAPVKAIVEHMIHNQIQRPVVLYWGGRRPRDLYHDALAQSWAGRLPGFRYVPVVSDALDEDGWSGRTGYVHEAVMQDLPDLSGYEVYACGTPLMVDAARREFSAQCGLPAEAFYADAFTSEADLAKATP

SEQ ID NO: 8538 - protein, 241 aa, Burkholderia pseudomallei
MTVYFIGAGPGDPELITVKGQRLVRRCPVILYAGSLVPAAVLDGHRAELVVNTAELDLDEIVALLARAHGKGQDVARVHSGDPSLYGAIGEQIRRLAALGIPYEIVPGVTATAACAAALGVELTLPGVAQTVILTRYAGKTTMPAGESLASLAAHRATLAIHLGVRHLARIVADVLPHYGADCPIAVIYRASWPDEARVTGTLADIVDKVSGRSIERTALILIGRVLSAEGFDESTLYAKA

SEQ ID NO: 8539 - protein, 211 aa, Escherichia coli
  misc_feature (51)..(51): Xaa can be any naturally occurring amino acid
SLFDKKHLVSPADALPGRNTPMPVATLHAVNGHSMTNVPDGMEIAIFAMGXFWGVERLFWQLPGVYSTAAGYTGGYTPNPTYREVCSGDTGHAEAVRIVYDPSVISYEQLLQVFWENHDPAQGMRQGNDHGTQYRSAIYPLTPEQDAAARASLERFQAAMLAADDDRHITTEIANATPFYYAEDDHQQYLHKNPYGYCGIGGIGVCLPPEA

SEQ ID NO: 8540 - protein, 778 aa, Oryza sativa
MPHRRRLLNPAPSLPAPPAAAPAGFHHHLLAVDDTRLPLLADYALLQGEAAAAPASAEWSAGSGFTGISTDPATATTATTASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 8541 - protein, 1439 aa, Kineococcus radiotolerans
MVHPAAGAGGGDRADGEVRAGRAGAVVGDGHRGVPSGPGVDCASATKLGRPRYSRSRAPLHLRDVVLTGPARRCEESAPRSQHGGNHRATASALTPSVTAPETPARVRSACSYCGVGCGVLLDVVTDPETGRRRVAGVTGDRQHPANAGRLCTKGATSADFMAAPGRLQQAAVRETRGGEPRPAPVRDAVGTVAQRFAEVVAEHGPDAVAVYVSGQMSVEAQYLANKLTKGFLRTNQIESNSRLCMASAGTGYKQSLGSDGPPGSYEDFDHADVFLVIGSNTADCHPILFLRMMDRVRAGAKLIVVDPRRTATAEAADLFLQVRPGTDLALLNGLLHLLVEAGAVDEEFIATATTGWEGMAGVVADHPPARVSELTGVAEADLRAAADLIAGAGEWMSCWTMGLNQSVHGTWNTNALVNLHLATGAICRRGSGPFSLTGQPNAMGGREMGYMGPGLPGQRSVLDPRDRDFTESVWGLEPGTLRTDVGTGTIDLFSRMAAGEVKACWIICTNPVASVANRSTVVEALRRCEFVVVQDAFAETETTAFADVLLPAALWAESDQVSVNSERTMTLLPQAADPVGDARPDWQLIADVARALGFGDHFAYGCAADVFEEIRRFSNPRTGYDLRGVDHERLRSGPVQWPAPPGDGVDRHPVRYLNDGVSQDLLVREDGTVPPLAFPTPSGRAVFWPRPFVPAAELPDDEHPFVLNTGRVQHQWHTRTKTGKVAKLEKLNPGPFLEVNPEDAARLGVAEGDRVEVVSRRGRVVLPAVVTDRVLPGCCFAPFHWNDAFGEDLAVNAVTHDAVDPESFQPEFKVCAVQLTRVEAAVPAAPALPATVGRGGPPVLDERQTRYLDGFLHALGEAPGFVPVLPASAPFADGDRAWVEGFLAGTFASPAPAVSAGSVGSAEPAPAPDVLVLWASQTGGAEEHARSAAAALEAAGVRVGVFGMDEVTPERLGAATTTLLVSSTFGDGGPPDNGESFWDALSGPAAPRLEGRGFAVLALGDSSYADFCGHGRRLDERLAELGAQRLLDRVECEPGEDQRAAEWSARVLDLLARRSPTPTAPAASTAPSPSTALVPAPRLAPTRPTRKDPYRSRLVRNVRLNAAGSTKEVRQIGLARDGGLEHHAGDSLGVWPENDPAVVEAFAAATGVDPAALTALDLTRPAPDLLRFVAQRSREEGLARVLAEGPARTAEWARERQTLDVLRQFPAHAEPAEWLNLLKPLQPRQYSISSAPEAHPGEVQLTVSTVRFGDPLRQGVCSTFLADRAAGKEVRVFVQPAPAFRPPADPDVPVVMIGPGTGVAPFRAFLQHRRAHGAGGPNWLFFGERSSATDWYYREEFEGWRDEGFLTRLSLAFSRDQPEKVYVQDRVLAHGAQLWRWIADGAHVYVCGDASRMAKDVDAALRRVVAEHGGMSEEDAALHVREMVAAKRYVRDVY

SEQ ID NO: 8542 - protein, 328 aa, Zea mays
  misc_feature (193)..(193): Xaa can be any naturally occurring amino acid
MLASLPSGPPRSPSALPSRALGKRSSSPKLPSGAISPTSPCTPDPRRPHHRLCWVRPQSAHASTRSSRTPSADGVRLAPVSHTVPQRIQSRLLTLRCLLPSPLPSNPGFRVHSGYRELAPASMGPSSARDPPVPVGRGSRILTRFLLHYLRAATRRPPTLEREGTALAGLADTAVHGMALVEGTTFSCRGLFXVLRIVSAVGLSRECRHKLERLMGLMLVQATLDDLLVSSDDGGDVYIVNLVMRLVRVFVASEEEADAPSERMRKVGRLVDKYLGEISPDQGLKVSKFLAVAESLPDSARDCYDGVYRALDIYLEVKKKKEPPQRSK

SEQ ID NO: 8543 - protein, 100 aa, Oryza sativa
  misc_feature (23)..(23): Xaa can be any naturally occurring amino acid
  misc_feature (35)..(35): Xaa can be any naturally occurring amino acid
GPHARTSGTNWVPCVASNRIVRXTLETEHAESTYXTFFGNSFIAGPTGEIVKLANDKDEDVLVAEFDLDEIKSTTRAAGIFRDRRPDLYKVLLTLDGEKS

SEQ ID NO: 8544 - protein, 651 aa, Thiomicrospira crunogena
MYEQISHSLLNDILNQIKPDIYEQDLRHFYTRLGANFYAIHSLFDRLYGNRPDFKQQSLRLVETMARQYIKRPDKLKDLDIEREDDYNWFLSQEWVGMALYSNGFANDLKGMKEHLNYFQELGVNLVHIMPIMKCPEGRSDGGYAISDFREIDERIGTLQDLNELSSEMQQRDLLLVLDVVLNHTSDEHEWAQKARSGDPVYQDYYYTFESRNIPDMFEQSMLEVFPETAPGNFTWDEEMQRWVMTVFNDYQWDLNYSNPAVFIEMLDVILFWANQGADILRLDAVAFLWKKIGSTCQNEHEAHLILQLLKDCCQVTAPGVLFIAEAIVAPVEVTKYFGEDAVIAKECEIAYNATFMALMWDAVATKNAKLLNQGIKSLPVKLERATWLNYVRCHDDIGLGFDDNDIIKAGYEPNSHRRFLIDYLTGKFDESHARGLPFGENAKTGDARISGSLASLVGLQYAMETGDIEATEDAVKIILLLHSMILSFGGIPLLYYGDEIGTLNDDAYLSDPNKMDDNRWVHRPHIDWEKTERRNSTGTVEYQIFSALKKMIAVRKEINVFSDFNNRELIEVDNPNLFVISRFDPHKFSDRVLVVANFNSKPQSLNLEEVSSWGSYQNGELMDLYTRQSPEIFNNALIVPGFSFYWLYEM

SEQ ID NO: 8545 - protein, 424 aa, Bacillus subtilis
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVERANGPTTIDATKILNERGVLLVPDILASAGGVTVSYFEWVQNNQGYYWSEEEVAEKLRSVMVSSFETIYQTAATHKVDMRLAAYMTGIRKSAEASRFRGWV

SEQ ID NO: 8546 - protein, 622 aa, Vigna radiata
MMMMMFDEMGFCNDLDTVTATLGEENITTGQADPEAIVEDDFSDEEIGVDELEHRMWKDKMLLKRLKEQSKSKEGIDAVKQRQSQEQARRKKMSRAQDGILKYMLKMMEVCKAQGFVYGIIPEKGKPVTGASDNLREWWKDKVRFDRNGPAAITKYQADNAIPGRNDGCNSIGPTPHTLQELQDTTLGSLLSALMQHCDPPQRRFPLEKGIPPPWWPTGNEVWWPQIGLPKDQSPPPYKKPHDLKKAWKVGVLTAVIKHMSPDIAKIRKLVRQSKCLQDKMTAKESATWLAIINQEEALARELYPDYIPPLASGGGSGSLVVNDGNEYDVEGGEDEPNFDVEERKQENIHMSNLGMERMRGTMGVQQPSFSIKGEAVTTNLDLLRKRKASNDFNMMDLKIYTCEQPQCPYSQVQLGFPDRISRDNHRLICAFRGPSDFGGPNFHVNEVKPVIYTQSFVPPKSTAQSANIAPSVIDLTGLEVSEDGKKRISDLMTNYDTNVQGNKNMSSCNRVAGEVLNFPQHGMQQHQQDNFIRGRGITMEGNVFDEATMSNNHHTFARDECQFDRFKALNSPFETNHNNNNNFHSMFGSFCDLASFDFKEDMQGVGMDALQKQTDFSVWYQ

SEQ ID NO: 8547 - protein, 193 aa, Solanum demissum
MTTFTNPTTLFHPKITITKTHHTQCKTLPKIQSNLSTNEENFSCRRKLIATFLATPLTLGLQFTPLALAENWGVRSFLREHFFEPGLSPEDAVARIRQTADGLHSIKEMLETNSWRYVLFYIRLKSAYLKQDVKNALSRVPESLKESYIKTANELTDNMAEFDYYIRTPKVYESRVFYEKTLKSIDELVGLLA

SEQ ID NO: 8548 - protein, 450 aa, Unknown
  Mycobacterium sp. JLS
MTPTPGEADLTNTPAPRARRSVLSRGSWSETARIAGILRKETVGGAVLLVASAVALVWANSPWAESYFALRDLKIGAEPFGLHLNLTLGTWAADGLLAVFFLVVGLELKREFVAGDLRDPARAALPMAAAVGGMVVPALIFVAVTAPVGDGATRGWAIPTATDIAFAVAVLAVISTHLPAALRTFLLTLAVVDDLLAVTVIAVFYTDEINLTALGLSIVPLALFALCVQRRIRSWWLLLPLGVATWVLVHESGVHATVAGVLLGFTVPVLRSVAAGGPEAGPGLAEHFEHRLRPLSAGVAVPVFAFFAAGVAIGGVSGLTRALSDPITLGIILGLVVGKPVGIFLTTRVLTAVTRANLDDALRWIDVFGVALLAGIGFTVSLLIGDLAYGLGSDRDDFVKVGVLTGSLVAALIAAVLLRVRNRHYRAVWLQETADTDRDGVPDVYQSQRD

SEQ ID NO: 8549 - protein, 484 aa, Salmonella enterica
MAEKKSQGVKWLPFILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMARGEWLMLATVGVLLVLWIFGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGIWWRTGFIISLFNQAVFLTVGLAWWKVLGLY

SEQ ID NO: 8550 - protein, 142 aa, Triticum aestivum
  misc_feature (28)..(28): Xaa can be any naturally occurring amino acid
  misc_feature (43)..(43): Xaa can be any naturally occurring amino acid
AKNFYTKSFFELIFNPRRKQGAYFVTQXAGPGGKFSHTEVFSXIYNTLRQVFKYVVPYSAHIPSYGDIWGWVMASDSPLDLSAEELDLRMRHRIKGENGYLDGKTFTSASTLSKTVRNSLDNETHVYTEESARFIYGHGKHA

SEQ ID NO: 8551 - protein, 170 aa, Mesembryanthemum crystallinum
MASQSTDQPKSIHDFIVKDARGNDVDLSIYKGKVLLIVNVASQCGLTNSNYPELTKLYEQYKDKGLEILAFPCNQFGNQEPGDNEQIMEFACTRFKAEFPIFDKVDVNGSNAAPVYKYLKSSKGGLFGDGIKWNFTKFLVDRDGKVVDRYAPTTSPASIEKDIKKLIGTS

SEQ ID NO: 8552 - protein, 340 aa, Medicago sativa
MELGLSLGDSSKPLIGLMEKHPHQASKELGLGFNTTLSIGPIISTTQRDQLQQQQQEEEKTQRDINNNSNRTENPNPVLHQLDLLPQLSFPWNPPSQNGNLLSTEFGGSSRGLDVNVVPPATVVVMANDEMALSSSRIVQHLLFRRDLCMYSRGGSGGRSLSGSGGNKREFSDGEGYDQRNSSRVSDEDDNCGVGNGNTRKKLRLSKDQSAFLEESFKEHHTLNPKQKLALAKQLNLRPRQVEVWFQNRRARTKLKQTEVDCEYLKRCCETLTEENRRLHKELQELRALKTSNPFNMQLPATTLTMCPSCERVATNSTATSSVTNTSATINGNNNNKINQ

SEQ ID NO: 8553 - protein, 238 aa, Prochlorococcus marinus
MAVVTLSEMMEAGAHFGHQTRRWNPKMSRYIYCARNGVHIIDLVKTAVCMNNAYKWTRNAAKSGKRFLFVGTKKQASEVVAQEAARCGASYVNQRWLGGMLTNWTTMKARIDRLKDLERMESSGAIAMRPKKEASVLRHELERLQKYLGGLKGMKRLPDVVVLVDQRRETNAVLEARKLDIPLVSMLDTNCDPDLCEVPIPCNDDAVRSVQLVLGRIADAINEGRHGSNDQRARQKYS

SEQ ID NO: 8554 - protein, 110 aa, Brassica napus
QDQGLDSRDHWRRVMQGHAGANVVPLVASNRIGKETIETEHGPSQITFYGNSFIAGPTGEIVAEADDKTEAVLVAKFDLEKIKSKRQSWGVFRDRRPDLYKVLLTMDGNL

SEQ ID NO: 8555 - protein, 103 aa, Picea abies
MSGRGKGGKGLGKGGAKRHRKVLRDNIQGITKPAIRRLARRGGVKRIRGLIYEEIRGVLKIFLENVIRDAVTYTEHARRKTVTAMDVVYALKRQGRTLYGFGG

SEQ ID NO: 8556 - protein, 979 aa, Bacillus cereus
MNNNMVHITIDGKKYTAEPGSTILGVINENGIEHPQICYVPEVDPIQTCDTCIVEVDGKLMRSCSTIATEGMNIERASVRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKRKFGWDFVNSKERITKPLIRKNGTFVESTWEEALNVVANKLGAIKEEYGKGSIGFISSSKITNEDNYVIQKLARQVFGTNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQEFINENVNFFEDFKESLEEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNEMERAKFETAYGVKIDSEPGLNNIEMLHAIDEGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEISPDLAKERGVKTGSLVRLVSPFGALKLRALVTDRVKANELYLPMNSTDNETAINFLTGPAVDVRTNTPAYKQTKVRMEVLEVDGENPMPKANPRNKKRHPQAGIEVHRKWARPGYVHLTDK

SEQ ID NO: 8557 - protein, 164 aa, Glycine max
MAAASASSTMISTPALSPSTSIQKHHHLKPSNVCFQGLRPLTRFTTKVSSTTKRVIPKGGVGVRAELNSALVISLSTGLSLFLGRFVFFNFQRENVAKQVPEQNGLTHFEAGDTRAKEYVSLLKSNDPVGFNIVDVLAWGSIGHVVAYYILATTSNGYDPAFFG

SEQ ID NO: 8558 - protein, 356 aa, Camellia sinensis
MSLLSDLCNLNLSESTEKIIAEYIWIGGSGMDLRSKARTLNAPVSDPSKLPQWNYDGSSTGQAPGEDSEVILYPQAIYKDPFRRGNNILVMCDAYTPGGEPIPTNKRFDAAKIFSHPDVVAEEPWYGIEQEYTLLQKEVKWPIGWPVGGYPGPQGPYYCGIGADKAFGRDIVDAHYKACLYAGINISGINGEVMPGQWEFQVGPSVGISSGDQLWMARYILERITEIAGVVVSFDPKPIEGDWNGAGAHTNYSTKSMRSDGGFEVIKKAIEKLGLKHKEHIAAYGEGNERRLTGKHETADINTFLWGVANRGASIRVGRDTEKAGKGYFEDRRPASNMDPYVVTSMIANTTILWKP

SEQ ID NO: 8559 - protein, 173 aa, Methanosarcina acetivorans
MVRKPGSMYRNVRQRSFTRRKYMGGVPGSQVIHYDMGDKANTSFPVKISLIVEEKCQIRHTALEAARITANRHLVADTGKMGFYMKLRVYPHEVIRENKQATGAGADRVSSGMRRAFGKNVGTAARVKPMQKIFTVAVEKQNFKAAKEALWHAGQKLPTPCRIVVDEGAELVQ

SEQ ID NO: 8560 - protein, 870 aa, Kineococcus radiotolerans
MTETTATATVPAQRRPQRRLVVVGNGMAGIRAVEELLERGGSDQFAITVFGDEPYGNYNRIMLSHVLSGEETEEGIFLNTLPWYAENGIDLRAGVRVDRIDRFAKVVHDADGGQTLYDVLLLATGSTPFFPTMEGLHRPDGTVLDGVFGFRTLDDARSLLTAARTHRRAVVIGGGLLGLEAAHGLATHGLEVHLVHSPQHLMNQQLGPEAGRVLRRKIEELGIRVHTGVRTRGLRGTDRVTGVELPDGTVLDADFVVVAAGIRPNTDVALRSGLEVQRGVVVDDRMQCSAGEEGEEGTADGIYAVGECVQHRGQTYGLVAPLWDQAGVLADHLTGSRPDAAYHGSRTSTKLKVAGVDVVAMGLAGPERDDDEFVVFSEPHRGVYLNVVIRDGRLVGATLLGDVRKTAFLTQAFDQGLPLPEERMSLLFDLGSPDEATSVAELADDVQVCNCNGVTKGKIVDAVAGGCTSVNAVMGKTKAGKGCGSCKTLVEQVTEWAAGGNLTVDESANWYVPAIPLAKPELMAAIRERRLKSVSAVFRELAPGGVEDAKSKMGLTSLLRMMWPEGLDQDERDGRFINDRVHANIQRDGTFSVVPQMKGGVTTAEQLRKIADVADKYDVGMIKVTGGQRVDLLGIRKEDLPKVWADLGMPSGYAYGKSFRTVKTCVGTDFCRFGLGDSTQLGIDLETRFQGVETPAKLKLGVVGCPRNCAEAYVKDIGVVAIGAGKWEVYVGGAAGASVRKGDLLATVDSPEEVITLTGRFIQFYREWGNWLERTYEFVPRLGLDRVKKVLLEDSDGLVAGLDERMQATVDNYRDPWLEGREPVTEGQFRPALPLVDLPLVPGRPAGAPGGTTVALPLPTARPDSLRVPR

SEQ ID NO: 8561 - protein, 291 aa, Burkholderia thailandensis
MNTMGKVTLLGAGPGDLDLLTLKAAKALAAADVLLLDDLVNPDIVALAPQARVIRVGKRGGCRSTPQAFIERLMCRYALRGAHVVRVKGGDVLLFGRAGEELGALRAARVPVEIVNGISSGFAAAAGLGVSLTHREHCPGVTFVTAHRQDHGEPDWASLAATGTTLAIYMGMSRIERIAAGLLSALDAATPAAVVQWAGAPAERRWTGTLGRLAAGASEAGLGSPAVILVGRAIGEALAIGDACEARDATTPDGSDGLDGAHGANRTSRANGTHRAHGARAPACPPVSRAA

SEQ ID NO: 8562 - protein, 460 aa, Kineococcus radiotolerans
MPAAPERLRPAHGRVHDRAGPDRGAPLLRRGRWCRERGPVTPGGEEVGAVAYPLHLDVSGRRVLVAGGGPVAARRARDLVAAGADVLVVAPAVCEDLRDLLPDLTWEQREVEPRDVADAWLVHTATGDPRADAEVAAAAEALRVWCVRADDARASSAWTPSVVRREGVTVSVTAGGDPRRARGLREALSRWLDSGAAPLRRRRPGAGRVTLVGGGPGEVDLLTLRGRRRLAEADVVVVDRLAPTAVLDELDPDVQVVDVGKTPDHHPVPQEEINRILVEHARAGRRVVRLKGGDSYVLGRGGEEVLACRAAGVEVEVVPGVTSAFAVPAAAGIPVTHRGLSRSVTVVSGHEDVDAATLARLDGTVVFLMGVTMLPRLCADLVAAGKPASTPVAIVENGWRPDQRTTRGTLGDIAATAARRGVRSPAVIVVGAVAGLAGLAGVADEEGVTVGPDVAYRPLS

SEQ ID NO: 8563 - protein, 218 aa, Oryza sativa
MARRSGLMLLLLAAAAVASAAVPPSCERIECPSYEVVDSANGFEIRRYSDAMWASTAPIEDISFVAATRTGFLQLFNYIQGKNAYNETIEMTAPVLTQVAPSDGPFCVSSFVVSFYVPAKNQPDPPPAEGLHVQRWAGARYAAVRRFGGFVADSDVGEQAALLDASLQGTRWAAAVSDGRRADPTSSYTVAQYNSPFEFSGRVNEIWMLFDAKDASDM

SEQ ID NO: 8564 - protein, 220 aa, Saccharomyces cerevisiae [sequence omitted]

SEQ ID NO: 8565 - protein, 978 aa, Bacillus thuringiensis
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSAYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSKMVEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPSSNPRDKNRNPQNGVEIEQKWQRKQYVSLVD

SEQ ID NO: 8566 - protein, 241 aa, Prochlorococcus marinus
MLKNLLNLIFFKKSEMASSDLTHYVLGSSLNEPIGNDEEEIFFGCGCFWGAEKGFWKLPGVKTTAVGYAGGEIANPTYREVCSGRTGHSEVVKVVWKKSLIDLSDLLKLFWECHDPTQKNRQGNDQGSQYRSAIFTTNEKQTKMALSSRNSYQKLLTKEGYGVITTEIREEHLFYYAEEYHQQYLAKPGSRPYCSAMPTNINLSDFDGANYKLSKKIWLNYDWSVSHCILRSNVNPIPKDL

SEQ ID NO: 8567 - protein, 609 aa, Vigna radiata
MMMFEDIGFCGDLDLLSCPLGDEDVVAVRHTDPDPVVEDDYSDEEIDVDELEKRMWRDKVRHKRLKEQQKAKEGTDAVKQRQSQEQARRKKMSRAQDGILKYMLKMMEVCKAQGFVYGIIPEKGKPVTGASDNLREWWKDKVRFDRNGPAAIAKYQADNAIPGKNDGCNSIGPTPHTLQELQDTTLGSLLSALMQHCDPPQRRFPLEKGVPPPWWPTGNEVWWPQIGLPKDQGPPPYKKPHDLKKAWKVGVLTAVIKHMSPDIAKIRKLVRQSKCLQDKMTAKESATWLAIINQEEALARELYPDYCPPFSSGAGNGSMVINDCSEYDVDGAEEEPNFDVEDRKPDPLHPSNLGMERITGRLPLQISHPFKGDVVTNLDFIRKRKIPGDFNLMMDPKIYTCEHPQCPYNEPRLGFPDRSARDNHQLNCPYRNSSSDYGGGSNFHDSEVKPVIFPQSFVQPNTTSQAANVVQPSFAVSGLGVPEDGQKMINDLMTIYDTNIIGNNNLSSNNFVAAENQNFSQTMLQQQQQDSRRDNYFTGQGMMTEGNFFAREEGQFERFKAMNMNAPFDTNHMLFSPQCDLSSFDFKDIQGGGMDTGHRQQQEVSIWFE

SEQ ID NO: 8568 - protein, 72 aa, Unknown
  Sulfitobacter sp. EE-36
MAKEDTLEFPGIVKELLPNATFRVELENGHEIIAHTAGKMRKNRIRVLAGDKVQVEMTPYDLSKGRINYRFK

SEQ ID NO: 8569 - protein, 318 aa, Solanum demissum
MSLLLPEMLTWINPPKTLIPFSSITPNPSSPSPICSISPKPTKTSLKSLHLSPQPTLTSTDCGLKFREKILYLQDLNINPTKVLQLNPHLRSATLDSIRSVEICLFSMGIERSAIGRILDMHPQLLTSDPYIHLYPIFDFLLNDVVIPFHDIRKSIIRCPRILVCSVEDQLKPTFEFLKEFGFVGQNRITCQTTVLLVSSVELTLNPKIDYMLSLGFERDDVVNMVLRSPGLLTFSIEKNFRPKVEYFLKEMNGDIGELKRFPQYFSFSLERKIKPRHRLLVEHGFSLSLSEMLKVSDGEFNARLIEMRLRIVEDKQL

SEQ ID NO: 8570 - protein, 427 aa, Methanothermobacter thermautotrophicus
MFCYQCSQTVRGRACTIRGVCGKEPTVARLQDNLLFAIKGISAYLYHARELGYTDEEVDAFLERGFYSTLTNVNFDAGEFIDLALEAGEMNIRTMKLLKKAHIDTYGEPEPTEVRVGALEGPAIIATGHSLRALEELLKQTEGTGINVYTHSELLPAHGYPGLRKYPHLAGQLGGPWFDQKDTFSRYTAAILGTSNCVLLPRDDYRDRMFTCGVAALPGVEHLEGYDFSPLIDKALELPPLSEEDATTLTTGFGLSTILSLADKIRELVEDGKIRRFFLVGGCDSPLPRAKYYTEFVRKLPEDTVVLTLACGKYRFNSMDLGDIEGVPRLIDLGQCNDAIVAVELVEALSNLFQMDINELPLSIILSWMEQKAAAILWSLLSLDLKGMYIGPILPGWANEDIVKFLVDNYDLTPIGDPEEDIRKILG

SEQ ID NO: 8571 - protein, 110 aa, Triticum aestivum
MGGHAAGPTSYGSSGRRSFPAPAATAKQRRAPAPAGNGGKSDGGGYFGAEAAVVLALMTAALLVLPLLLPPRPPPPPLSLFVPVAILAGLLLLVLLPSDARGLRVAPSYL

SEQ ID NO: 8572 - protein, 2209 aa, Lactobacillus johnsonii
MKKKREKYTWLLLSTALITSGQILGGGEQIIKASVESQTNSVKKSKTAVEHSTTALSRQAVEAQLAAQGVNFERLTPEEQQEVYVDVIVQLEALPASENGSIDSQTASRAEIEQASNKVIAAQSGIKDEVQKITNQAIDKSYGYVVNGFATKAKVGDIKKLREIKGVKSVTLAKVYFAADTSANNMANVSTVWSNYQYKGEGTVVSIIDTGIDPNHKDLRLSDESKVKLTAKDIDGFTENSGYGRYFTSKVPFGHNYSDNNDIITDDDPKEQHGMHVAGIVAANGTGKNSASSVVGVAPEAQLLAMKAFSNSDSSSTTDSTSVIGAVDDSAKLGADVLNMSLGSVSGEQTEDDPEIAAVEKAVKHGTAAVISAGNSGTSTSNQEGVNKDFYGNPDMETIGSPGTSRSATTVASAENTKVTTDGMTVSTADGKKIFGPSVTQLSPNTSHDAFDSKKFYIVKDASGKLGMGTPSQYTADVKGKVAVVSRGEITFTDKQKYAQAAGAAGLIIVNNAGGNTPLTSVLYNEGFPTAGLSTDDGNKLVAYVEAHPDELLRVNVEVQPLNNVIREEDLMSSFTSYGPVSDLSFKPDITAPGGNIWSLQNNNGYINMSGTSMASPFIAGSQALLVQAMNDKTGKFYETYQKMSGSERAALIKNIQMNTANIEVDVDHGSVIESPRRQGAGLVNVEAAINAILHNPSTVSGSNGYPGVELKDFQDRQHQFTIKFTNRTNKDIEYGLNENGKFSDVYTSETDPKTGVLFEKKIDGASLTPSEKIVVPANSTKEVTINLSLPDNFKENQYVEGFMAFTGSDNSHLKIPYMGFFGDWAAPAIFDGLNGLAFNPGNNNLGTIVTAGNKNGAVGYAGLNQDEDGNYRVDPDAIALSTADGASVSWVRPQYFLFRNANDVKAEILNQDGEVINTLVSLAHVTKSYWAASSQRYAKFNYAPAWDGTYFNQQTNKTEKVPDGTYTYRVTGTVDGTKKQQHYDIKVKVDSVKPEVKNLKLGSHKDQTGKVSYVLKAEAKDNFSGLNGQANTYVNGELNRSVAYDIVGSSSDGYQKIEVPLSDEQVKTLRAGKNDLAIAVFDNATNAGTNSGTSNKPGEINFGLIIDNNLPQKITTVSDGYDMTDDSYTISGTYPEKVYGTYTDKDGKEHDLNISYDEASERFVTKLPLSVSDYDTNVKFYADEEHETLITQKRINVSLVPPKLESLKVDDQETYTGNEEAKLSQTSEDTVEVSGKVSDDTDKVAVKVAGKTYSAKPTKEHTFKVKVPVSYGENTMNIVLTDKDGNSSSVKQIVKSSDRGKTVVSAKDVTFDNGIKFGTTSVNTETENYDPKTGKLTLTGKVNRPTTTVRIGDHTVKVKADGTFKLVLDLGKHGAKVFPVLIGDTTVNDTVQERLTFYVDSNNPELTLNQEKDQSGYVPVYTNKEEFKLQGTISDDYPYYSLLINDNNVDANWDDVDYNGNKNLKKSFSHSVKLKEGKNTFNVVVVDNNDNRSEVQTLVVYYKKAQKLASPQITATTASDKKSVTVTGKAKDGNVLYSTDNGNKYNVLPEDGVTVKNNGKLLFKTVDKYGNESEVVEYDVKTIGKEESTVDKSVAQARKDLRKKLDQARALGNTGKYTHESAKKLAQARQEASKALKDKNATLQELKQASEQLEEAIKNLVEKPVDQNKDKDKVEDKDSQVNALKEKLEETVKAGEKFDKDKYTDDSVEKVTKALDEAKVVLANKDANSTDVQDAIDSIVNATKSLKEKQVSPEKTTQQEDTPKENKDTEEVLAAKNALKEKADKLSHLDTTKYTSESAENLSNALKKVNQVLTNKDANKAQVQEALDSLSQAEKDLVEKTESNKDVETAKEQLREELNKHKDEDKSQYTDDSAKVKDNAEKISEGVLDSKDAQADEVNKAKDSLVEAEKGLVKKEENKPAESDTQEVDKAREALEQEVNKNANVNLDGYTPESQDKFKEILNGVRDVLNDKNASASSLEKAEKVLETATGVLTQVEHQVELPKVEQPVVTPEKKQTEQEEAKKSESSSVSTSKDEVKEPEEKKQDAHSVSDKGTGTSVEKKGQTPADALSQVEHQAELSKNEQEEAKKSESHSASTSKDEVKEPEEKKQDAESVSDKESSTLVGKKHQVARSAQESSKKNADNKVPTHKNSNKAQNTTNSSTRSTKSSNNKELPKTGERETFFGLLVTGITALFASLGTVLRIKNKK

SEQ ID NO: 8573 - protein, 347 aa, Bacillus thuringiensis
MKDLIIIGAGQAGLTMGYYLKQEGYNFLLLEAGNRVGDSWRNRYDSLQLFTPRSYSSLPGMALIGEKNEFPYKDEIATYLEEYARHFQLPVQLQTEVLKIRKEKGIFELHTSTEILQTKKVIIATGGFQQPFIPSVSANLSSHVFQIHSSQYKSPSQIPQGKVLVVGGGNSGMQIAVEFAKTHEVTMSISHPLTFLPLHFFRKSIFNWLEKLGLLYAEVSTKRGKWFQKRKDPIFGFEGKELIRNGAIQLQEKVVSASENNIMFQNGETYSAESIIWSTGFIQNYNWIEIEKVVNENGLPNHIKGISPVRGLYYIGLPWQSQRGSALICGVGKDAAYLLSEIKKIDQ

SEQ ID NO: 8574 - protein, 549 aa, Unknown
  Rhodococcus sp. RHA1
MTAIHAPKNDLAQSAETPTYDVIVVGGGFGGIYQLRHLRDRGFSVILLEASGGFGGAWSLNRYPGARVDSHAPVYQFTDEYLWKDWDFSQMYPDHEEMRSYFNYVDSKLDLSKDSRFNTKVVGATFDEEQRMWSLETQDGATFRARFVVFATGSTTEPYTPSIPDMDAYQGELVHTARWRSDLDMTGKRVAIIGTGASAVQVVQEAGPVVENLTVFQRTPNISLPMQQKYLDDEEQAALKNKMPDVAAKCRETHAAIDYDFDPRSGFETPEDERNAVFERLWNQGGFAFWLGNFSDYLFNDKTNALTYEFWKNKIKPQIKDPVKAELLVPEIAPHPFGAKRPALHQNYYEVMNQTNVSLVSTKETPIVGFTETGIRTADGVEHGEFDIIVLATGFNNNTGALTSIDVQNANGVTLRDKWSQGVDAYLGAVTAGFPNAIFVYGPQSPAAFANGSTNAELQGEVMVDFFEFLRSNGLTRFESTVEADKAWTAHINETDDTALFNRAKSWYNGGNIPGKKMQMLQYLNGVPTYLQFWQKEKESGYTDGLTVS

SEQ ID NO: 8575 - protein, 739 aa, Clostridium thermocellum
MKKILAFLLTVALVAVVAIPQAVVSFAADFNYGEALQKAIMFYEFQRSGKLPENKRNNWRGDSALNDGADNGLDLTGGWYDAGDHVKFNLPMAYAVTMLAWSVYESRDAYVQSGQLPYILDNIKWATDYFIKCHPSPNVYYYQVGDGALDHSWWGPAEVMQMPRPSFKVDLTNPGSTVVAETAAAMAASSIVFKPTDPEYAATLLRHAKELFTFADTTRSDAGYRAAEGYYSSHSGFYDELTWASIWLYLATGDQSYLDKAESYEPHWERERGTTLISYSWAHCWDNKLYGSLLLLAKITGKSYYKQCIENHLDYWTVGFNGSRVQYTPKGLAYLDRWGSLRYATTQAFLASVYADWSGCDPAKAAVYKEFAKKQVDYALGSTGRSFVVGFGKNPPRNPHHRTAHSSWSALMTEPAECRHILVGALVGGPDGSDSYVDRLDDYQCNEVANDYNAGFVGALAKMYEKYGGEPIPNFVAFETPGEEFYVEAAVNAAGPGFVNIKASIINKSGWPARGSDKLSAKYFVDISEAVAKGITLDQITVQSTTNGGAKVSQLLPWDPDNHIYYVNIDFTGINIFPGGINEYKRDVYFTITAPYGEGNWDNTNDFSFQGLEQGFTSKKTEYIPLYDGNVRVWGKVPDGGSEPDPTPTITVGPTPSVTPTSVPGIMLGDVNFDGRINSTDYSRLKRYVIKSLEFTDPEEHQKFIAAADVDGNGRINSTDLYVLNRYILKLIEKFPAEQ

SEQ ID NO: 8576 - protein, 266 aa, Robiginitalea biformata
MRPEGILTVIGAGPGDPELITLKALRALERADVVLYDALVARELLEYARGAECIFVGKRKGCVAYRQSQINDLIVARGNGGKHVVRLKGGDPFVFGRGAEEMAHAAAHGMEVAVIPGISSGLAVPASQHIPVTLRGIAESFWVITGTTREHALSEDVALAARSSATVVILMGMSKLPEITALFRENGKGGTPAAVIQEGTTQGERIALGTVDTIAGEVSRLGLTNPAIILIGETVRHREGTWSARVEPRQVSHPVKAAFTNPLETA

SEQ ID NO: 8577 - protein, 436 aa, Bacillus thuringiensis
MIGRGWDDMFCYQCEQTPTGGCKVMGVCGKNETIASLQDTIVFGLKGIAAYRTHAAQLGYTDAFVDATTQEALYMTLTNSNFNEQEHIDMAMKVGKSALRVMELLDEAHTNHFGVPEPVQITQNRVEGKAIVVTGHNLFALEELLKQTEGKEINIYTHSEMLPAHGYPQLKKYKHLKGNIGKAWYDQRRLFEKFTGAILATTNCVMPIKGSYSDRFFSYDIAGLEGVQKIENDDFTPLIQKALELPEVHMDSDEQLVTGFHHNTVLSLAPEIIEAVKEGKIKRFFVIAGCDAPGKGGEYYRELATSLPPETVILTTSCGKFRFNDVDYGVVPGTEIPRYIDLGQCNNSISTVKIAAALADAFQCEVNELPVSIVLSWFEQKAVAILLGLFSLGIQDIRIGPKAPEFISAGVLDVLQETFGLKLITTAAEDMEMMLS

SEQ ID NO: 8578 - protein, 220 aa, Burkholderia vietnamiensis
MAKNRFNQHWLHDHINDPYVKMAQREGYRARAAYKLKEIDEQDKLIRPGQVIVDLGAAPGSWSQYARNKLAQGKQRDAQREGGIDGTIIALDLLPMEPIADVHFLQGDFREDDVLHQLEGVLEGRPVDLVISDMAPNLSGVASADAARIEHICDLALEFAQNHLKPEGALLVKCFHGSGYSQIVEKFKQQFKVVAPRKPKASRDKSSETFILGRQLKHPR

SEQ ID NO: 8579 - protein, 374 aa, Herminiimonas arsenicoxydans
MAKRDFYEILGLGKNASDEEIKKAYRKLAMKHHPDRNPDSKGAEDKFKEAKEAYEMLSDPQKRDAYDRYGHAGVDPNMGGGGGGGGFADAFGDIFGDIFGQAGGGRGGRGGPQVYRGADLRYNLEITLEQAAHGYDTTIRVPSWDSCETCDGSGAKPGTSPINCTTCGGHGQVRMQQGFFSVLQTCPKCHGSGKINPSPCTACSGAGKIKRNKTLEVKIPSGIDDGMRIRSSGNGEPGMNGGPPGDLYVEIRIKQHAMFQREGDDLHCEIPISFAKAALGGEIEVPTLNGKASFTIPEGTQSGKTFRLRSKGIKGVRSGYAGDLFCHVVVETPVTLTEKQKELLREFELLTIEGGSKHSPQTKSWKDKVKEFFE

SEQ ID NO: 8580 - protein, 191 aa, Legionella pneumophila
MLRIFLYFLLLINTTFCLAKTEKAIFAGGCFWCMEADFDHLPGVLSTTSGFDGDTLKNPTYEQVSAGNTHYAESVMVEFDPNKLSYKKLVEYFFMHIDPTVKNAQFCDHGSQYRSAIFYLNDQQKKIAMEYKKELEQKFPTVYTEIVPSTSFYPAEEYHQNYYKKNPVRYKYYRYRCGRDARIQEVWGNKK

SEQ ID NO: 8581 - protein, 455 aa, Oryza sativa
MEARRISASPRPCSGRRVVARKRPRHEAAVNSVRKLQRREISSCRDRAFSMSAAQERFRNIQLQEEFDTHDPKENSLLLPYLRKRSKIIEIVAARDIVFALSQSGVCAAFSRETNRRICFLNGSPDEVIRSLFYNKNNESLITVSVYGSENFSALRCRTTRIEYIRRAKPDAGFPLFESESLKWPGFVEFDDVNGKVLTYSAQDSTYKVFDLKNYTLLYSISDKNVQEIKISPGIMLLIYTRTSSSVPLKILSIEDGTVLKSFNHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSNDSSSEENAGSINISNILTGKCLAKIKASDLCKQKKAWKFQSTALEALEDITALYYDEERDEIYTGNRQGLVHVWSN

SEQ ID NO: 8582 - protein, 415 aa, Burkholderia thailandensis
MTEQASADASAAPRTVVVIGGGQAAGWVMKTLRGEGFAGRIVMIADEAHLPYERPPLSKAVLAGEADISTVRVVQPDEFGALGVEAWQPERAVSIDRARRVVRAASGREIEYDRLVIATGGAPRRLPDAIVATPRLHYLRTLDEAVALGERLRASRRVLVIGGGWIGLEVAATARKLGVDAVVVEGAPRLCARSVPGAVSDFLLELHRANGVDIRLNASLASLGAHPADANRVRATLADGTAVDADFAVAGIGLALNTSLATEAGLHVDDGIVVDEYGATSDPAIFACGDVANHPNAWLKRRVRLESWANAQNQAIAAAKAVLGVRAPYAEIPWFWSDQYDVNLQILGDLPADAQLVVRGDIAAKRATLFFVTHGALRGVIAINSARELKLARKWMNQGRAIDVAALADTTRALA

SEQ ID NO: 8583 - protein, 370 aa, Rickettsia typhi
MSQDYYQVLGVSKTASQADIKKAYLKLAKQYHPDTTNAHDAEKKFKEINAAYDVLKDEQKRAAYDRFGHDAFQNQQARGGGNNSGFHHDINDIFGDFFSDFMGSGRRKQTSSKIRGSDLKYDLTIKLEEAFHGIEKNISFSSEVKCDACHGTGSEKGETVTTCDSCGGVGVTRIQQGFFTLEQTCHKCQGNGQIIKNPCKKCHGMGRYHKQRNLSINIPAGVENGTRIRHSGEGEAGIRGGNNGDLYVDIAIKPHDIYKIDGANLHCKLPISFVHAALGGEIEVPVIEGGKVKLTIPAGTQNGDQLRLRSKGMSKIRSTIRGDMLTHIHVEVPKNLSKRQRELLEEFKKESINEKENDSSFFNKMKSMWS

SEQ ID NO: 8584 - protein, 465 aa, Arabidopsis thaliana
MGAMMVMMGLLLIIVSLCSALLRWNQMRYTKNGLPPGTMGWPIFGETTEFLKQGPNFMRNQRLRYGSFFKSHLLGCPTLISMDSEVNRYILKNESKGLVPGYPQSMLDILGTCNMAAVHGSSHRLMRGSLLSLISSTMMRDHILPKVDHFMRSYLDQWNELEVIDIQDKTKHMAFLSSLTQIAGNLRKPFVEEFKTAFFKLVVGTLSVPIDLPGTNYRCGIQARNNIDRLLRELMQERRDSGETFTDMLGYLMKKEGNRYPLTDEEIRDQVVTILYSGYETVSTTSMMALKYLHDHPKALQELRAEHLAFRERKRQDEPLGLEDVKSMKFTRAVIYETSRLATIVNGVLRKTTRDLEINGYLIPKGWRIYVYTREINYDANLYEDPLIFNPWRWMKKSLESQNSCFVFGGGTRLCPGKELGIVEISSFLHYFVTRYRWEEIGGDELMVFPRVFAPKGFHLRISPY

SEQ ID NO: 8585 - protein, 1060 aa, Thermosynechococcus elongatus
MLSKLSFRHKLLLGTLFPIVVIYTGLFFYIRSQVIRRSTADYEAWQQDVASLYAQQFSNALQEITGLATTSANALEAFPTIREEELYSFLRRNLKISRLAYGAAITFTPYSFSPRKRLFAPYVYRDIHRNRLVPKDIGHIYDYTQVRWDWYSEAVRTGQPQWSDPYFEEGAGNVWMVTYAVPFYRQGQIRGVATVDVALPTLQQEIDIQGLQQAQFFVLDRKGRIIFHGDPQLIGQSIFYIAKEYNRSDLAALAEAMISGHSGHLWMTDWVSNERQWFFYTPIPEVGWSLAIRVREEALLDFIHQETWAGLLILVVSFGLISLVTLGVTSYMVRPIQRLAIAAHKIALGNLDIAGEVDTHSQDELGNLGRTFVDMAAQLQESFAELHHFNQRLEEKVKQRTAALEAANQQLSEKERVLHDHNVALVQLSQSPHVQQGHFRMALQEIIQVTAITLRVQRASAWELQGDRLKCVVQYDPAANNHTQPTYLTHSPYPEYLKLLRSGEPLVINDLLTDPRTHELREYARVQRVYSRIDTPIIFNGQLLGVICVESIGKQRVWLLEERRFVANVADIVTIALAAHQRHQAERELLKAKEAAEAANKAKSIFLANMSHELRTPLNAILGFSQILLSDRTLAPQHRQTLEKINRSGEHLLGLINDVLDMAKIEAGRMILQQTTFDLRRMLRDLEEMLKVRAEAKGLRLVFDLAANLPVAVTTDEMKLRQVLVNLLGNGIKFTKEGSVCLKVSYRAQEPPRLAFEVSDTGIGMTPQELKMLFQPFVQTDSSKKVSEGTGLGLAISRQFVQLMGGDIQVRSTKGKGSHFYFEVPIDLGDPRSLEEEKAQTIVGLRSPTSEVRILVVDDLPENRQLLTQLLEPVGFRCREASNGQEAVEIWRAWQPHAILMDIRMPVMDGKTATRQIKKEVGDRLQRGETICPPKILAVTASSFEQDKQELLGLGCDDYIAKPFRPQILFERLAAQLHLEYAYDSTPPAAPPPPTLDPTALTVMPPSWIAELQAAAKKLNAKRIRELIAEIPPEEAALIAGLQQLVKTFRFDKIVELTLV

SEQ ID NO: 8586 - protein, 327 aa, Unknown
  Magnetococcus sp. MC-1
MADPIRVAVTGAAGQIAYSLLVRLASGQLFGKDRKVELKLLEIPQAMGPLEGVMMELQDCAFPTLAKVEAFDNPEQAFDGINWCLMVGSRPRGPGMERSDLIKINGPIFVNQGKALNRAAQDVRAVVVGNPCNTNCMIAAHNSDVPHERFSAMMRLDQNRAKYLLASKAGAQVIDVTNVVIWGNHSNNQVPDFEFAKIGGKPVPEVIADAAWLENAFMPTVQNRGAAVIKARGASSAASAANAALDHVRSLITPTPAGDTFCAAVMANGAYGVDAGLIAGMPLTSTGHGDWSIVEGVPMSPFIKGKFDAVLDELRREREMVKDLLPG

SEQ ID NO: 8587 - protein, 276 aa, Brassica napus
  misc_feature (24)..(24): Xaa can be any naturally occurring amino acid
  misc_feature (28)..(28): Xaa can be any naturally occurring amino acid
  misc_feature (43)..(43): Xaa can be any naturally occurring amino acid
  misc_feature (47)..(47): Xaa can be any naturally occurring amino acid
  misc_feature (53)..(53): Xaa can be any naturally occurring amino acid
  misc_feature (61)..(61): Xaa can be any naturally occurring amino acid
  misc_feature (65)..(65): Xaa can be any naturally occurring amino acid
  misc_feature (103)..(103): Xaa can be any naturally occurring amino acid
  misc_feature (107)..(107): Xaa can be any naturally occurring amino acid
  misc_feature (110)..(111): Xaa can be any naturally occurring amino acid
  misc_feature (113)..(116): Xaa can be any naturally occurring amino acid
  misc_feature (176)..(176): Xaa can be any naturally occurring amino acid
TIRKKDHHDDQPISSSKPDKLNSXADKXLMSPKMRLIKKTITXNNKXRIDHTXSNDNNHKXDHYXLDKTTFKEDHDEELKKVSTRTTTAVTTEKRCNTINETXYGNXNGXXRXXXXCNTTKTPLWRSGPRGPKSLCNACGIRQRKARRAAMAAAVAAGDDQEVVARLQQLPVKKKXQNKRKRFNGGDKYNLSSPVVAKTKKCKLKEEEDDAAIVAGDSEISKSTTSSGSSVLPNKFCFDDLTILLSKSSAYQQVFPQDEKEAAILLMALSYGMVHG

SEQ ID NO: 8588 - protein, 420 aa, Neisseria meningitidis [sequence omitted]

SEQ ID NO: 8589 - protein, 483 aa, Pichia angusta
MSIDDKPLPADLAKEIETYKELFWVPTETLHKIIDYFIEELERGNADGTDPTGIPMNPAWVLEYPNGSETGDYLAIDLGGTNLRVVLAHLLGDHKFSTEQTKYHIPSHMRTTKNRDELFEFIAQCLEDFLKSKHPDGIPSDAVFPLGFTFSYPATQNSIFEGVLQRWTKGFDIPNVEGHDVVPLLMEQVEKKGLPIKIGALINDTSGTLVASRYTDELTEMGCIFGTGVNGAYYDRIKNIPKLKGKLYDDIDPESPMLINCEYGSFDNAHKVLPRTKFDIRIDDESPRPGQQSFEKMTSGYYLGELLRMIMLDTYKKGLIFKSYTESSEQIKNLETPYFLDTSFLSIAEADDTPSLSVVSNEFSNKLFIDTTFEERLYVRKLSQFIGTRAARLSICGISAVCKKMNYKKCHVAADGSVFLKYPYFPERAAQGLSDVFGWDGIDMKDHPIQIKQAEDGSGVGAAIIAALSHARREKGLSLGLKK

SEQ ID NO: 8590 - protein, 369 aa, Neisseria meningitidis
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIATESGVPVYICSSLKPDALAEAADNQADGSFFVPRAKGLRTQKQWLAFYSESRGGVYVDEGAEHALSEQGKSLLMSGIAGIEGHFSRMDTVTVYSKATKQPLGKGRVLFGSAAAEDLLKLRKAKGVFIHRDDWISITPEIRLLLTEF

SEQ ID NO: 8591 - protein, 578 aa, Thermosynechococcus elongatus
MLTETRPRDVQVAEIAPGVLVLRSRTWDRLKFEVEYGRQQGTTSNSYLIQAPQPALLDPPGESFTQIYLQELQRHIDLNQLRYLILSHVNSNRLATVKVLLEKAPQITLVCSKAGAVTLRSAIGEQLHLWIARADTPLELGGDRQLMFIAAATPRWPDGLITVDPQNQIVFSDKLFGAHVCGDSLYDEQWKKLDEDRAYYFECLHAAQTRQVESILDRLAELTPPPRLYAPAHGPIVKFSRSRLFQDYRDWCQAQAEQETKVALFYASAYGNTAILANAIAQGLTAAGVQVEAVNCETTPPAEMQALIHSSDGFIIGSPTLGGHMPTQVQTALGFILAEGSQTKLAGVFGSYGWSGEAIDDIEQKLLDAGYTLGFETLRVKFTPTATDLEKCQIAANEFAQALKKLRKSRTVRPSSLAEAQVDRTEQAVNRVVGSLCVLTTLPEGCFHLTQAAAILVSSVSQASFNPPGITVSLPQEWAESLCLVGDRFVLNILKEGSPLVRQFQQAQRLGEQQLATLGLKSAESGAPILLDALAYLECTVESRMNCGNHWLIYAVVESGELLQTSGLTAIQHRKTSS

SEQ ID NO: 8592 - protein, 112 aa, Magnetospirillum magnetotacticum
MKKIEAIIKPFKLDEVKEALHEVGLQGLTVTEAKGFGRQKGHTELYRGAEYVVDFLPKVKIELVIEDNLVERAVEAIQQAAHTGRIGDGKIFISTVEEAIRIRTGERGSDAI

SEQ ID NO: 8593 - protein, 594 aa, Unknown
  Magnetococcus sp. MC-1
MHQQTLRLVHAVKKNRFKTIKAISSLVVLGLVGCTWAVESGLNQSRAETAAATTKEPHIFTPEERLADATATFSFLVGHLLLQERDWKGAEAAFTQVVESDPGAVESQVMVARLAMQGKDYEKALVHARKVVDLAPEHELARRTLATILRVLKRYPEAVVQYEELLKQDPDDSGVRLVLAQLYGRIGRAAESSKVVEALLSHPLIGWRAELAVGRGWLHQDDQAQALAAFERARAMAPEQLEPTLALGSVLQDLKKNEEAEAIYRRYLDEHPRSEVVHTRLGRLLLNVDDREGALAVFSNLQRLAPSSVQAHLSSAFILLSQERYEEALGALRLAEVQQPENSSIRYYLGQALEYLKRDEEAVGEYAKVQLGETFYPESQIRIAYLQSDLGRKKEGVEIVESLYKSHPTRVDVVLALNFLQLQNDQYEQVIQSTEEGLKLDPEESRFLFNRAMAYDKLGKWKEAEADLEAYIKVNPNDAHALNYLGYTWADRNENLEGSLELLKKAAKLAPGDGFITDSLGWVLFRMNRLSESVDAMREAVRLQPDDATIVEHLGDVLKALGRDKEAANFWQKYLKISPDNANLKEKLRQLNLP

SEQ ID NO: 8594 - protein, 445 aa, Bradyrhizobium japonicum
MLRAEDNKFLTESGPGTGMGELLRRFWIPVLLSKELPEADGEPKKIVVLGEELLAFRDSRGVVGVIDQYCPHRGANLWLGRNEECGIRCVYHGWKFDTDGRCVDMPTSYPDLNAKDLIRIKSYPVREWGEMIWAYMGPADVMPELPDLEMAMLPASHRYVSKKWQDCNWVQALEGSIDTAHFTFAHLSFDKEENEILDIKKHFVNPIARMSSDHMRWIAEDPRPVIKIAPHDAGLSIAGGRLTGSDNIYWRIAQFLMPFHAYAPSAMPGENIFGQTFVPVSDTNCWIYTYAWNPERPLTQAERDAYDRGNGVIAEVDDNYVPLRHKGNDYLIDRKLQKTRSYTGIKGVSEQDAAVQDSQGPIADRTREHLGPTDLGIMHFRKVVMDLARALQRGEAPPQAAHQDRYAVRSGACVTSKAKDLPAVMLERFGDVAGFVGRPKVAAAE

SEQ ID NO: 8595 - protein, 482 aa, Vibrio fischeri
MKGDIGVIGLAVMGQNLILNMNDHGYKVVAHNRTAEKVDEFLQGPAKGTNIVGAYSLQELVDKLESPRKIMLMVRAGDVVDSFIDKLVPLLDKGDIIIDGGNTNFPDTNRRVAALKEKGIHFIGSGVSGGEEGARFGPSIMPGGSPEAWPFVKPIFQAISAKTENNEPCCDWVGNDGAGHFVKMVHNGIEYGDMQLITEAYQFMKDGLGMTHDEMQSVFIEWNKTELNSYLVEITSDILGYKDTDGEPLVEKILDTAGQKGTGKWTGINALDMGIPLTLITESVFARCLSSLKDQRVEAEELFGKKESIVEGDKQVWIEALRQALLASKIISYAQGFMLMREASNENGWDLNYGNVALMWRGGCIIRSAFLSNIRDAYDIDPELSFLGSDSYFKGILENSMSAWRKVAAKSMEVGIPMPSMTSALTFLDGYTTARLPANLLQAQRDYFGAHTYERVDKPKGEFFHTNWTGKGGDVSSTTYNS

SEQ ID NO: 8596 - protein, 75 aa, Symbiobacterium thermophilum
MARSDMIEVDGVIVEPRSNGFFTVRLDLENQPEVIAHLGGKLRRHYIRVVPGDRVTVELSPYDLTRGRIVYRYRH

SEQ ID NO: 8597 - protein, 1127 aa, Oryza sativa
MPGDTTHSVNFGTSKNWQCSSASVAALSCEVLGAAALQSMEASETLASDAAIADCLARALRRGSQRVAEAACNAIMDLSASSAGREHLAGSAVLQSILYLFSQVEFISGVIDIRSTECSKSASKANKSFYLMVDTLVFMVNSCQVDTLHNLQQDVVRKVLPLLHKIWKNVDKLGSSTDCINSKNQLQRKEHEISEAIFRLSMNIACPAHLEPDEVRRSIFGQSVSDYENFLLNYWEKSTYLVTRKQKNLHVDSVFTSLLNEFDLKTPDTIIQSLVNGIVSCPAIASDELDISSFLREVQGSLGATVKYRQDIRVVRINDQCDQTSIGYAMEEHFFDDGMTFQDADAFVEKCKDAFKNGFSVALRGMEFRSEKIAAIASAVADLFGQPSVGANIYFSPPRAQGLARHYDDHCVLVWQLLGCKKWMIWPDTKLLLPRLYEPFEPLDDLVDDCGGRMEILLEGDIMYVPRGFVHEAHTDVDVGGFEVNSTVDCSLHLTLAIEVEPPFEWEGFTHIALHCWTEKHWSSPFVKSQEEARTSLFALLLHVAIRLLSKNDATFRKACMVAAKLPPSSSCTTTHSKALRSNQRSFFDEIIKKIDRSCNFKEALMCIGLAVREKNDEPFQWMCWLRHLPQHGGTNDQVDFCNILGALEELLEAVSCNLEQSLTEFTDFKLKFCRLSELAVVPAMQCQVGAVRARPAAAAAAAGGRVWGVRRTGRGTSGFRVMAVSTETTGVVTRMEQLLNMDTTPFTDKIIAEYIWVGGTGIDLRSKSRTISKPVEDPSELPKWNYDGSSTGQAPGEDSEVILYPQAIFKDPFRGGNNILVMCDTYTPAGEPIPTNKRNRAAQVFSDPKVVSQVPWFGIEQEYTLLQRDVNWPLGWPVGGYPGPQGPYYCAVGSDKSFGRDISDAHYKACLYAGINISGTNGEVMPGQWEYQVGPSVGIEAGDHIWISRYILERITEQAGVVLTLDPKPIQADSVICFVIRLRLILQITKSMREDGGFEVIKKAILNLSLRHDLHISAYGEGNERRLTGLHETASIDNFSWGVANRGCSIRVGRDTEAKGKGYLEDRRPASNMDPYVVTALLAETTILWEPTLEAEVLAAKKLALKFLENHATFHSPVNILVEHHT

SEQ ID NO: 8598 - protein, 448 aa, Symbiobacterium thermophilum
MSSSLRFTVSPSLLGPHPHELTYQAEAIRIAHRMLHERTGPGAGFTGWLDLPERYDREEFRRIQEAAARIRGDSDVLVVIGIGGSYLGARATVEALGHAFHNLLPPERRGAPQIFFAGTDLSPRYLTELLDVLEDREVSLNVVSKSGTTTEPAIAFRLLRNWMERRYGKEGARRRIYATTDAARGALKQLADAEGYTRFVIPDDVGGRYSVLTAVGLLPIAAAGIDIDALMAGAAAAAAAYSDPDLERNPCYQYAAARNALYRKGMTTEVLVTYEPALKATAEWWKQLFGESEGKDGKGIFPAAAAFTTDLHSLGQYIQEGMRNLFETVVHVERPSVDIPLPPGDEGDGLGFLGGQTLHHVNHTAFLATRLAHTEGGVPNLTLTLPELTPYHYGYMLYFFMKACAISGYLLGVNPFDQPGVEAYKQNMYALLGKPGFEARRAEIEERL

SEQ ID NO: 8599 - protein, 431 aa, Prochlorococcus marinus
MKRVLAIILGGGKGSRLYPLTKMRAKPAVPLAGKYRLIDIPISNCINSNITKMYVLTQFNSASLNRHLAQTYNLSSPFAQGFVEVLAAQQTPESPSWFEGTADAVRKYQWLFQEWDVDEYLILSGDQLYRMDYSLFVEHHRETGADLTVAALPVDGAQAEGFGLMRTDNDGNIREFKEKPSGEALKAMAVDTSRFGLSPDSAKERPYLASMGIYVFSRSTLFDLLNKYPSYKDFGKEVIPEALSRGDALKSYVFDAYWEDIGTIGAFYESNLALTQQPTPPFSFYDEKFPIYTRARYLPPSKLVDAQITDSIVGEGSILKSCSIHHCVLGVRSRIESDVVLEDSLVMGSDFYESAEERIALRKGGGIPLGVGQGTTVKRAILDKNTRIGENVTIINKDRIEEADRADQGFYIRNGIVVVVKNASILDGTII

SEQ ID NO: 8600 - protein, 348 aa, Ustilago maydis
MASYTSIVRDMLRPSTSSSSSTAWWDPNTSMPVLDDRIVIITGPTSGIGYETLRQLVLSSAHVYLFGRSLGRLEQTRATLCVECSAALDALEPRSLRYGAKVGSMHLIQCDLSDLHSIQRAVTEFLQSETHVDLVFANAGVMLSGKTAQGYEQMFGTNVLGHHALVRLLLPALRRSATLRNSASTGETRIVLTASDTHRWVNHRDHVTLSDDATNAKLGHMHLYGRSKLGNIYTAAHLAHLSHKHAWGLTVCSVHPGGVKSQLGSTNRILTAIKNMFLVPATLGAVTQLWAGAGAQAAQVNARYLVPYATVGTESELASNKLVRDNVWTWCEQQCLKHGLTQPQDLIL

SEQ ID NO: 8601 - protein, 472 aa, Prochlorococcus marinus
MSKAHFGLVGLGVMGENLVLNAERNGFSSVVYNRTYSKTEAFLNGKGLGKKISGASDLQDFVNKLERPRRILMMVKAGAATDAVIEQISPYLQEDDLLIDGGNALFSDTERRVLELESKSFGYIGMGVSGGAKGALEGPSMMPGGTKASYKAIENLLNKMAAQVDDGPCVTYIGPRGSGHFVKTVHNGIEYGIEQILSEGYDLMKRVCKMNCDEISDVFGIWNKTEELSSYLVEITEICLRTKDPTDGADLVEKIMDKAGQKGTGLWTVVSALQLGASVPTIYASLNGRVMSSMKSERVKAEKVFGKLSIERTDLGSPSNGMSPIMDAVVLSTIASYAQGMEILRLASEEYKYDLHMPSIAQIWKGGCIIRSTLLQRIQDAFNNEPQLTNLLMDPWFAEQIKNRLPGLTKTVAVAAQTGVPVPCFSSTLDYINSYRTARLPQNLVQAMRDCFGSHTYERIDKEGSFHTEWIN

SEQ ID NO: 8602 - protein, 318 aa, Prochlorococcus marinus
MEIIESDVVIIGGGPAGCTCALYTSRSNLKTVILDKNPSVGALAITHQIANYPGVPVDISGEKLLTLMREQAVQYGTDYRRAQVFGIDASGEWKTVFTPEGTFKAKALVLASGAMGRPASFKGEADFLGKGVSYCATCDGAFYKNREVAVVGVNKEAIEEATVLTKFASTVHWITSSDPKSDNEEAMELIDNSNIKHWSRTRLLEILGDDMGVNGVIVKNKQEENPINLNLDGVFVYMSGSKPITDFLGDQIALKDDGGVIVDDFMSTNSDGVWAIGDIRNTPFKQAVVAASDGCIAAMSIDRYLNSRKNIRVDWIHS

SEQ ID NO: 8603 - protein, 283 aa, Prochlorococcus marinus
MKDITTWIDEYQKGSRFGLKGKVLLKKNSKFQEILIIESDYYGKALMLDRCWMTSMRDEKYYHECLVHPALSSIKEKSRILIIGGGDGGTARECLKYSQVEKIDLVEIDEEVIKASKKFLQEIGGTAWIDKRLTIHIDDGVKWVEKAKNNFYDCIFIDCSDPSEFSNLLFTDTFYKECKRILTQKGILATQSESPESFKNIHIHILKSLKKVFKLSETMYSFVPIYPSGIWSWTFASKGELNLSTPCCNEVTTIEKGCDIWNLNFQNAAFKMMPNKIVKELNS

SEQ ID NO: 8604 - protein, 146 aa, Fulvimarina pelagi
MRYLHTMVRVSDLDASLDFYCNKLGLVETNRKESEQGRFTLVFLAAPDDLPQAKDTKAPLMELTYNWDPEEYTGGRNFGHLAFAVDDIYGTCQKLMDNGIIINRPPRDGHMAFIKSPDGISFELLQKGDALQPKEPWASMSNTGSW

SEQ ID NO: 8605 - protein, 339 aa, Burkholderia mallei
MNTTTLSTKLNAFARLNLIDAPTPLQYLPRLSAHVGRDIHVKRDDCTPLAMGGNKLRKLEFLAADALGQNADVLVTAGAIQSNHVRQTAALVAQLGLGCVALLENPIAAARDDYLQSGNRLLLDLFDVRAHVVDGLDDVDRQLEAAARRLRDEGRRPYVIPIGGSNPLGALGYVRAGLELAQQIRAAERDFAAVVLASGSAGTHAGLAFALAHALPGLPVIGVTVSRTDAQQRPKVRHLLDGMSGLLDVALPAGARIDLWDDYFAPRYGEPNRAGIDALRLLARTEGLLLDPVYTGKAMAGLIDGVARGRFDGNGPVLFVHTGGAPALFAYQDTCRASR

SEQ ID NO: 8606 - protein, 174 aa, Unknown
  uncultured marine gamma proteobacterium EBAC31A08
MNKFYIFGLLFFTLNAFSCSDLLDTDMRVLDSAESRNLCEFEGKALLVVNVASRCGYTYQYAGLQKLYESYKDEDFLVIGIPSRDFLQEYSDESDVAEFCSTEYGVEFPMFSTAKVKGKKAHPFYKKLIAESGFTPSWNFNKYLISKEGKVVSTYGSKVKPDSKELISAIEGLL

SEQ ID NO: 8607 - protein, 216 aa, Triticum aestivum
  misc_feature (167)..(167): Xaa can be any naturally occurring amino acid
  misc_feature (182)..(182): Xaa can be any naturally occurring amino acid
  misc_feature (184)..(184): Xaa can be any naturally occurring amino acid
  misc_feature (188)..(188): Xaa can be any naturally occurring amino acid
  misc_feature (193)..(193): Xaa can be any naturally occurring amino acid
  misc_feature (204)..(204): Xaa can be any naturally occurring amino acid
  misc_feature (208)..(208): Xaa can be any naturally occurring amino acid
  misc_feature (212)..(212): Xaa can be any naturally occurring amino acid
MDLLSGRVVHGCSPSWRGVKSLRFPPLLGSWAAGSSAFPGCSCALAVCRNGSAVVPFAKKKRKGYSVEPPDGEETKDGASDEIEGMVEDVDGEEEGGDEEDAGDDDIVDDDDSDNDDDYDFEDEFESDDEQDLYVGDGGAGGGVSLAGTWWGKEALALAEEVSASFXGDLKIYAFKATANLXIXVRIXKMSTXYGSPTIDDIEXYTIXYRAXLDDA

SEQ ID NO: 8608 - protein, 338 aa, Photobacterium profundum
MNQNVNNAITMTVLGAGSYGTSLAISLARYGANVILWGHDAEHIAQLEIDRANEAFLPGVAFPESLILSADLEMAVQASRDLLVVVPSHVFGLVLSDVKPFLREDSRICWATKGLEPETGRLLKEVAVDAVGAEVPLAVLSGPTFAKELAAGMPTAIAVSSPDDAFVEDLQEKIHCSKTFRVYSNSDFIGMQLGGAVKNVIAIGAGMSDGIGFGANARTALITRGLAEMCRLGAALGAQKETFMGMAGLGDLVLTCTDNQSRNRRFGLALGQGKSVDQAQIDIGQVVEGYRNTKEVWALAQRYGVEMPISEQIYQVLYQGKDAREAAKDLLARDKKYE

SEQ ID NO: 8609 - protein, 242 aa, Porphyra yezoensis
MAIVTLAELLEAGVHFGHQARRWNPKMFPYIYTERNGIHIIDLVQTAQLLTEACELIKQASSDGKKVLFLGTKRQAAGIVAQEAQRCDSYYVNQRWLGGMLTNWVTIKSRVSRLRQLEEQDKSGMIDQLPKKEAAVLRRELDKLRKHLNGIKNMTRLPDIVVVVDQKRETTAIQECLKLGIPTICILDTNCSPEIINIPIPANDDAIRSIKLIVGKIADAIYDGKYGQTDLEEITHPTQSEL

SEQ ID NO: 8610 - protein, 117 aa, Picea abies
STITLTKNVRRFSQHRWRAMATNPTVDYDSSAKSVFPAEACDTVGGEACEGEIGAEVTLKVDSPPTSSPGVGIDREYVEYASEQKTVFPGEACDDLGGEFCEPEYQSGVYKEKEPAK

SEQ ID NO: 8611 - protein, 461 aa, Unknown
  Rhodococcus sp. RHA1
MRRELRFVMSKILAVPPAQSQLQPVSGRSGLPGVGHVLEYIRDPLALMQKHWDRYGEVSWFSMVGRRWVAVLGPDACQEVLQNKDRAFVNGDGWSVLIGPFFHGGLMLLDSEEHLRHRRIMQQAFTRSRLENTVDVLNPAIDSALDAWTPTNGFRAYTALKALTLDLATDIFMGGAEGSTESEISSVKKAFVDCVQAATSVVRYPVPGTRWKRGLDGRRVLEDFFRQYLPARRSHETDDLFSVLCHIESEAGQRFSDDEVVDHMIFLLMAAHDTSTITISTMMQYLGQHPQWQDRCRAESLALGTPAPSYADLDGLDSLDLVMKECLRIVSPVPVMARRAVRDTQVQGHFVPAGTYAAVVPHFTHHMPQYWPEPERFDPERFAEHRREDKVHRYAWEPFGGGVHKCLGMHFAGAEIKAIMHHLLLRFDWHVDADYVAPLNFTSLPFPSDGQPVDLRLLATS

SEQ ID NO: 8612 - protein, 613 aa, Clostridium thermocellum
MCGIAGWINLKSDLTNQKEILNSMIDRLTPRGPDASGSWISPNALIAHKRLIVVDPEGGIQPMVRRQGENTYVITYNGELYNTADLRNELESRGHEFLTSSDTEVLLVSYIEWGAKCVEHLNGIYAFGIWDEGKKRLFLGRDRFGVKPLFYAQRGDSLIFGSELKALLANPLVEPKLDAEGLAEIFALGPARTPGHGIFKDVYELKPAHSMIFDINGIQIRKYWSLESYPHTDSEKATISKVRDFVLDAITRQLVADVPVCTFLSGGLDSSAITAVASKTFASQGKGQLNTFSVDYVDNDIYFKPSMFQPNSDEPWIKKMSESFNTCHHYVKFDTPQLVDALIDAVKARDLPGMADIDSSLFLFCREVKKFSVVALSGECADEIFGGYPWFHNEKMLFADTFPWSVSVHERTKILSPEILNLIKPEEYIQRRYRETLSEVPHLKGENRIEARRREIFYLNINWFMATLLDRKDRMSMASGLEVRVPFCDHRLVQYVWNIPWELKMYNKREKGLLRQALKGILPDDIIERKKSPYPKTHNPSYKKAVSKWLLEILNDSSSPLHQLIDVKVVRSMAEGNSDNTDPWFGQLMAQPQMLAYLIQVDFWLRDNHISIV

SEQ ID NO: 8613 - protein, 489 aa, Mycobacterium bovis
MSAASQRVDAFGEEAGYHKGLKPRQLQMIGIGGAIGTGLFLGASGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 8614 - protein, 284 aa, Chlorobium tepidum
MKYKTLTPEEKRVIIDKGTERPFSGKYYLTKEKGVYQCKQCGADLFRSDAKFDSGTGWPSFDDAIPGAVRQETDRDGMRIEILCANCGGHLGHVFYNEGFTSKNARYCVNSVSLSFEPSDKPATATEKAVFAGGCFWGVEYHFKKMKGVLSTTVGYTGGKTAHPTYEQVCSGRTGHAEAIEVEFDPSVVSYEELAKLFFEIHDPTQVDRQGPDVGEQYRSAVFYQNDQQKKIAEALIEQLKKRGYDVVTSVEKGGEFWPAELYHQDYYEKTGHKPYCHIYQKRF

SEQ ID NO: 8615 - protein, 403 aa, Thiomicrospira crunogena
MKPKLILVGTGMAGTRFLEHLLEEAPNRYEIEVFNKEPVGGYNRIMLSPVLAGEKTIPDIMTHDEAWFEERRIRLHTGKTVSAIDSVGQVLTTFCGETYFYDKLVIATGSNPFKLEIPGADLPGVVTFRDIRDVENMLSVSQNHNKAVVIGGGLLGLEAAHGLIKRGMDVTVIHRSEVLMNMQMDEESGQLLKSHLEQGSSHALGMKFRLGVNTTEILGQHQVEGVRLDDGSEIATDLVVMSIGIRPNTQLAKQANLDVNRGILVNDFLETSAENIYALGECNEHRGQTYGLVAPLYEQAKILAKRLAGQSVSYTGSITSTMLKVTGVQLFSAGEFKGENGADVIVFRDLAKNIYRKIVLKNNQVIGALLFGDTTGATWLFELLRQKQNISPMRDTLVFGPGY

SEQ ID NO: 8616 - protein, 112 aa, Porphyra yezoensis
MKKIEAIIRPFKLNEVKLALVKEGIGGMTVIKVSGFGRQKGQTERYKGSEYSIDIIDKIKIEIIISDDKVEKIVETIIKASKTGEIGDGKIFISSIERVIRIRTNDLNFEAL

SEQ ID NO: 8617 - protein, 846 aa, Thiomicrospira crunogena
MKQRIVVIGNGMVGHSFLEKLIASEGFENFEVTVFGEEPRKAYDRVYLSSYFSGKTAEDLSLVKPGLYEENGIQLYLKDKVIDIDRTQKTITSESGQKISYDKLILATGSYPFVPPIKGNDRDNCLVYRTIEDLEAIKAAASNGKTGVVVGGGLLGLEAAKALKDLGLDTHVVEFAPRLMPVQLDEGGAGLLKRKIENMGVHVHVSKATQEITDGENCFNKMVFSDGESLETDIVLFSAGIRPRDDLAKQAELAIGPRGGVEINDQCLTSDPNIYAIGECALHNGVIYGLVAPGYAMAQAVVDQLNLTSASFEGADMSTKLKLMGVDVGSIGDPHGNDESALSYVYENGPEEVYKKIVVSSDGQTLLGAVLVGDAEDFSNLLQIMLNDMTLPEHPDSLILPNRDGGGSDLFGPDALPETAQLCSCYDVSKGDIIQAVEAGCCTVSDVKASTQAGTGCGGCVQLVTNVLNNELEKRGVEVNTDLCEHFSHTRQELFHICQVEEIKTFEDLIQKHGRGHGCDICKQTTGNIFASLWNSYALEPDKIPLQDTNDNYLGNMQKDGTYSVIPRVPGGEITPQKLIVLGQVATKYKLYTKVNGGQRIVLFGAQMNDLPAIWKELIDAGFESGQAYAKALRTVKSCVGSTWCRYGLDDSVTMAIDMENRYKGLRSPHKIKMGVSGCTRECAEAQAKDIGLISTEEGWNLYVCGNGGMKPRHADLFATKLTQEEVFRYVDRLLMFYIKTADRLQRTASWLDNLEGGLTYLQEVVIQDSLGIGESLEDQMKRLRETYECDWKRAIANPSFTKRFRSFVNVDNKAEQLFVQERGQIRPATEQDKLNGIAVQVKEIA

SEQ ID NO: 8618 - protein, 143 aa, Zygosaccharomyces pseudorouxii
GVGFLDHMIHALAKHSGWSLIVECIGDLHIDDHHTTEDCGIALGDAFKQALGQVRGVKRFGFGFAPLDEALSRAVVDLSNRPYSVIELGLKREKIGDLSCEMIPHFLESFTEAARLTVHVDCLRGFNDHHRSESAFKALAVAL

SEQ ID NO: 8619 - protein, 176 aa, Pseudomonas aeruginosa
MSFNTEVQPGICMEPDAITQEYVFNHTMLRVKDPKRSLDFYSRVLGMRLLRRLDFEEGRFSLYFLAMTRGEEVPDALDERQRYTFGRQSVLELTHNWGSESDDSQYHNGNQDPRGFGHICFSVPDLVAACERFETLGVNFVKPLDRGMKNVAFISDPDGYWVEIVQASLNGEMGRG

SEQ ID NO: 8620 - protein, 907 aa, Thiomicrospira crunogena
MNRPVFLNPEDVETTCPYCGVGCGMTVSSKAPSTESDSFEVKVKGSPSHRANYGKLCVKGSSAGETVDFSGRMLHPQIDGNIVDWETALNDVAKTFQKTISEYGPDSVAFYVSGQFLTEDYYVANKLIKGFMGTANIDTNSRLCMASAVVGYKRAFGSDTVPCCYEDLEHADLITLVGSNTAWAHPIIYQRIAAAKKKNPKLKIVVVDPRKTATCDIADLHLAIKPGMDAALFNGLLAYLNQQNALDLDYIQKHTEGFESALQKANELQGNVSDLATQCDLNETDLRQWLDWATYTPKMVTMYSQGINQSSSGVDKSNAIINCHLATGRIGKEGMGPFSITGQPNAMGGREVGGLANQLAAHMDFSDSENIDRVARFWQAENMAQQNGLKAVDLFHAVGEGKIKAIWIMNTNPVVSMPDADNVKRALEKCDYVVVQDCMQDTDTTRVANVLLPATTWGETDGAVTNSDRTISIQRQFMQGPENARPDWWILSEVAKKMGWAHAFNYDSAVDIFREHAQLSGFENNGSRDFDISAFANISKQEYAHFKPIQWPVNVSAPNGTQRMFSDGCFFTPSKKAQFIAITPYAPLSQQTKDKPYVLNTGRVRDQWHTMTRTAKTAKLMAHKNEPYITLHPDDARIQRLSEGDLVRVSNELGQLIGRVEVSDSQRRGEIFVPIHWTSQYASHGRVDSLIKANVDPLSGQPESKHATVTIERYSAQWQGFILSRTAINPELFDDDYWVKITGKHFYRYEIASERAIKNAHAWAKTILSSSENTEWIEYDDASCKQYRAALIKNDQLQKVFFMAEDHKMPSRDWLGHLFSATELSPIERRSLLAGKASGAKDPGRTICSCFGVGINTIIEAIEAQNLVSVEAIGQALKAGTNCGSCVPELTEILAVELSLDVSEKTG

SEQ ID NO: 8621 - protein, 473 aa, Thiomicrospira crunogena
MDYLPIFMKIEQQHCLIVGGGTVAARKADLFIKSGAIVTVVAPKLGNEMTFHLAQGKIIWHMNTFSTALVSELPRPSLVISATDDQNVNLAVYKTYHAQDIPVNVADQTEYCDFILPAIVDRSPMTIAISTGGRSPVLARVMKARLETMIPHGFSVLTDLVGRYRQTVKNVISDIDGRKTFWETLLSGLFIDKAVHGNTGEAEALLEAELETIKNNGQSLPQGEVYIIGAGPGDPDLMTFKGLRLLQQADVILYDRLVAPEILEMGRREAERIYVGKKEKWHKMDQKDINQMLVDLARQGKRVARLKGGDPYIFGRGAEEVELLVQHDVPYQVVPGITAAAGCSVYADFPLTHRDYAQSVALITGHQQAGAQGIDYARLAQSGDTMVFYMGIKNAPKIQAGLIAHGLCPDTPAAIIENGTRLNQKVTVTSLAKLSETIQKKSIKPPALLVIGEVIKVRERLQKKSLLDDRVPA

SEQ ID NO: 8622 - protein, 411 aa, Asparagus officinalis
MNALAATSRNFKQAAKLLGLDPKLEKSLLIPFREIKVECTIPKDDGTLASFVGFRVQHDNARGPMKGGIRYHSEVDPDEVNALAQLMTWKTAVANIPYGGAKGGIGCSPGDLSLSELERLTRVFTQKIHDLIGVHTDVPAPDMGTNAQTMAWILDEYSKFHGYSPAIVTGKPVDLGGSLGRDAATGRGVLFATEALLAEYGKGISGQRFVIQGFGNVGSWAAQLITKAGGKVVAVSDVTGAIKHSNGLDIENLLKYSVKNRGIKGFSGGDAIDSNSLLTEDCDVLIPAALGGVINRENANDVRAKFIIEAANHPTDPEADEILSKKGVCILPDILANSGGVTVSYFEWVQNIQGFMWDEEKVNSELKTYMTKGFKHVKEMCKTHNCDLRMGAFTLGVNRVARATLLRGWEA

SEQ ID NO: 8623 - protein, 641 aa, Oryza sativa
MMGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGIGGSNGGVFEDVNGMMQQPQQTTPAQQQFFIRDDTPFGNQMGDINGASEFRFGSGFNMSGAVEYPGAMQGQQKNDGSNWYY

SEQ ID NO: 8624 - protein, 558 aa, Trifolium pratense
MGCHGSKEAKKSAAEHSRHRHQSSAAAGGAATGGTNFQYQIVQPSSSHVQTSPPPKPKPESHSHSHSHASTVTTTTTSNPKPSASENVRTVQKPDTTILGKPFEDIKKFYTLGKELGRGQFGITYFCTENSTGLNYACKSILKRKLVSKADREDIKREIQILQHLSGQPNIVEFKGAYEDRFSVHLVMELCAGGELFDRIIAQGHYSERAAASICRAVVNVVHICHFMGVLHRDLKPENFLLSSKDEGAALKATDFGLSVFIEEGKVYRDMVGSAYYVAPEVLRRNYGKEIDIWSAGIILYILLSGVPPFWAETEKGIFNAILEGELDFVSEPWPSISDSAKDLVRKMLTQDPKKRITSTQVLEHPWMREGGEASDKPIDSAVLSRMKQFRAMNKFKKLALKVMAENLSEEEIKGLKAMFANMDTDGSGTITYEELKSGLARIGSRLSEPEVKQLMEAADVDGNGSIDYLEFISATMHRHRLERDEHLYKAFQYFDKDNSGHITREELETAMTKHGMGDEATIKEIISEVDTDNDGRINYEEFCAMMRSGMPHQAQLF

SEQ ID NO: 8625 - protein, 435 aa, Vibrio cholerae
MNANLNKAYPNVSLENFFSTPLAATNDAVFAAIQAEYTRQNEQIELIASENIVSKAVMQAQGTCLTNKYAEGYPGRRYYGGCEHVDSVEQIAIERAKMLFQCQYANVQPHSGAQANGAVMLALLQPGDTIMGMSLDAGGHLTHGARPALSGKWFNAVQYGVDRQTLEINYDSVRALALEHKPKMIIAGGSAIPRTIDFAQFRSIVDEVGALLMVDMAHIAGLVATGAHPSPLPHAHVVTTTTHKTLRGPRGGMILTNSEEIHKKINSAVFPGLQGGPLMHVIAAKAVAFGEALGPEFRTYIDSVIDNAKVLAEVLQTRGCDIVTGGTDTHLMLVDLRPKGLKGNQVEQALERAGITCNKNGIPFDEEKPMITSGIRLGTPAGTSRGFGREEFKLIGEWIGDVLDGLVASPEGNPDVEQQVRKQVKALCQRFPLYQ

SEQ ID NO: 8626 - protein, 493 aa, Unknown
  Rhodococcus sp. RHA1
MTHYDILIVGAGISGIGAAIRLKQSGIDNFAILEKGDALGGTWRDNTYPGCACDVPSALYSYSFAPNREWSRLFAGQDEIRRYIERTAAEHGVPAHVKFGTEMQRAQWSEQSRRWTVDTSAGTFTANAVIAAAGPWNEPLVPTVPGLDTFTGEVFHSSRWNHTYDLTGKRVAVVGTGASAVQFVPAIQPTVESLHLYQRTAQWVLPKPDHTLPGVERAILRRVPGAIRALRRVEYAIMESLGLGFRHPWILRVIQQVGKAQLRAQVRDPKLRKALTPDYTLGCKRLLLSNTYYPALTRPNVEVHANAVESVRGNVVVGSDGAEREVDAIIFGTGFHILDMPIGSKVFDGDGRSLDDHWKGSPQAYLGTTVAGFPNAFVLLGPALGTGHTSAFMILEAQLDYLIQAVTAARSNGWTRMEPRREVQDAFNAQVQEALATTVYNAGGCQSYFLDVNGRNSFNWPWSTDRMRQRLGRFDEAAYDVSREPASATATSR

SEQ ID NO: 8627 - protein, 426 aa, Oryza sativa
LHAPFALLPMSFSKVYWDQAVELAPLFNELVDRVSLDGDFLQETLARTKEVDSFTGRLLDIHAKMMKLNKKEDVRLGLTRSDYMIDGATDQLLQVELNTISTSSNGLACGVCELHRNLIRQHERELGLDPESVVGNTAIAQHAEALAGAWAEFNNQSSVVLVVVQPEERYMYDQYWITVALREMYGVTTIRKTMAAIDAEGELRPDGTLTIDGLPVAVVYFRAGYTPNDYPSEAEWRARLLIECSSAIKCPSIAHHLVGTKKIQQELAKENVLERFLDNKADIEKVRKCFAGLWSLENDSIVMSAIESPELFVLKPQREGGGNNIYGDNLRETLISLKKDGSNELAAYILMQRIFPPASLCYLVRDGTCIRENAVSEFGIFGAYLRNKDRVIINDQCGYLMRTKAASLNEGGVVAGYAFLNSVFLT

SEQ ID NO: 8628 - protein, 330 aa, Thermosynechococcus elongatus
MVNQEKTLDVGFTHADFAALLDRYDYHFNPGDIVAGTVFSIEPKGALIDIGAKTAAYIPIQEMSINRIESPEEVLQPNETREFFILADENEEGQLTLSIRRIEYMRAWERVRQLQAEDATVRSQVFATNRGGALVRIEGLRGFIPGSHISTRVNKEELVGEELPLKFLEVDEERNRLVLSHRRALVERKMNKLEVGEVVVGTVRGIKPYGAFIDIGGVSGLLHISEISHDHIDTPHSVFNVNDQVKVMIIDLDAERGRISLSTKQLEPEPGDMVKNPQLVYEKAEEMAERYRQQLLQQQQQAAGETPEEGMEDIPEATEDDSPAPILQEA

SEQ ID NO: 8629 - protein, 702 aa, Spiroplasma citri
MAKQVFKKIINNQELIVEHGQLAKQASGSVLVRYGDTVVLVTATVNNKLSEVDFFPLTVVFQEKLYSVGKIPGGFLKREGKPSEYGTLSARVIDRALRPLFSENFRNEVQIVINVLAVDNDNDVRMVSLFAASLALSISKIPFAGPVAGALVTVDQKNNIIINPTLEQINDGQMELIVAGTDEAINMVEAGAKEVSENLMLQAILAGHDVIQQLIAFQHEIIAKVGVPKMEVELFQVRPEIITYVNNNYAKDLITAARIKEKTKRYETIEHLIEQAIKNYPMPVSLSEKEQKQLTVELKTALHNIIRQEVRRQILIDKTRLDGRKLDQIRPLSSEIDILPVVHGSALFTRGETQVLSVVTLGALGENQIIDGITDEESKRFMHHYNFPAFSVGETGRMGPPSRREIGHGALGEKVLLQIIPSEKVFPYTIRIVSEVLESNGSTSQASICAATLALMAAGVPITAPVVGIAMGLIKEKNNYTILTDIQGMEDHLGDMDFKVAGTATGICALQMDIKIVGINKAILQEALKAAKKARLTILDNVLATISAPRTHLAPTAPKMKTFMIPVDKIREVIGPGGKMITAIIEKSDDVKIDIEDDGQVTIYHKETTAIEKAYQLIKAIAMPVVVGEKIIGPVVKIEKFGVFVHLKENLDGLIHISKLAKQHVEKAEDIVQLNDIVKVKVIEIDGKGKIKLQLIEILPKK

SEQ ID NO: 8630 - protein, 161 aa, Zea mays
SRTQRVPANAASTQFSEALAQAWSEFNIDSAVIMMIVQPEERNMYDQYWLSKHLQDSHGITTIRKTLSQVEAEGQENLIAGGQKVAVVYFRAGYTPNDYPSEAEWSARLMMEQSSAVKCPSISYHLVGTKKIQQELAKPNVLERFLKSEEEIEKVRKCFCW

SEQ ID NO: 8631 - protein, 254 aa, Vitis vinifera
MASSAPATALRTISSSSPKLHNTRSPFSSSLSPPKSSLSFTKVLSPALISTPKLQITSNPSSKTYITCRSQASPSESENLSRFMNFAFMRYSIRDRGSPAYLRLSQKSVNSLGDLVPFSNKIYTGDLEKRLGVTAGICVLIQNVPGKKGDRYEAIYSFYFGDYGHISVQGAYLTYEDTYLAITGGSGIFEGAYGQVKLQQIVFPFKLFYTFYLKGINELPADLLGKPVSPSPNVEPAPAAKACEPHACIANFTD

SEQ ID NO: 8632 - protein, 878 aa, Clostridium perfringens
MNYLEVKKDIYWVGSLDPELRVFDIIMYTPYGTTYNSYVVKGSEKIAVFETVKEKCFDDYLSKLNSLGIDPKSIDYIVVDHTEPDHAGSVEKLLELSPKAKVIGSMQAIEFLKDIVNKDFEYIVVGDNDTISLGNKTLQFISAPFLHWPDSMYTYIPEDKALITCDSFGSHYSCEEIFNDLVPNEEEYLDALRYYYDCIFGPYKPYVLKAIDKIKDLDIELVCPGHGPILRQDPWKIINTYKEWSTPVKPKINGDKKVTIPYVSAYGYTKELAEEIAKGIQSEHNVEVKLYDLTYSKQEDVLADIGESDGILFGSPTIVGELLPPIRILLANLNPIIHGGKYAAAFGSFGWSGEAVPRIEARLKELKMNIFGPGLRIKFKPSTTELKEAFEFGRDFSRTMFGEKELDYAPNNATETKEVLTGNGKTRYWKCLVCGEIFESPVCPEVCPVCGAGKEQFIEVEMDTFEKNDTDDNFVIIGNGAAGFYAAKTIREINSTASVKLLSSEEVSSYSRPNLSDLLNEEMNLDTFYLAKSSWYKENNIEELLGVTVTSIDKDAKKVILKDGTEIPYTKLILANGSHNFIPPFKVKNNNEEVTLNCENIHEFKGIYSIKDLKDTFDVKEEMKEAKKAVVIGAGPLGLEAAWEMKLAGLDVTVVEFLPNLMNNQLDQEGADIFRNQVSDCGITFITSEECAEIIAKDGKLTSLNLKSGKTLDADILLVSTGIRSNIELAKETGIECNRGVIVNERMETSIKDIYACGDVAEFNGLVYGNWPAAIEMGKTAGANACEAEKAFENFTPSIILDALNTHVFSAGLIRFNDSSYEKISSKDESKGQYTKLFFKDNILVGGIIVGDISKAGQIIIAIDNKLSKAAALSNDLL

SEQ ID NO: 8633 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNHTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNTTEQIENARQQYELQESDATWIKVLAAQMGVGGDDTWGAPVHDEFLLSSADSYQLSFMIEPLN

SEQ ID NO: 8634 - protein, 255 aa, Prochlorococcus marinus
MPGIVYLVGAGPGDPELLTLKALRLIKSCDVLVHDALISAEIIKETNKKAEIFNVGKRAGKCSVPQSDTNSLILKLAKEGKTVVRLKGGDPFVFSRGGEEVSFLEKNGISIEIVPGITSGIAAPTYYGIPLTHREAGSSITFVTGHEHINKDKKNVNWRALSQSSDGLVIYMGIRNIEFIVSELILGGLDKNTKCAVIQEATLNNQKCLISELKNLVENIRLKGFTSPSIVVIGRIVDFKVNNYITNLPNAFLTD

SEQ ID NO: 8635 - protein, 320 aa, Photobacterium profundum
MIKKIGVLTSGGDAPGMNAAVRGVVRAALSDGLEVYGIYDGYQGLHQNRIEKLSRTSVSDVINRGGTFLGSARFPEFKDEKVRAQAIQNLKMHGIEALVVIGGDGSYMGAKKLTEMGFPCIGIPGTIDNDVAGTDYTIGYFTALNTVIDAIDRLRDTSSSHQRISIVEVMGRHCGDLTLMSAIAGGCEYIITPETGLHKEELIAKIKEGIYKGKKHAIVALTELMTDANELAKYIEDETGRETRATVLGHIQRGGQPTAFDRILASRMGAYAVELLIQGEGGRCVGVQNEKMVHHDIIDAIENMKRPVRKDLYELADKLF

SEQ ID NO: 8636 - protein, 209 aa, Arabidopsis thaliana
MVDAKQVRFIIGVIGNVISFGLFAAPAKTFWRIFKKKSVEEFSYVPYVATVMNCMLWVFYGLPVVHKDSILVSTINGVGLVIELFYVGVYLMYCGHKKNHRRNILGFLALEVILVVAIILITLFALKGDFVKQTFVGVICDVFNIAMYGAPSLAIIKVVKTKSVEYMPFLLSLVCFVNAGIWTTYSLIFKIDYYVLVIMGLEPFWHFLS

SEQ ID NO: 8637 - protein, 166 aa, Solanum tuberosum
TPKVFVGYSIYKGKAALTVEPRSPEFSPLDSGAFKLSREGMVMLQFAPAAGVRQYDWSRKQVFSLSVTEIGSIISLGTKDSCEFFHDPNKGRSDEGRVRKVLKVEPLPDGSGHFFNLSVQNKLINLDENIYIPVTKAEFAVLVSAFNFVMPYLLGWHTAVNSFKPE

SEQ ID NO: 8638 - protein, 170 aa, Solanum tuberosum
TPKVFVGYSIYKGKAALTVEPRSPEFSPLDSGAFKLSREGMVMLQFAPAAGVRQYDWSRKQVFSLSVTEIGSIISLGTKDSCEFFHDPNKGRSDEGRVRKVLKVEPLPDGSGHFFNLSVQNKLINLDENIYIPVTKAEFAVLVSAFNFVMPYLLGWHTAVNSFKPEAELE

SEQ ID NO: 8639 - protein, 182 aa, Solanum tuberosum
TPKVFVGYSIYKGKAALTVEPRSPEFSPLDSGAFKLSREGMVMLQFAPAAGVRQYDWSRKQVFSLSVTEIGSIISLGTKDSCEFFHDPNKGRSDEGRVRKVLKVEPLPDGSGHFFNLSVQNKLINLDENIYIPVTKAEFAVLVSAFNFVMPYLLGWHTAVNSFKPESGAELEWNLEHHHHHH

SEQ ID NO: 8640 - protein, 643 aa, Zea mays
MMGGGLLVDQSVVFPGVHNFVDLLQQNGDKNLGFGSLMPQTSSGDQCVMGEGDLVDPPPDSFPDAGEDDSDDDVEDIEELERRMWRDRMKLKRLRELQQTGGKDSLASGVGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCEPPQRRFPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLRLNPGARPPASTGGIASAISFNTSSSEYDVDIIDECKGDEAGNQRTAVTDPTAFNLGAAILSDKFLVPTPMKEETADVEFIQKRNAPAAAEPELMLNNRVYTCNNVQCPRSDYSYGFLDRNARNSHQYTCKHKDPTPQSTENKPPSAPPQPQAFQPAFSQPNQALNSVDFSLPMDGQRSIAELMNMYDNNFVPNKNPSSDSVAVMERPNAMPQQRIQMDEGFFVQGNGAFDDVNSMMQQQQQQHQAPVQQQQQFFIRDDTPFVSQMGDIAASAPEFRFGHGFNMSSGVDYPGAAQRNDGTNWFY

SEQ ID NO: 8641 - protein, 421 aa, Herminiimonas arsenicoxydans
MDIKQYMKEVGQRARKASRAMAKADTAAKNQALSLIAAAIRRDADILRAANQVDLVAARLNGLEPAMLDRLTLSDKAIATMAEGLEQIVALPDPIGEISNMKYRPTGIQVGQMRVPLGVIGIIYEARPNVTVDAAGLCIKSGNATILRGGSEAIHCNQALAKLVSEGLAGAGLPADAVQIVETTDRAAVGELITMPEYVDVIVPRGGKGLIERLMKESKVPMIKHLDGICHVYIDDKADPAKALDIAFNAKCHRYGTCNTMETLLVARAIAPTILPALAKLYATRDVELRGDDEARAILQGYAHLAAASAEDWSTEYLDAILSVKIVADMDEAIDHINTYSSKHTDSIVTEDYTRAMRFLREVDSASVMINASTRFADGFEYGLGAEIGISNDKLHARGPVGLDGLTSLKYVVFGHGEVRE

SEQ ID NO: 8642 - protein, 255 aa, Oryza sativa
MSSSSTSGSAEPAAAVRVLGSWTSPFVMRVVVALKLKGVEEYELLQETRGKKSELLLRSNPVHKKIPVLLHHGKPLAESLIIVEYIDEVWPASDGAPAILPRDPYCRAVERFWAQYIDDKPDDFALILDNLCAVSSGDSRVERNRGRRGTVVEMSTALKHLEEAFVKCSQGKKYFGGDKIGYLDIALGSFLGWIKAVEKFAGVELLDEAKVPNLAAWADRFCAHPAVVDAMPDADKLVEFAVKHAASMKALDAPK

SEQ ID NO: 8643 - protein, 250 aa, Brassica juncea
MTKNYPTVSEVYQKVYEKCKRKLRGLIAEKNCAPIMVRLAWHSAGTFDCASRTGVPFGTMRFDGELAHGANSGLHIALRLLEPIREQFPTISFADFHQLAGVVAVEVTGGPDIPFHPGREDKPQPPPEGRLPDATKGCDHLRQVLLKQMVLTDQDIVALSGAHTLGRYRAAPSGFEGAWTSNPLIFDNSYFKELLTGEKEGLLQLVSDKALLDDPVFRPLVEKYAADEEAFFADYAEAHLKLSELGFADA

SEQ ID NO: 8644 - protein, 388 aa, Arabidopsis thaliana
MVLSVKQTLSPKIGLFRRNPSSSLGRSPVSLSFPSTELPKRTVLAVSKPLHLSSSLRAKSPVVRCEAYEADRSEPHPIGDDAAAAETKSEAAKKLKIGIYFATWWALNVVFNIYNKKVLNAYPYPWLTSTLSLAAGSLMMLISWAVGIVETPKTDFDFWKTLFPVAVAHTIGHVAATVSMSKVAVSFTHIIKSGEPAFSVLVSRFILGETFPTSVYLSLIPIIGGCALSALTELNFNMIGFMGAMISNLAFVFRNIFSKKGMKGKSVSGMNYYACLSMLSLLILTPFAIAVEGPQMWVDGWQTALATVGPQFVWWVVAQSVFYHLYNQVSYMSLDQISPLTFSVGNTMKRISVIVSSIIIFRTPVQPVNALGAAIAILGTFLYSQAKL

SEQ ID NO: 8645 - protein, 128 aa, Gibberella zeae
MAMQKRGIGRPAGHQSTGGKTILGGKRHRKILRDNIHGINTFADRIILAKPAIRRLARRGGVKRISAGIYEEIRTALKARLETILRNCVIYVEYRNAKTVTVQDVIHSLSRMGRPLWGFDLETYNPNK

SEQ ID NO: 8646 - protein, 323 aa, Arabidopsis thaliana
MDLLFCFRPNQTCRGISVLPAFSISNLSAVNRFRSTTSLRFGFPATPFRRTPNFTFKTHAKRKNKTSTFEPKPNKVEELIIEEEEEEEEEEEIVLPEEIQENQDELLLDDEYDEDDDDDFEFDESEEELYAGDGGGGGGIKLAGTLWDKVALALAVKVCESFDGDLGIYAFKTLPNSTIQVRIERLTNKFGSPTMEDIEAFSTIYRAKLAEAELAKSIPDNISLEVSSPGVERVVRIPQDLDRYKDRPMYVRYTNEDTETEGDGIFRLVSFDVEAKICIWGIADIRVNREKAGKGRPLSKKQREWRLETAFESLRLVRLHSEC

SEQ ID NO: 8647 - protein, 560 aa, Ostreococcus tauri
MADACADALAAVTLRAHAYSRVTGRTSIEDVLRTPAATLVGKTIVVGGWVKTGREAERGTLLFIALNDGSGPGNLQCVVRSETYALSDLKTTGTSVVLEGELREPPESATGQTIELHATRVLMCGTCDGATYPIAKKKQTLEYLREKIHLRPRTNTIASVARVRSALAFATHSFFNQNGFLYVHTPCITQSDCEGAGEMFQVTTMLSSAEKPEALEAAVKPEELEAKRGEVSASGAGIKAMKESGADSKDVKKAVKAMDTLKQELAQMEHASRKIGGLQRTEDGSIDYSEDFFGGKSFLTVSGQLQVETYACALSNVYTFGPTFRAENSNTTRHLAEFWMIEPELAFADLQDDMQCAEDYVKFCCNYLLEHCLGDLEFFAKMYDSTCIDRVRQIATTPFGRVSYTEAIELLEKAVADGHEFVFPVSWGIDLATEHERWLAESHFKKPVIVYNYPKDIKAFYMRLNDDNKTVAAMDVLVPRVGELIGGSQREERLDVLERRMKESGLDPEDYSWYLDLRRFGTVTHSGFGLGFERLILLCTGMDNIRDVIPYPRWPNNCIS

SEQ ID NO: 8648 - protein, 147 aa, Agrobacterium tumefaciens
MSFDYITRLRAKIGHQLLLLPAVAAVIRDDEGRILFQEKASGEGWSLPAGGIEPGESPEEAIRREVLEETGLMVQDTELLGVFGGKNYRYTYSNGDEVEYTVVLFECTASGEAGTGHDPETRRLKFLSRDEMPRLALPYPMDVLFRS

SEQ ID NO: 8649 - protein, 1893 aa, Staphylococcus saprophyticus
MNFKGVKLLKNSKKRLDFLPNTLNKYSIRKFTVGTASILVGATLFLGVSNEAEAAEKIDSPTKEKVATTEEAATKEEAATTEEPATKEEAATTEEPATKEEAAIAEEPATKEEAATTEEPATKEEAAIAEEPATKEEAATTEEPATKEEAATTEEPATKEEAAIAEEPATKEEAATTEEPATKEEAAIAEEPATKEEAVTSEEAATKEKAAIAEEPATKEEAAIAEEPETKEEAATTEEPATKEEAAIAEEAATKEKAVTSEEAATKEKAAIAEEAATKEKAAIAEEPETKEEAATTEEPETKEEAAIAEEPATKEKAVTSEEAHGINNKNKQLLDMDKNSTIDEKFDYAKQAINELNINQKDISNIEASIKNNSDLKNLSKEELNNEILRAALVNESNNNDYGLQTLSAIEPLTTNVRNKNNSLSPVSRLKMLATATSGQNVNDKINITNASLTLNQKNNQHDDNTVWPTSNEQLRLSADYELDNSIKEGDTFTIKYGDYIRPGALELPAKNTQLRSKEGSIVANGVYDENTTTTTYTFTNYVDQYQNITGSFNLLATPKRETVTTDKQTYPMNVTIANQEVSENFVVDYGNHEDHLTNAAVVNVDNVNNQHNEVVYLNQSGDRIYDAKYFSIVQNGTFIPNEVKVYEVLDDNVLVDSFNPDLNGPAVKDVTSEFTPQYSLNNTRVDIDLNRSNMNKGSRYIITQAVKPSGTGNVNTTYELTRYGNEASRYPTGTKSTTVSYINGSSTAQGDNPTYNLGDYVWLDKNKDGIQNDDEKGISGVYVILKDSNNKELQRATTDDTGRYQFNNLQNGTYNVEFVIPNNYTPSPSNTIDNDTIDSDGQKDGDSNVVVAKGTINNADNMTVDTGFYETPKYSLGDYVWKDTNKDGVQDSDEKGIQGVTVTLKDKNGNVLKTTTTDENGSYRFDNLDSGDYIVHFEKPEGLTQTTTNSDSDENKDADGEEVHVTITDHDDFSIDNGYFDEDSDADADSDADADSDADADADADSDADADADADSDADSDADADADSDADADADADADSDSDADADADADADSDADADADSDADADADADSDADADADSDADSDADADADSDADADADADADSDADADSDADADADADADSDADADADADSDADADSDSDADADADADSDADADADADSDADADADSDADADADSDADADADSDADSDADADADSDADADADADADSDADADADSDADADADADADSDADSDADSDADSDADADADSDADADADADADSDADADSDADADSDADADADADADSDADADSDADADSDADADSDADADADADSDADADADADSDADADADSDSDADADADADSDADADADADSDADADSDADADSDADADADADSDADADSDADADADADSDADADADSDADADADADSDADADSDADADADADADSDADADADADSDADADADADADADSDADADADSDADADADSDADSDADADADSDADADADADSDADADSDADADSDADADSDADADADADSDADADSDADADSDADADADADSDADADSDADADADSDADADADSDADADSDADADADADADSDADADSDADSDADADADSDSDADADADADSDADADADADSDADADSDADADADSDSDADADADADSDADADSDADADADADSDADADADSDADADADSDADADADSDADSDADADADSDADADADADSDADADSDADADADADSDADADSDADADADADSDADADSDADADSDADADSDADADSDADADSDADADADADSDADADSDADADADADSDADADADSDADADADSDADADADSDADADADSDADADADSDADKYHNDTADKSNDNELPDTGNNTQNNGTLFGSLFAALGGLFLVGSRRKNKNNEEK

SEQ ID NO: 8650 - protein, 380 aa, Spiroplasma citri
MVMGKRDYYEVLGVNRNATDDEIKRAFRQLAKKYHPDVSKEKDAEAKFKEINEAYEVLSVPNKRRNYDQFGHAGTDPNGFGGFSHGFSSTGDFEDIFSGGFGGFGDIFENFFGGGKKRRGFSNQPIKGENIAARVTLTLKEQMFGKKINLDLNIDKKCEMCDGTGAKDPKKDIHTCTTCDGYGYVNLEQRSLFGVIQSQQPCPDCKGRGKVITNKCSKCKGQGNYRGKETVEIDLPKSIYENQQLRIQEKGNYGLNNGRRGDIYLEISVKPNKYFKRVNDNLHLNLPVSYLDALLGAEVKVPTFDEDVYLKLPPNTKTNSIFNIPNHGFFKSPTSTKRGDLIVNVIVTIPTKLSPEEKTILQKLRNNSSFKITDDFYEDL

SEQ ID NO: 8651 - protein, 247 aa, Magnetospirillum magnetotacticum
MATGGKKSSGRTTGSGPGGGSRNLTVKVKTAKRRKLSSTLWLQRQLNDPYVHEAKRLGFRSRAAFKLIQLDERFHILKPGLRVVDLGAAPGGWTQVAVDKVGALRPKGGGKVVGMDILEWDPLPGAITLQGDFLADDAPDRLKEALGGPADVVLSDMAAPTTGHPSTDHLRIIGLVEVALHFALEVLTPGGTFVAKVFQGGTEKTLLDQLKRNFTTVRHAKPPASRQGSAETYVVATGFRGEGMNSP

SEQ ID NO: 8652 - protein, 916 aa, Oryza sativa
MAASVQPRQFGHLEPGSAPVRGAASSNGAKAYPPANGIPRRADSPVRGCGFPPLVSPPPRKPPSDGSDDEEEEQEDWRELYGSHLQLEVEPPVRDARNEGTADAWTERNPSLIRLTGKHPLNCEPPLAELMHHGFITPAALHYVANHGAVPRGDWSTWTVDVTGLVKRPMRLTMDELVNGFPAVEIPVTLVCAGNRRKEQNMVQQTVGFNWGAAGVSTSVWRGARLRDVLRRCGIMPSKGGALNVCFEGAEDLPGGGGSKYGTSITRQWALDPSRDIMLAYMQNGEPLLPDHGFPVRAIIPGCIGGRMVKWVKRIIVTTAESDNYYHYKDNRVLPSHVDAELANADAWWYKPEYIINELNVNSVITTPGYDEILPINGITTQRGYTMKGYAYSGGGKRITRVEVTLDGGETWLVCVLDLPEKPTKYGKHWCWRFWPVEVEVFDLLGAKEIAARAWDQSHNTQPEKLIWNLMGMMNNCWFKVKVNVCRPHKGEIGLVFEHPTQPGNQTGGWMARQKHLETAEAAAPGLKRSTSTPFMNTTDGKQFTMSEVRKHSSQDSAWIVVHGHVYDCTAFLKDHPGGADSILINAGTDCTEEFDAIHSDKAKALLDTYRIGELITTGAGYSSDNSVHGASNLSQLAPIREAIKAPAPVALSSPRDKVPCQLVDKKELSRDVRLFRFALPSSDQVLGLPVGKHIFVCASIEGKLCMRAYTPTSMVDEVGHFDLLIKVYFKNEHPKFPDGGLMTQYLDSLPVGAYIDVKGPLGHVEYTGRGEFVINGKPRNARRLAMIAGGSGITPMYQVIQSVLRDQPEDTTEMHLVYANRTEDDILLRDELDRWAAEYPDRLKVWYVIDQVKRPEEGWKYGVGFVTEEVLREHVPEGGDDTLALACGPPPMIKFAVSPNLEKMKYDMANSFIVF

SEQ ID NO: 8653 - protein, 372 aa, Carboxydothermus hydrogenoformans
MREILKNVRRLVVKIGSSSLTHPETGKINLAAMERFVRECADLKNAGFEVIIVSSGAIAAGMGRLALPEKPKNLPEKQACAAVGQGVLMHLYEKFFSEYQVIAAQVLLTGEDLAVRKRFLNAKHTFSALLNYGVVPVVNENDTVAVEEIRFGDNDTLSARVAVLVEADLLVLLSDIDGLYTADPRKNSNARFLPEVLEINEEIEQLAGGSGTAVGTGGMETKIEAAKIAVNAGIPMVIARADYGNLRRILRGEEVGTFFYPKKKKQWKKQWLLSGARVQGSIIVDLGAEEALCSGGKSLLPSGVLGVEGEFPTGAIVAVKNLKGRVIAKGLTNYAAQDILKIKGLHSWEIADVLGHKDYDEIIHRDNLVLVD

SEQ ID NO: 8654 - protein, 424 aa, Thiomicrospira crunogena
MFEIAKQRLSDVFKHIDVEEEVITRLSVPKRSIKASIPVRMDDGSLRIFTGYRVQYDDTRGPTKGGIRYHPRVNEDEVTSLSFWMTVKCAVAGLPFGGAKGGITVNPKELSQLEIERLSRGYIRAFADVIGETRDIPAPDMYTNATIMGWMADEYSIISRQQVPGIITGKPVHLNGSEGRTQATGQGALFCLNEYARRQGWDIKNTTVAVQGFGNAGYHFARLAQQEGYRVIAVSDSSGGILTPSGLNIDDVKQYKDQTSELQAVYCDGSVCKVIEHEKLTNEELLELEIDVLVLAAMENQVTQENVDNIQAHTILEIANGPVSPQADEVLYAKNIQIIPDVLANAGGVTVSYFEWVQNRAGFYWEADEIRVKLSKIMKRESNTIYDLAIRYETSLRTAAYIHGIERLAGAINQRGNRKFFKKN

SEQ ID NO: 8655 - protein, 414 aa, Schizosaccharomyces pombe
MGQTLSEPVTEKHSVNGSNEFVLYGLSSMQGWRISMEDAHSAILSMECSAVKDPVDFFAVYDGHGGDKVAKWCGSNLPQILEKNPDFQKGDFVNALKSSFLNADKAILDDDQFHTDPSGCTATVVLRVGNKLYCANAGDSRTVLGSKGIAKPLSADHKPSNEAEKARICAAGGFVDFGRVNGNLALSRAIGDFEFTNSNLEPEKQIVTALPDVVVHEITDDDEFVVLACDGIWDCKTSQQVIEFVRRGIVAGTSLEKIAENLMDNCIASDTETTGLGCDNMTVCIVALLQENDKSAWYKKIADRVAANDGPCAPPEYAENHGPGWRSGDNNKKVIVPPNFHQVKLNGSDGYDKDANENSKEDDSTNGSLAAGFRWKEHFFPHKAEEENSSSETDIVNSNKDVADDHKEAVSAAD

SEQ ID NO: 8656 - protein, 99 aa, Glycine max
  misc_feature (49)..(49): Xaa can be any naturally occurring amino acid
  misc_feature (59)..(59): Xaa can be any naturally occurring amino acid
RRMPGPKMRMYYVPMNKKGMDNFPFYALLASRKKYNSVIDALDAEDILXSRTWCIPSNXDAIHLRVRAHAFHMLQINMMLSCAKADRIHTSMKIAFVLA

SEQ ID NO: 8657 - protein, 227 aa, Brassica napus
  misc_feature (70)..(70): Xaa can be any naturally occurring amino acid
  misc_feature (202)..(202): Xaa can be any naturally occurring amino acid
LKWFSSHLIKLVFVFSSLFFFTTIIVIFSYNQKYGVCTVNNSEDCGYNRPTFRRIVKKKSVEEYSPIPYXATLINCLVWVLYGLPMVHPDSTLVVTINGAGILIEVVFITIFFVFSGRPKQRLVIAAVLAGETLFVAILAVLVFTLQHTTTERTMSVGIVCCVFSVMMYASPLSVMKMVIRTKSVEFMPFWLSLAAFLNAGXWTVYALMPLDPFIAIPNGIGCIFGL

SEQ ID NO: 8658 - protein, 358 aa, Solanum pinnatisectum
MASTLTALANEKTLQTSFIRDEEERPKVAYDKFSDEIPVISLQGIDDINGSRRSEICEEIVNACEDWGVFQVVDHGVDAELLSQMTKLAKEFFELPPDEKLRFDMSGGKKGGFIVSSHLQGEVVQDWREIVTYFSYPIRARDYSRWPDKPQGWIAVTEKYSEKLMDLACKLLEVLSEAMGLEKEALTKACVDMDQKVVVNFYPKCPEPDLTLGLKRHTDPGTITLLLQDQVGGLQATKDNGKTWITVQPVEGAFVVNLGDHGHYLSNGRFKNADHQAVVNSNSSRLSIATFQNPAPDAKVYPLKIREGEKAIMDEPITFAEMYRRKMSKDLELARLKKQKKQTEEAQLESKPIEEILA

SEQ ID NO: 8659 - protein, 374 aa, Triticum aestivum
MAIPLVLVLLPLGLLFLLSGLVVNTVQAVLFLTIRPFSKRLYRQINVFLAELLWLQLIWLVDWWAGIKVQVYADPETWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAVSQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDKHIATGTFDEEIIPIGRPVKSLMVVLSWSCLLLYGAHRFLQWTQLLSTWKGVILFASGLAMVTAVMHVFIMFSQAERSSSAKAARDRVKKD

SEQ ID NO: 8660 - protein, 379 aa, Solanum lycopersicum
MDSNGTNAATSNNMEKPIQDPSQQQQQQPPPHLKCPRCDSSNTKFCYYNNYSLSQPRHFCKACKRYWTRGGTLRNVPVGGGCRKNKRIKRPSVNSSSSTTTTSHDIITTSTPNIVNPSHHHQLHHGVVHNNIDHLSTTNSQNHLNPLFYGLTHERSDLNIPFARLFNSRVSSHAGGVDPEGQVYSLTDNIPGLMDRRMGLGFSNSSGGVVNMGHENNNNNNNSSSSNYGHGGFNPIKQIQDVHVMSTSNCTTSTTSLLSSYPNMFGSSSSTSTMASLIASSLQQQKFMSNINGNSFHSLLTPNNYEELQMSRGENNNTNINNVHEGGGNGITMLKEEKMDLSNHQIHEQIINSSDPSLSWNGAWLDPSNMGSNSVPSLI

SEQ ID NO: 8661 - protein, 157 aa, Clostridium perfringens
MKKIILAGGCFWGVEEFLSRINGVVSTEVGYANGRTENPTYEDICTKNTYFAEVCLVNYDENIISLKELLAKFWTIIDPTSLNKQGNDVGSQYRTGIYYVDPSDLEEILNSKEELQKSYSKKIVTEVKPLENYYKAEEYHQKYLKKNPNGYCHIKLD

SEQ ID NO: 8662 - protein, 429 aa, Symbiobacterium thermophilum
MFCNQCEMTAHGTGCTKVGICGKDENIQALQENLIYALKGIAAYTYHARELGYTDPEIDAFFAEALYSTLTNVDFDLNHFLELNMRAGQMTLRAMTMLKKAHTDHFGEMVPTQVPTGTVAGPAVVVTGHNLKALYELLRQTEGTGINVYTHSEMLPAHGYPGLKRFPHLVGNLGAAWCDQKKLFAQFPGAIVGTSNCVQIPLDAYKDRIFTVGASRLPGVPHVENWDFSPVIARALSLPPCEEKPGEVTLTTGFADTNILPMADKILAGVKAGKIRHFFVVGGCDAPGSLGNYYRDFVRMTPPDTLVITLACGKFRFNDLDLGTIDGIPRLLDLGQCNDTISAIRIATALAEAFGCEVNDLPLSIVLSWMEQKAVAVLMCLLSLGIRGIYLGPKPPAWITPDVLRVLQEQFDLRLTTTPEADLKALLGR

SEQ ID NO: 8663 - protein, 171 aa, Solanum tuberosum
TPKVFVGYSIYKGKAALTVEPRSPEFSPLDSGAFKLSREGMVMLQFAPAAGVRQYDWSRKQVFSLSVTEIGSIISLGTKDSCEFFHDPNKGRSDEGRVRKVLKVEPLPDGSGHFFNLSVQNKLINLDENIYIPVTKAEFAVLVSAFNFVMPYLLGWHTAVNSFKPEGAELE

SEQ ID NO: 8664 - protein, 248 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDVLTNEYENQQHRTTVSIGMDPELDQFMEAYCEMLTKYHEEL

SEQ ID NO: 8665 - protein, 424 aa, Unknown
  Dehalococcoides sp. BAV1
MEKALLEIEEKARLARAASRPLSYASSAQKDAALKNIARCLLDNGPAILEANLKDQNEAKASGMLPAMLDRLIIDQSRLEGIAKDTFAIAALPDPVGEIFDMNTMPNGLIIGKKRVPLGVIAAIYESRPNVTVDIASLCLKAGNAVILRGGKETIHSNTILAKLIRQAVEQAGLPKEAVQFIENTDRNLVNHLLKLSDQIDLVIPRGGAGLISYVKQNSFIPVVAGGIGVVHVYVDANAKVTDAVNIAYNSKVQRPTVCNAMDTLLVHKDIAPVFLPAVAAEWSKAGVEIRADEAALKILENTFGCKLIPATPDDWGKEFLALIAAVKVVDSLDEALSHIARYGSGHTESIVTQNYTSSQRFLNEVDAAAVMVNASTRFTDGSQFGLGAELGISTQKMHARGPMGLKEITSYKWIVYGSGQIRG

SEQ ID NO: 8666 - protein, 413 aa, Unknown
  Sphingomonas sp. KA1
MTLSTQCFVIVGGGQAGAWIARTLRAEGYDGRILLIAKEIHLPYERPPLSKDILSGKTEIASAALLTADSVATHQIEVWTGTVATEIDRDARIVRCADGRSVTYDHLFLTTGSRVRTLPFTQKGEGPKRVHVLRDLDDAQGLRTAMKSSRRIGVIGGGWIGLEVAATARQMGLDVIVLEAAPRLCGRSLPEEISAYLALMHKDHGTDVRTGAAVEKVTATADGVQVDVAGEALHFDHVVIGIGIVPETDLAAAAGLAVDNGILVDECGRTLDPHISAAGDVTSHPNAFMGGHVRMESWANAQNQAIVAAKAAIGAEAVHADIPWVWSDQYDANFQIIGMPERAATLHKRGNEADGKCCWLAVDAAGKAIGAVSLNMPRELRLVRKALEQDKTPDLDQWQSDKIRITEVALLPA

SEQ ID NO: 8667 - protein, 109 aa, Brassica napus
MASSMLSSAAVVTSPAQATMVAPFTGLKSSSAFPVTRKANNDITSIVSNGGRVSCMKVWPPVGKKKFERRLISVLKEMVRLQSEFLKPMRPRPKLLKKRLQYQQQEEEE

SEQ ID NO: 8668 - protein, 134 aa, Shigella flexneri
MSGALKSLNNIRTLRAQGRELPLEILEELLEKLSVVVEERRQEESSKEAELKARLEKIESLRQLMLEDGIDPEELLSPFSAKSGAPKKVREPRPAKYKYTDVNGETKTWTGQGRTPKALAEQLEAGKTLDDFLI

SEQ ID NO: 8669 - protein, 637 aa, Thermococcus litoralis
MQIITCPYCGAGCRAYVKKELSHPFIIEYVTDINVPNDRGKLCPKGNAMFEYLLSKERLKTPLKAIERGKFVKISWKEAINEIASFIRGYMKDDPNRLMFIAGGKVSNESAYLFQKLARNIGTNNVDNTSHLCHGVSVRAILDANFERNWATYDDIEESNVIILWGANLAETAPLIFRRVLKAKNRSAKIIVIDPRKTKTTKFASIHVRPFPGTDIVLINALINLLLKRRNIKSAHFKASDLEIISKNTPEYAERITGVPVRDIEEIAREIGLARRGIILWGSGIAMHSNGYDVIRSIITLASIVDFKVLPLAGQNNSQGVMDMGVVPNFLPGYRTYDNVYIFREAWKNEELPTEVGLDIPKSIKEAQKRNVSAFYVMGANIALSFPEAEKALRRAEFVIVQDIFPTQTTELADIVLPAAAFLESNGSTTNAERRIQWSSRVKWPPGDAKPDWAILCELGNALGLRGFDFYFPEEILREISTLVPQYANANPRTLMRTPEGVMWNIVPDSQPTKVYVSNKMPLLEPPVMITVRYVGQFQTGTMTKRSPPLNIRWQDLLILVSEEDAQKWGIKDGDRVKLVSENGKYIGTVKVSKTVIPGTIKAPWHEGVNRIMGLKIDEKTGLPQLKACSCKLERVE

SEQ ID NO: 8670 - protein, 736 aa, Clostridium thermocellum
MKKLIITVIVSAVLLTALIPQLPVFAADYNYGEALQKAIMFYEFQMSGKLPDNIRNNWRGDSCLGDGSDVGLDLTGGWFDAGDHVKFNLPMAYTATMLAWAVYEYKDALQKSGQLGYLMDQIKWASDYFIRCHPEKYVYYYQVGNGDMDHRWWVPAECIDVQAPRPSYKVDLSNPGSTVTAGTAAALAATALVFKDTDPAYAALCIRHAKELFDFAETTMSDKGYTAALNFYTSHSGWYDELSWAGAWIYLADGDETYLEKAEKYVDKWPIESQTTYIAYSWGHCWDDVHYGAALLLAKITNKSLYKEAIERHLDYWTVGFNGQRVRYTPKGLAHLTDWGVLRHATTTAFLACVYSDWSECPREKANIYIDFAKKQADYALGSSGRSYVVGFGVNPPQHPHHRTAHSSWCDSQKVPEYHRHVLYGALVGGPDASDAYVDDIGNYVTNEVACDYNAGFVGLLAKMYEKYGGNPIPNFMAIEEKTNEEIYVEATANSNNGVELKTYLYNKSGWPARVCDKLSFRYFMDLTEYVSAGYNPNDITVSIIYSAAPTAKISKPILYDASKNIYYCEIDLSGTKIFPGSNSDHQKETQFRIQPPAGAPWDNTNDFSYQGIKKNGEVVKEMPVYEDGILIFGVEPNGTGPATPTPKPSVNPSPSPTPTSDILYGDINLDGKINSSDVTLLKRYIVKSIDVFPTADPERSLIASDVNGDGRVNSTDYSYLKRYVLKIIPTIPGNS

SEQ ID NO: 8671 - protein, 193 aa, Zea mays
  misc_feature (48)..(48): Xaa can be any naturally occurring amino acid
  misc_feature (60)..(60): Xaa can be any naturally occurring amino acid
  misc_feature (73)..(73): Xaa can be any naturally occurring amino acid
  misc_feature (80)..(80): Xaa can be any naturally occurring amino acid
  misc_feature (90)..(90): Xaa can be any naturally occurring amino acid
  misc_feature (105)..(105): Xaa can be any naturally occurring amino acid
  misc_feature (124)..(124): Xaa can be any naturally occurring amino acid
  misc_feature (154)..(154): Xaa can be any naturally occurring amino acid
  misc_feature (164)..(164): Xaa can be any naturally occurring amino acid
IDYPLPLFVASVYADWLPHVPSPWAIRPARCYRQIINNPYPKSRYCTXVPDPWIRIYDSXVMNSKEADELPYXVHLVSCXKESASREALXAARIACCKYMSKSGXLDAFLLNSRCHPFRVLRIXYMLSCVGDDMLPHWNEVWLCLDSRLLRYVXIDQGLLSERXKDCNAVHGMQCLRSANVKFPVRHQIIVSG

SEQ ID NO: 8672 - protein, 318 aa, Hevea brasiliensis
MEFPVINLGKLNGEERAATMAKIKDACENWGFFELLNHGIEPEFMDTVERMTKGHYRKCMEQRFKEMVASKGLEGVQTEIKDMDWESTFFLRHLPESNIAQVPDLDDEYRKVMKDFAAKLEKLAEELLDLLCENLGLEKGYLKKAFYGSRGPNFGTKVSNYPPCPKPDLIKGLRAHTDAGGIILLFQDDKVSGLQLLKDGQWIDVPPMRHSIVINLGDQLEVITNGKYKSVEHRVVAQTDGTRMSIASFYNPGNDAVIYPAPALVEKEAEEKKQVYPKFVFEDYMKLYAGLKFQPKEPRFEAMKAVESNVNLGPIATA

SEQ ID NO: 8673 - protein, 445 aa, Armillariella tabescens
MHLLAFLSLSTFLCSAFAAVPEWGQCGGIGWTGQTTCVSGTVCAALNDYYSQCVPGTATTTAAPTTATSTTISSTSRTTATSTTASAPSSTGFVTTSGTEFRLNGAKFTIFGANSYWVGLMGYSTTDMNKAFADIAATGATVVRTWGFNEVTSPNGIYYQSWSGSTPTINTGSTGLQNFDAVVAAAAAHGLRLIVAITNNWSDYGGMDVYVNQIVGSGSAHDLFYTDCEVISTYMNYVKTFVSRYVNEPTILGWELANEPRCKGSTGTTSGSCTATTITKWAAAISAYIKSIDPNHLVGIGDEGFYNEPSAPTYPYQGSEGIDFDANLAISSIDFGTFHSYPISWGQTTDPQGWGTQWIADHATSMTAAGKPVILEEFGVTTNQATVYGAWYQEVVSSGLTGALIWQAGSYLSSGATPDDGYAIYPDDPVYSLETSYAVTLKARA

SEQ ID NO: 8674 - protein, 322 aa, Prochlorococcus marinus
MPIAADITALVGRTPIVRLNRLPQLSGCHAEVLAKLESFNPTASVKDRIAGAMIQAAEEAGTIAPGRTVLVEPTSGNTGIALAMVAAARGYRLILTMPDTMSTERRAMLRAYGAELQLTPGSDGMTGSIELAKELVATIPEAYLLQQFDNPANPQVHERTTAEEIWNDCEGRLDGLITGVGTGGTLTGCARLLKQRNPSLRVFAVEPALSPVLAGGSPAPHRIQGIGAGFIPSVLDLSLIDEILPVSDDDAMEMGRRLAREEGLLSGVSSGAAVAAALQVGSRAEMVGKRLVVVLASFGERYLSTPMFSAASAVPAQRDGYL

SEQ ID NO: 8675 - protein, 255 aa, Zea mays
  misc_feature (56)..(56): Xaa can be any naturally occurring amino acid
MEPSSQPQPAMGVAAGGSQVYPASAYPPAATVAPPAVASAGLQSVQPFPANPAHMXAQHQIVYQQAQQFHQQLQQQQQQQLQQFWVERMTEIEATADFRNHNLPLARIKKIMKADEDVRMISAEAPVVFAKACEIFILELTLRSWMHTEENKRRTLQKNDIAAAITRTDIYDFLVDIVPRDEMKDDGIGLPRPGLPPMGAPADAYPYYYMPQQQVPGPGMVYGAQQGHPVTYLWQDPQEQQEQAPEEQQSLHERD

SEQ ID NO: 8676 - protein, 408 aa, Arabidopsis thaliana
MATANPGRGGGRRGGGAMDDDKLVFETTDGIEPITSFNDMGIKEDVLRGVYEYGFEKPSAIQQRAVMPILQGRDVIAQAQSGTGKTSMIALSVCQVVDTSSREVQALILSPTRGLATQTEKTIQAIGLHANIQAHACIGGNSVGEDIRKLEHGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWKFDTLCDLYDTLTITQAVIFCNTKRKVDYLSEKMRSHNFTVSSMHGDMPQKERDAIMNEFRSGDSRVLITTDVWARGIDVQQVSLVINYDLPNNRELYIHRIGRSGRFGRKGVAINFVKSDDIKILRDIEQYYSTQIDEMPMNVADLI

SEQ ID NO: 8677 - protein, 478 aa, Arabidopsis thaliana
MESQKPIFDLEKLDDEFVQKLVYDALVWSSLHGLGVGDKTYQKSGNVPGVGLMHAPIALLPTGFPEAYWKQACDVTPLFNELIDRVSLDGKFLQDSLSRTKKVDVFTSRLLDIHSKMLERNKKEDIRLGLHRFDYMLDEETNSLLQIEMNTISCSFPALSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNIYGDDVRENLLRLQKEGEEGNAAYILMQRIFPKVSNMFLVREGVYHKHQAISELGVYGAYLRSKDKVIVNEQSGYLMRTKIASSDEGGVAAGFGVLDSIYLN

SEQ ID NO: 8678 - protein, 644 aa, Nitrosomonas europaea
MCGITGVFDTRSTSEIDRNLLHRMNETLTHRGPDEGEVYVESGLGLGHRRLSIMDVSSGQQPLFNEDGSVVVVFNGEIYNFQKLVGELTALGHRFRTHCDTEVIVHAWEEWGERCVERFSGMFAFGVWDRNRQTLFMARDRLGIKPFYYTLLDNGLFLFASELKALLVHPDFDKTFDHRAIEDYFAYGYIPEPKTIFKNAFKLNPGHLLSLQRGQQTVQSREYWDIPFTPHGSLSEEEAAEELILRLRNAVDSHLMSEVPLGAFLSGGVDSSAVVAMMGGLMKEPVNTCSIAFSDPAFDESDYARLVAERYQTRHFTEQVQQDDFDLIDRLAALYDEPFADSSAIPTYRVCELARKRVTVALSGDGGDENFAGYRRYRWHMIEERLRSKLPLGLRKPLFGLLGSVYPKADWAPKFLRAKTTFESLARDSVEGYFHSVSILDNKLRMQLFTRDFYRDLQGYRAVEVLRDYADKSPTKDALSLIQYLDMKTYLVGDILTKVDRASMAHSLEVRVPLLDHELVEWVSGLPASMKLRQQEGKYILKRSLEPYLPNEVLYRNKMGFSVPLASWFRGPLRERVRTALLGNTLAGTGIFDMGFIKKMLDQHQSGRRDYSAPIWTLLMFEAFLRNILSMGNMSYTGQDKKVA

SEQ ID NO: 8679 - protein, 958 aa, Pseudomonas aeruginosa
MSQTPSLAQLQPADAFLRRHLGPDPAEQQAMLAFLGVSTRAELIVQTVPPAIRLNRPLELPAALDEQAALARLRGYAGLNQRWTSLIGMGYYGTVTPSVILRNVLENPGWYTAYTPYQPEIAQGRLEALLNFQQLTIDLTGLDLASASLLDEATAAAEAMALARRVAKARSNRFFVDAHCHPQTVSVLRTRAEAFGFELVVDEPDNLAAHAVFGALLQYPDSRGEIRDLRPLIEALHGQQALACVASDLLALLLLTPPGELGADVVLGSAQRFGVPMGYGGPHAAFFATREGYKRAMPGRIIGVSRDARGNPALRMALQTREQHIRREKANSNICTAQVLLANIASLYAVYHGPQELKRIAQRVQRLTALLAAGLKSKGLRRLNRHFFDTLTYEVGERQAAILERARAARVNLRVVDDRRLALSLDETCDAATLATLFEIFLGAGHGLDVAHLDGGAVADGIPAVLQRTSAYLQHPVFNAHHSETEMLRYLRQLEGKDLALNQAMIPLGSCTMKLNASSEMIPITWPEFAELHPFVPREQAEGYRRMIDELEAWLRAITGFDAICMQPNSGAQGEYAGLLAIRRYHQSRGDSQRDICLIPASAHGTNPASAIMASMRVVIVECDPRGNVDLDDLRLKAAEAGDRLSCLMITYPSTHGVYEEGIGEICEVVHRHGGQVYMDGANLNAQVGLARPADIGADVSHMNLHKTFCIPHGGGGPGMGPIGVKRHLAPFVANHPVIRVEGPNPLNDAVSATPWGSASILPISWMYIAMMGPQLADASEVAILSANYLANRLDGAFPVLYRGRNERVAHECILDLRPLKAQTGITEEDVAKRLMDYGFHAPTMSFPVPGTLMVEPTESESKAELDRFVEAMLSIRAEIGKVESGAWPAEDNPLKRAPHTLADVTGIWQRPYEIAEAVTPSEHARAFKYWPAVNRVDNVYGDRNLFCACVPLDDYRE

SEQ ID NO: 8680 - protein, 335 aa, Unknown
  Fragaria x ananassa
MGVERVQDIASTISEDTIPAEYIRSENEQPGITTVPNTVLECPTIDFSDPDEEKLLKQIFEASTDWGMYQIVNHDISNEAISKLQAVGKEFFELPQEEKEVYAKDPNSKSVEGYGTFLQKELEGKKGWVDHLFHMIWPPSAINYRFWPKNPASYREANEEYAKNLHKVVEKLFKLLSLGLGLEAQELKKAVGGDDLVYLLKINYYPPCPRPDLALGVVAHTDMSALTILVPNEVQGLQACRDGQWYDVKYIPNALVIHIGDQMEIMSNGKYRAVLHRTTVSKDKTRISWPVFLEPPADQVIGPHPKLVDDKENPPKYKTKKYSEYVYNKLNKIPQ

SEQ ID NO: 8681 - protein, 239 aa, Oryza sativa
MAGSGDELMLLGKWPSPFVTRVELALGLKGLSYEYVKQDLVNKSELLLASNPVHKKIPVLIHNGKPVCESSIIVQYIDEAFPDAGASAALLPADPYERAVARFWVAYVDDKFVPAWVATFRGKTEEEKAEGMKQLLAAVETLEGALKDCSKGKPFFGGDTVGIVDVALGGLISWVKATEVLAGSKIFDEEKAPLLAAWAQRFGELDVAEKVLPDVDGVVEFAKMRLAEAAAAAAAASKN

SEQ ID NO: 8682 - protein, 570 aa, Chlamydia muridarum
MPKQADYTWGAKKNLDTIACLPEDVKQFKDLLYAMHGFTATEEEPTSEVQPGAILKGTVVDISKDFVVVDVGLKSEGVIPMSEFIDSSEGLSVGAEVEVYLDQTEDEEGKVVLSREKATRQRQWEYILAHCEEGSIVKGQITRKVKGGLIVDIGMEAFLPGSQIDNKKIKNLDDYVGKVCEFKILKINVDRRNVVVSRRELLEAERISKKAELIEQITIGERRKGIVKNITDFGVFLDLDGIDGLLHITDMTWKRIRHPSEMVELNQELEVIILSVDKEKGRVALGLKQKEHNPWEDIEKKYPPGKRVRGKIVKLLPYGAFIEIEEGIEGLIHVSEMSWVKNIVDPNEVVNKGDEVEVVVLSIQKDEGKISLGLKQTEHNPWDNIEEKYPIGLRVTAEIKNLTNYGAFVELEPGIEGLIHISDMSWIKKVSHPSELFKKGNTVEAVILSVDKESKKITLGVKQLTPNPWDEIEAMFPVGSDISGIVTKITAFGAFVELQNGIEGLIHVSKLSDKPFAKIEDILSIGDKVSAKVIKLDPDHKKVSLSIKEFLAHGGHAGQDAEEETSSNRD

SEQ ID NO: 8683 - protein, 233 aa, Oryza sativa
MAGGGDELKLLGMWASPFALRAKLALSFKGLSYEYVEEDLKNKSELLLSSNPVHKKVPVLIHNGKPVCESQVIVQYIDEAFPDAGVPLLPSDPYDRAVARFWAAYIDDKLLKSWLQASMCKTEQEKAAAMKETFAAVANLEAAFKECSKGKPFFGGDAVGYVDVTLGAVIGFVRVGEALHGMRLFDASRSPLLDAWLDRFAALDAAKAVLPDTGRLAEYAKMKQAEWAAAATN

SEQ ID NO: 8684 - protein, 457 aa, Cryptococcus neoformans
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGQ

SEQ ID NO: 8685 - protein, 352 aa, Unknown
  Mycobacterium sp. MCS
MNREALTPEKLREAYQHVWFVVARSQDISTPQSATLLDQNLVVFRDSTGAARVTDRRCIHRGANLADGKVVGDSIQCPYHGWQFDGSTGACSRIPSLPANGRIPPKAAIKAYPVIERFGHVWTCLGDPVFDLPDPPEIADLELEWRAAEPIHADCGFMAATENFRDMAHFPFVHEPSMGDVDPVVGDLDVKRDGREVWASYFYRQVPGSEFSDVGDAWMHYHSYAPGIATILYDFGPETGKRYLVDFPSPVSYDKCIIFWGVATDRDFRGGTVDEILETETMVFNEDTPVLEGLEPKEVPLAGQAFEVSAPADIYTLNYRRATQYAVQTIQQARGLVEAPLEQAGANGHVHA

SEQ ID NO: 8686 - protein, 108 aa, Unknown
  uncultured marine gamma proteobacterium EBAC31A08
MSNVIEIRDEESFNSDVLNSEKPVLVDFWAEWCGPCKQLAPTVETVAAEKSETLKVCKMDVDSNREIAAKYGIRSIPSLIIFKNGEPAGVEVGALTKQQLEDFISTVV

SEQ ID NO: 8687 - protein, 318 aa, Psychrobacter arcticus
MSATAPLNVNFITQITDLADCVGQTPLVKLQRLPEQEQIDNGAIMLAKLEGNNPAGSVKDRPAFNMIYQAERRGDIKPGDMLIEATSGNTGIALAMVAAMRGYPITLFMPSNSTQERKDAMTAYGATLIQVEEGIEAARDMALQMQADGKGIVLDQFNNPDNKQAHYLTTGPELWAQTEGKITHFISSMGTTGTITGVAQYLKEQNPAIQIIGLQPDEEAAIAGIRRWPAAYMPGIFDADLVDEIMDIDQRVAEVYMRKLAKTEGIFAGVSSGAAAWAATQVAKANPDAVIAFIVCDRGDRYLSTGLYNVDDSIDNAN

SEQ ID NO: 8688 - protein, 1135 aa, Psychrobacter arcticus
MAYKKRFDTSSAYGQLVILVFLPICLLAAVGGILVFYETMRASNSEQAVLAEAVLIRYSPTIAEIVPELLAQNDAKAQTTENNNESTTNSVLQAAMATLEGIQDKLGRMRAEQHVQRIAIVNQNNEVLATVGYGTDEAWPAVDPSERFLAQQPTPIGTAYGSILGEFDGQTLWLLVDMDSEPLYIARYRIAMALVITGLFTLLILLLSLNIYSKRWIAPIYELRLQLQRTHVDNLYQPIPVESNGELNLLQQDLVRTLRRLYVSFQELKEHAEQTEDDLRLAFDEMEMQNISIRNARDAAISTSQAKSAFLANISHELRTPLNSIDGFINLLARHGELNPEQDLYVQTIRKSSAHLLALVNDVLDFSKIEAGKLVLDRHEFDLYDTIYDVVDMLSPVSAEKGLRMAVLFYNDVPMRVNGDALRLKQVLTNIVGNAIKFTDSGDVVVRVSLDDYQDNYLMISVQDSGKGISLSDQKMLFQSFSQGDPSITRQYGGTGLGLVISKQLTRLMGGDIGFYDNMQENISNQGATFWFRMPAHVDVLEAATGQTIELPVLAPLASATDEFNVLIWINHTASIQVLKASLHHLPITLTQANSLPGLLESLKEHGNYWDWVIVDDDTQDDMMALLKQIRLHYQGKLAVFGYQVAADQALLNRYHANILYEPLDKRQLYAMLDTQKRSVPTGIAEPRWKGVTVLAVDDHLPNLLVLDALLSELGIHVITASNGFDAIEMISKQQTKNIKSAKTEKQSLSKKTQISKAVTRDDVSKSAVSALHIEDTTTEEKGKAQHKNSIDLIFMDIQMPRMSGHEAARQIRKIEAADSHIPIIALTAHGLADERDKLIASGINDYVGKPISQPQLLQVLQKWLGRSASSSPLTAENDEHSQSLSIASGAPPTYQMIRSEQVKSYKPTKMSNEKRVTRPLSLKKIRDDYLRDSQPREDYRRESRRDTQPRYESLRFQEQGQSVFGTRSIQTLDDNKDELLVNTAYLQKNSHLNASVFNTLDILNWQDALMRSANKPDLAAKLIIMMLDTINDEKQALTQAWEAHNRSMLAQIAHRILGGSRYTGVPQLRQASQDLEERCLLNIQHTTPAQFAMLEPYYEALLTALNNLQTLDLSAYPQLNYHRLSENDMTWKMI

SEQ ID NO: 8689 - protein, 744 aa, Cryptococcus neoformans
MSPPASQPPLWISLWMLFTTLIVSWALLNVVEIFLAIGYLYLQHISPRDKPLHAVAPLIGFVGTVMTASKTILYFLQEYFCGWCNVGHNDRRTFWMVWVIPNGTWIILPTIVSIVLGRYIAVALKRDAVYSPVSTSLLRAEFLAEKLASTLTEEPTQLPAALPLTFHPRTLSVLIVGSNRLAASRALTFLEADAKVFLLTSSEEVAKEVKELEEGGRVSLLQNTASDSVAWSELLTKHDISLACVTDTLISTPSRRSLASATIIYQTCLSLHIPVNISDQPHFSTYTFPSVHRFAGADGPSHLQVAVSTNGQGCRMSGRIKREIVSRLPADVGKAVDNVGKLRARAKARAKISEEDDGPLNTPVPQLPTPSISRRNSEEVTQQLSDEEQQLRRMRWVYQMSEYYSFEHLAKISNEEMDKALDIWGQRDEGYLPHHDVKTVNASEKKGRILLIGSGPGHPGLLTMAAHTALRTATLILSDKLVPAEILALIPDSTKLHIAKKFPGNAEGAQNEMMELALEGAQRGETVVRLKQGDPFVYGRGGEEVLYFRQHGFESTVIPGISSALAAPLMMGIPVTQRGVAESLVLCTGVGRQGKAVQLPGYVKSRTLVMLMGVARISQIIEVLTSTTATTATGRDGAAYPPHLPIAVIERASSPDQRVILSTLEKIQPALKQVDERPPGMMLVGWAALALEGKGRVDVLDRSEDDEFEMVESWLAEGQEGEIKGWKVREGLNDEWRGILNGII

SEQ ID NO: 8690 - protein, 607 aa, Mycoplasma pulmonis
MYKKIFIFLTPLLLLTQTITISCINKNEKNWGDKNFKKNIEKENLNNLTYVDKSLEAKNEAPFIEKQKSNVIYQLTVYSFADGNNDGIGDFIGLKNNIDYFVKLGINTLYLSPIHPASSYHGYDVIDYLDVAPELGGMEAFKEFLKVSHANGIKVVMDLVFNHSSFEHPWFQEALNGNTKYQNYYYFLDENISKDTQGLGIDSQDLRNQFKNLKNKQASNKKYVAHFWPGMPDLNLNNSDLIKELKAIQRYWSKIGVDGFRYDAFYHFFDSNNQHKPRENGNQKINSIFQKLRSTNKEAINDNTQRSSKEPFLFGEWWKSPFEANDYLDIKNQGLDSVIDGRNWKDNINVSINAKEQRALLEFLNKNNSTWMPFLDNHDVERWINKVRRQINKNVASVDKLSELEISLMKYALVSLLSRAGSPILYNGNELNLHGGPKQAGDHFVREAFPWKDRTKQVDFYELRSGKENSRIFLNLSKNEEKIEDAIKNENSTFNLVKQLNEIRNKYQYVVSQDPNTIADLEEILSESEIRKYQNNLNLRKNNQGEYLLYIFGWGNNDISFKIKNNFKIDQILLQKNININTQTREISSSGIGTYAVLKINKKSEAI

SEQ ID NO: 8691 - protein, 377 aa, Pisum sativum
MSHLAVSQMAVTVPVSSDFSVRRSAFKSSNLNFRDKSWAPVFTLGMKAKNCGWRNHNVICMSVQQASVPKVTVSPLELENPSEPPLNLHKPKEPYTATIVSVERLVGPKAPGETCHIVINHDGNVPYWEGQSYGVIPPGENPKKPGSPHNVRLYSIASTRYGDNFDGKTASLCVRRAVYYDPVTGKEDPSKNGVCSNFLCDSKPGDKIKIAGPSGKIMLLPEDDPNATHIMIATGTGVAPYRGYLRRMFMESVPTFKFGGLAWLFLGVANVDSLLYDDEFTKYLKDYPDNFRYNRALSREEKNKNGGKMYVQDKIEEYSDEIFKLLDNGAHIYFCGLRGMMPGIQETLKRVAEKRGESWEEKLSQLKKNKQWHVEVY

SEQ ID NO: 8692 - protein, 544 aa, Mycoplasma pulmonis
MKTKISKWNEKIIYQIFPRSFYDSNNDGNGDLKGIINKLKYLKLLGINAIWLCPIYETDFVDAGYDVSNYKEVWKKFGTINDFKELVKEAKKYDIDIIMDIVLNHTSTNHVWFKKAIESENNPEHNYYIWTKNPKNEESIFGGSAWEYVPNLNKYYFHLFSKEQADLNWESNETISAMVDVVNYWYNLGVKGFRLDAIQHVHKELKDEQFSHSFSSKMVAFLQKFLNQVKKDKDDIFFIAEASGITPEKVLKYSKDEEKIADNFFNFSTWYVGWGKQTGRNGYDPNWTVDNLVNDNFIEYQNNDKIENLMITNFLSSHDTSRAISRWGNENLFWKESAKSLALFQFMQKGLQCILYGEEIGMLNSVFKTRDDFRDIDVYNSYQLFVDKNKVYTEEEMTRFHNINSRDHSRLPMIWNNKTNYGFNDGFKPWIQFGKYFKNASVEEQIEDQNSIFYFYKNLIEARNKYKNILVYGKSFFEFEKDKKLIKITRQDKDNNYIISLINLTPREIEINDQDLGEILLTTYTDKKEFKNILRPYESIMFLR

SEQ ID NO: 8693 - protein, 264 aa, Psychrobacter arcticus
MATKNPTKIEMRDLLQAGAHFGHQTRFWNPKMGPYIFGARNKIHIINLEHTVKAFNEALTYVNGLAAKKNKVLFVGTKRAASGVIAEQAARAGMPYVDHRWLGGMLTNWKTLRQSINRLKELEKQAEDGTFAKLTKREALERTRDMEKLERSLGGIKDMGGLPDAIFVVDVDHEAIAIKEAKNLGIPVIGIVDTNSNPDNVDYIIPANDDAIRAVTLYVTSMADAIIAGKEYAQTQAGGKAEQEAPATEEAADAQTEEAATPAE

SEQ ID NO: 8694 - protein, 706 aa, Oryza sativa
  misc_feature (47)..(47): Xaa can be any naturally occurring amino acid
MAKSSADDAELRRACAQAVAASGARGEEVSFSIRVAKGRGIFEKLGXRLAKPRVLALTVKQSTKGEAAKAFLRVLKYSSGAVLEPAKLYKLKHLTKVEVISNDPSGCTFVLGFDNLRSQSVAPPQWTMRNIDDRNRLLFSILTMCKEILSYLPKVVGIDFVELALWAKENTVTLDNQSSTQDGQEKSVTTQTERKVTVTVENDLVSQAKDEEEDMEALLDTYVMGIGEADAFSERLKQELVALEAANVYQLLQSEPLIDEVLQGLDAASATVDDMDEWLRIFNMKLAAGIRHEASIESRNNGLEMQSVNNKGLVEELEKLLDRLRIPQEFAASLTGGSFEESRMLKNVEACEWLTGAIRSLEVPNLDPCYVNMRAVREKRAELEKLKTTFVRRASEFLRNYFSSLVDFMISDKSYFSQRGQLKRPDHADLRYKCRTYARLLQHLKSLDKSCLGPLRKAYCHSLNLLLRREAREFANELRASTKAPKNPAVWLEGSNSGGQNGSSADTSTVSDAYSKMLTIFIPLLVDESSFFAHFMCFEVPALVPAGAPNAKSRSGGNDPDDDLNLMDPDGNDLKPDDTSAELGTLNDALQELLDGIQEDFYAVVDWAYKIDPLRCISMHGITERYLSGQKADAAGFVRRLLHDLESRISTQFSRFIDEACHQIERNERNVRQTGILAYIPRFAVLASRMEQYIQGQSRDLLDKAY

SEQ ID NO: 8695 - protein, 524 aa, Capsicum annuum
MGNCCAVPKTSDTEEKKRGKNKPNPFSVDYAHGNGHKSYVLDNPTGCDIEATYELGRELGRGEFGVTYLSTDKATGDVYACKSISKKKLRTRVDIEDVRREVEIMKHLPKHPNIVTLKDTYEDDNAVHIVMELCEGGELFDRIVARGHYTERAAAAVTRTIVEVIQMCHKHGVMHRDLKPENFLFENKKETAPLKAIDFGLSVFFKPGERFNEIVGSPYYMAPEVLKRDYGPEVDVWSAGVILYILLCGVPPFWAETEQGVAQAIIRSVVNFKRDPWPKVSDNAKDLVKRMLNPDPSKRLTAQEVLDHPWIQNAKKNPNVSLGETVKARLKQFSMMNKLKKRALRVIAEHLTVDEVAGIKEGFQLMDIGNKGKIDINELRVGLQKLGHQIPESDVQILMDVGDVDKDGFLDYGEFVAISVHLRKMANEEHLKAAFEFFDKNQNGYIEIDELREALDDEIETNSEEVINAIMQDVDTDKDGRISYDEFSAMMKAGTDWRKASRQYSRERYNSLSLKLMKDGSLQS

SEQ ID NO: 8696 - protein, 382 aa, Candida albicans
MVAPALIYSNHELSTAIDSTHAFEGPEKLLEIWFYESKELSPINLRDIKFDTWIEILNLVHCEVLSKVSSNLCDAFLLSESSLFVFPHKIILKTCGTTTTLACLDLLFETVNKELLQNEGLKATFQSKNIYQIFYSRRSFMFPDRQIHVHGNWQEEVKLLNQYFNNGKSYIVGNNTNWHLYVGGNGKTKNPVASTTTTTTTPVVNDCTLEIIMTQLSLEASQQFYTTRKPGDTAIDSNHDLGHDLGQEILKQTGLNELFKFKKQPTMPGLSSSPIKEIHDGFAFTPCGFSSNSINESNYYTIHVTPEPGWSYASFETNMIGDYKAIVDKCINVFQPGQFMVTFLTNTDMEKFECCLDDYKVNHREELDVEDYKLYFVEFVRQ

SEQ ID NO: 8697 - protein, 516 aa, Bacteroides fragilis
MLDSAIKEQLRTIFAALEANYTFDITVSPQHESRTELLELLNDVASCSEKLSCRINEGKGLEFTLLKGEHRTGITFRAVPNGHEFSSLLLAILNTDGKGKNFPDEGICNRVKSLKGPVRLTTYVSLTCTNCPDVVQALNAMTTLNGQIQHQTVDGAINQAEVEALKIQGVPSVFADGKLIHVGRGDFGELLAKLEEQYGTETNSAETSIKKYDVIVAGGGPAGSAAAIYSARKGLNVAVIAERIGGQVKETVGIENLISVPSTTGSQLADNLKTHMSQYPIDLLEHRQIEKIELDGKDKVLTAKGGERFSAPAVIVATGASWRKLNVPGEAEYIGRGVAFCPHCDGPFYKGKQVAVVGGGNSGIEAAIDLAGICSKVTVLEFMDELKADQVLQEKLKSLPNVEVLVHSQTTEVVGNGDKVTGIRVKDRKTEEERVISLDGIFVQIGLVANSGIFRDVVEVNRPGEIVIDAHCRTNVPGIYAAGDVSTVPYKQIIIAMGEGAKAALAAFEDRMRGEI

SEQ ID NO: 8698 - protein, 432 aa, Unknown
  marine gamma proteobacterium HTCC2080
MNQAASQPSNFLDDDVQSIQAFDPDLWKAMRSEAQRQEDHVELIASENYASPRVLEAQGSVLTNKYAEGYPGKRYYGGCEFVDVAEDLAIERAKTLFGAAYANVQPHSGSSANIAVYHALLEPGDTVMGMSLADGGHLTHGASVNFSGKIYNAVQYGINHDTGLIDYDALMELAKAHKPKLIIGGFSAYSRIMDWSKFREIADTVGAWLLVDMAHVAGLVAAGVYPSPMPYADVVTSTTHKTLRGPRSGIILAKDDEALHKKLNSAVFPGAQGGPLMHVIAAKAVAFKEAMEPDFADYQRQVVKNAQAMAATFIERGHKIVSGGTDNHLMLLDLIGKSYTGKDADAALGDAYITVNKNAVPNDPRSPFVTSGLRLGTPAITTRGFSEADTATLTHWICDVLAALETGTGDKVIPEVRQKVLEVCGRLPVYRR

SEQ ID NO: 8699 - protein, 199 aa, Bifidobacterium longum
MARTAHIVRETSESHIDLELNLDGTGKTDIDTSVPFYNHMMTALGKHSLIDLTIHAHGDTDIDVHHTVEDTAIVFGEALKQALGDKKGIRRFADATVPLDEALAKAVVDISGRPYCVCSGEPEGYEFCMIGGHFTGSLVRHVMESIAFHAGICLHMQVLAGRDPHHIAEAEFKALARALRFAVEIDPRVDGVPSTKGAL

SEQ ID NO: 8700 - protein, 510 aa, Arabidopsis thaliana
MATSDQDRRHRVTRNRPPIARPSTSSSRPVVSPPRSKVSKRVLLRVASVACGIQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTENDNRRTRVANGYFSLFMAVGNVLGYATGSYNGWYKIFTFTKTVACNVECANLKSAFYIDVVFIAITTILSVSAAHEVPLASLASEAHGQTSGTDEAFLSEIFGTFRYFPGNVWIILLVTALTWIGWFPFILFDTDWMGREIYGGEPNIGTSYSAGVSMGALGLMLNSVFLGITSVLMEKLCRKWGAGFVWGISNILMAICFLGMIITSFVASHLGYIGHEQPPASIVFAAVLIFTILGIPLAITYSVPYALISIRIESLGLGQGLSLGVLNLAIVIPQVIVSVGSGPWDQLFGGGNSPALAVGAATGFIGGIVAILALPRTRIQKPIPLP

SEQ ID NO: 8701 - protein, 382 aa, Acetabularia acetabulum
MNDMDFAALFNQHEGNNPDNLQPNAPPYMLSPQQNAAATMPKSHCSGDNTLMLSDMGEQVIMHPLYPDLVKAIMDCRKVGGMDESRHHIQIRTEQVLEDLHRKREQYQITGRMPALDPELDQFLRQYIQVLDELHAELLNINREADNILHMFTTQIAEVINMPMDPRSMHARNAFNAQSNIDMTWFEIRNEQEQRVLLKQKYRQELLALKEEFSKRKKRGKLPTHSIEVLKSWWKEHIAWPYPTDSAKRSLASQTNLTSIQINNWFINQRKRHWHKLFPEGVPNSQEEALRSLKARGMLGMDSSGPMRLMSMDIESQETQEVEQETEDIQTPNEFQFQSAFLNEHEQMMDEAGFTSRPNVQLPDAISQFQSQLGQIRKDSDE

SEQ ID NO: 8702 - protein, 130 aa, Debaryomyces hansenii
MAPKAEKKPASKAPAEKKPAAKKTASATGTKKRSKTRKETYSSYIYKVLKQTHPDTGISQKAMSIMNSFVNDIFERIAGEASKLAAYNKKSTISAREIQTAVRLILPGELAKHAVSEGTRAVTKYSSAAN

SEQ ID NO: 8703 - protein, 75 aa, Hordeum vulgare
LYPGGSYFDPLGLAADPEKKETLQLAEIKHARLAMVAFLGFAVQAAATGKGPLNNWATHLSDPLHTTIFDTFGSS

SEQ ID NO: 8704 - protein, 458 aa, Prochlorococcus marinus
MPAENKELKTENLVIIGSGPAGYTAAIYAARANLQPLIITGFEKGGIPGGQLMTTTFVENFPGFPNGVQGPELMDLIKAQAVRWGTNLIEEDAISIDLSKRPFSIVTTTKKIKTNSLIISTGASANRLGLKNEKLFWSKGISACAICDGATPQFRDEELAVIGGGDSACEEAEYLTKYGSHVHLLVRSRKLRASAAMADRVEANPNITIHWETELLDVLGNDWLEKLKVKRKDTNQEYEILAKGLFYAIGHTPNTSLFTNQLNKDSKGYLITQPGRPETSLEGVYAAGDVADSEWRQGVTAAGSGCKAALAAERWLTKNNLATLIKRIELEPSKAEKAKTLEISNEANFDPDKTWQKGSYALRKLYHETEKPLFVVYTSSSCGPCHILKPQLLRVLNESKGKAIGVEIDIENDQDIAKQAEVSGTPTVHLFKNKELKKQWKGVKTRSAYKAALDELIN

SEQ ID NO: 8705 - protein, 189 aa, Leptospira interrogans
MKEGASFMYSKYFIWFMTLGIFLPLAGIFAKGSFYDFKVKDIKGNEVSLSKYKGKVVMVVNVASKCGYTYQYEHLEKVYKKYKDQGFAVVGFPANNFGGQEPGTDQEIETFCRIQKGASFDMMSKISVKGKDIHPLYFYLIQNSPNPGEVEWNFEKILISKSGTIEARYRSSVEPDSSAVTQKIETLLK

SEQ ID NO: 8706 - protein, 380 aa, Actinobacillus pleuropneumoniae
MAKKDYYEVLGLQKGASENDIKRAYKRLASKHHPDKNQGSKDAEEKFKEINEAYEVLGDAEKRAAYDQYGHAAFEQGGGAGGFGGGFGGGGFGGFEDIFSEMFGGGFGGGGRRNHVVRGDDLRYDIEISLEEAVKGCKKDIRISTLAECDTCHGSGAEKGSKVETCSHCHGSGRIRRQQGFFVTEAVCPSCHGSGKKIEKPCKSCHGDGRVQKAKNLSVTIPAGVDTGNQLRLSGEGAAGENGAPAGDLYVVIHVREHDIFERDGSNLYCEVPISFTMAALGGEIEVPTLDGKLKLKIPAETQTGKLFRVRGKGVASPRGGYAGDLICKVVVETPVALNDEQKDLLRKLEESLAGKSKHRPQQESFLDSVKNFFSNLGKH

SEQ ID NO: 8707 - protein, 123 aa, Brassica napus
  misc_feature (11)..(11): Xaa can be any naturally occurring amino acid
  misc_feature (16)..(16): Xaa can be any naturally occurring amino acid
  misc_feature (21)..(21): Xaa can be any naturally occurring amino acid
  misc_feature (30)..(30): Xaa can be any naturally occurring amino acid
  misc_feature (33)..(34): Xaa can be any naturally occurring amino acid
  misc_feature (37)..(37): Xaa can be any naturally occurring amino acid
  misc_feature (60)..(60): Xaa can be any naturally occurring amino acid
  misc_feature (64)..(64): Xaa can be any naturally occurring amino acid
  misc_feature (66)..(67): Xaa can be any naturally occurring amino acid
  misc_feature (71)..(71): Xaa can be any naturally occurring amino acid
  misc_feature (73)..(74): Xaa can be any naturally occurring amino acid
  misc_feature (86)..(86): Xaa can be any naturally occurring amino acid
  misc_feature (89)..(89): Xaa can be any naturally occurring amino acid
  misc_feature (92)..(93): Xaa can be any naturally occurring amino acid
  misc_feature (97)..(98): Xaa can be any naturally occurring amino acid
  misc_feature (102)..(103): Xaa can be any naturally occurring amino acid
  misc_feature (110)..(111): Xaa can be any naturally occurring amino acid
  misc_feature (114)..(114): Xaa can be any naturally occurring amino acid
  misc_feature (117)..(117): Xaa can be any naturally occurring amino acid
  misc_feature (120)..(120): Xaa can be any naturally occurring amino acid
EKEEEYSMLSXAAVVXTSPAXATMVAPFTXLKXXSAXPVTRKANNDITSIGSNGGRVSCXKVWXPXXKKKXEXXSYLPDLTEVELXKEXDYXXRNKXXPCVXXQLEHGFXXREXGSXPGXYPE

SEQ ID NO: 8708 - protein, 325 aa, Tropheryma whipplei
MKEGGLRNKVAVIGSGSWGTAIANLLCKAGNETILWGRDENVIDEINNARVNSKYLPGVELFLRATCDLDYAVADASHVYIALPSFALSKVLPKLSLDKFSIVISLIKCLEPDTGRRMSEVISEALDLGHNRLAVISGPNLALEVANDEPSVSVVASANIATANIVAGTLKCPGFYCIPSSDIKGVEICAASKNLVALISGIARGMDLGDNTRAALITLGFRELLRLVLENGGTEETVFGVAGLGDVVATCNSHLSRNNKAGVLLAKGAPLDEVKQTAEGVVAISGVLALAERSGVYMPIAQALSQVISGKRTAHSLLDICFSLA

SEQ ID NO: 8709 - protein, 202 aa, Brassica napus
MGAFETEKTAKDAAALETQSSLEEFNQPSPLRKIISVSSIAAGVQFGWALQLSLLTPYVQLLGIPHKWSSLIWLCGPVSGMIVQPIVGFHSDRCTSRFGRRRPFIAAGAAMVAVAVFLIGYAADIGYKMGDKLEQTPRVRAIGIFALGFWILDVANNTLQGPCRAFLADLAAGDAKRTRVANAFFSFFMGVGNVLGYAAGLF

SEQ ID NO: 8710 - protein, 299 aa, Oryza sativa
MATAGDEQQQQAAAAQTAEVTEAAAKEVVSVEMPAPEGWTKKRGGRFEIVFVSPTGEEIKNKRQLSQYLKAHPGGPASSEFDWGTGDTPRRSARISEKVKAFDSPEGEKIPKRSRNSSGRKGKQEKKEATENEEAKDAEADKEAPSEDAPKETDVETKPAEEAKEAPSEDAPKDTDVEMKTAEDASKTADADTPAPAPAGTEKEDAKPAESEAAPPAPSEGGEKKEDAKPAEPEAAAAPPSNPTEPSAPKAAAAAPVENSADKGPHQDSQPPSAAAPAKESSPVNNGQLPAGASAVKCT

SEQ ID NO: 8711 - protein, 374 aa, Zea mays
MARLVSSGIIGKGHNIFDDGGFGEVHADPIKVERPHKRPPQKQNAENGTTTKVDEPKELPKHVCFKGDNGLYLSARMVEGYPYLQFASDDIGDPSVRFTTYNYMIDGKRVIRVKSDHFGKFWRRSPNWIWCDTDDTSTDNRDTLFEVVRVGDDADAVYGLRNLGNNHICHRLTYEGKESCLNASIPSVRKEAQLKIEEAVLLRKIYGVDYHLKDAKILNNKVRTLVTREAVNAGSMPSKNTLTLKYVVSNGKIWDASRSLRLGIKSSFQAGVPEVVTGSITLESEFDTSYIWGENTVNTEEFSTDYEVIVPPHTVITVRILATQGTCQVPFSYTQEDILTTGEKKVTKYDDGIFRGVNSFGFKSEVTERKINGE

SEQ ID NO: 8712 - protein, 177 aa, Hibiscus rosa-sinensis
ECALWMPTRTGLELQLSYTLRQQNPVGYTVPIHLPVINQVFSSNHAMKISPNFPVARIRPAGKYMAGEVVAVCVPLLHLSNFQINDWPELSTKQYALMVLMLPSDSARQWHVHELELVEEVADQVAVALSHAAILEESMRARDLLMEQNVALDLARREEEKAIHARNDFLAVMNHEM

SEQ ID NO: 8713 - protein, 178 aa, Solibacter usitatus
METITLGGGCFWCLEAVYVEMEGVQSVVSGYMGGHLADPDYRAVCTGSTGHIEVVQVTYDPAVTSTREILEVFFAIHDPTSLDRQGNDAGTQYRSAIFYHTQEQYEISQALIDELEREKIWSRPIVTEVRPAVKFYPAEDYHQNYFANNPQQPYCSFVVSPKVRKFREKFAAKMRKRA

SEQ ID NO: 8714 - protein, 375 aa, Nicotiana tabacum
MAHSALSQVSVAVPLQTDSSFRRSTFKATSITFSDRSSWISMPPIDLKAAPSRNQHIVCMSVQQASKAKVSVSPLSLEDAKEPPLNIYKPKEPYTATIVSVERLVGPKAPGETCHIVIDHDGNLPYWEGQSYGVIPPGENPKKPGNPHNVRLYLIASTRYGDSFDGKTASLCVRRAVYYDPETGKEDPSKNGVCSNFLCDSKPGDKVKITGPSGKIMLLPEEIPNATHIMIGTGTGVAPFRGYLRRMFMESVPTKFNGLAWLFLGVANTDSLLYDDEFTKYLNDYPGNFRYDRALSREQKNNKGGKMYVQDKIEEYSDEIFKLLDEGAHIYFCGLKGMMPGIQDTLKRVAERRGESWEQKLSQLKKNKQWHVEVY

SEQ ID NO: 8715 - protein, 80 aa, Adiantum capillus-veneris
MKKQNLIDMEGTVTESLPNATFRACLDNGCQVLTHISGRMRRSYIRILPGDRVRVELSPYDLTKGRIIYRLRSRHTNNSQ

SEQ ID NO: 8716 - protein, 369 aa, Arabidopsis thaliana
MSNAFSYMPTLYKKAGSMGSNFHYTIDLNEDQNHQPFFASLGSSLHHHLQQQQQQQQHFHHQASSNPSSLMSPSLSYFPFLINSRQDQVYVGYNNNTFHDVLDTHISQPLETKNFVSDGGSSSSDQMVPKKETRLKLTIKKKDNHQDQTDLPQSPIKDMTGTNSLKWISSKVRLMKKKKAIITTSDSSKQHTNNDQSSNLSNSERQNGYNNDCVIRICSDCNTTKTPLWRSGPRGPKSLCNACGIRQRKARRAAMATATATAVSGVSPPVMKKKMQNKNKISNGVYKILSPLPLKVNTCKRMITLEETALAEDLETQSNSTMLSSSDNIYFDDLALLLSKSSAYQQVFPQDEKEAAILLMALSHGMVHG

SEQ ID NO: 8717 - protein, 691 aa, Mycoplasma pulmonis
MLYQDNKWCFILENIITNMIYFRGIKKSFAQRIDYIDKNFATNAKLGIWKKDKNFIINFWQPFALSVDLIIYDKLDNDKVVEKINFVKKQKIWQVKIPLKFEDYYYHIKVQDENKKSKLVLDPYAKSLSVFNWEGKTNKTPKAAIIDWQKHFKNESFSDKNFDIKKDQNLVIYEMHIRDFSSLVDKKLENRKGTFKAAQECQIFSYLKKLGITHIQLLPVQSIYTLDDSNLEIIEKGNGQKWSTNYNWGYDPLNYFSLAGWYFSKPEDPSNRIIEFRDFIEEAHKNGIAVIMDVVYNHMMTNMLMNNILKDYFFRENSQILPVDDFALNTESKMVRKLIIDSLVYFVEYFKVDGFRFDLSTFIDKKTLNLIFKKLKKINPNIILHGEAWEFSDLNYENSYTKGTNTNSKGFAYFNDTTRNAIKGSDDLDLIEKSYGLIQGNLDYFDHYLFSIVGNVKKYPLFQKSNLEKKNYHLFSKDYNMNLQYSACHDGFSLWDKIITTTNKSFSDSIKIYRQALMMQFSTQGKQLILAGTEFCHSKPTDFSGYDSARSLKILNSENNLVDKSNFWVNENSYKTSDYTNGLKWQNLNNDLVKKHVFNFLTRLIHFYKNSNFFKLDNNFEKVNFLKIKKGFVFYEIQHQEEKLFIAHNFSNENIYLKELENKKILFNSDFDDSNDKSDFWVLKNSSIIFQ

SEQ ID NO: 8718 - protein, 463 aa, Clostridium acetobutylicum
MENVLVKQLYRLSSEFGGKKVRLSGWVRTIRASKSFGFIEINDGSFFKNIQVVFDDKLDNFKEISKFIISSTITVEGEFVLTPNAKQPFEIHAENITLEGNSDNDYPLQKKRHTLEYLRSIAHLRPRSNTFSAVFRVRSLAAYAVHKFFQERDFVYVNTPLITASDAEGAGEMFQVTTLDLKNPPKNEEGNIDFSKDFFGKKANLTVSGQLSAETFALAFRNVYTFGPTFRAEESNTTRHAAEFWMIEPEMAFAELSDYLDTAEEMVKYIINFVMENAPEEMEFFNTRIDKGLFDRLHNVVNSEFGRITYTEAVDILEKSGEKFEYPVKWGIDLQTEHERYLTDKVFKKPLFVTDYPKDIKAFYMRINDDNKTVAAADLLVPGVGEIIGGSQREERLAVLEKRMEELNLNKEDYWWYLELRKYGETKHSGYGLGFERMIMYLTGISNIRDVIPFPRTTGSAEF

SEQ ID NO: 8719 - protein, 420 aa, Pyrococcus abyssi
MVEQDPFEIAVKQLERAAQYMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETIARRKTPAFGIITGKPLSIGGSLGRNEATARGASYTIREAAKVLGWDDLKGKTIAIQGYGNAGYYLAKIMSEDYGMKVVAVSDSKGGIYNPDGLNADEVLKWKREHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDAAYVVAVQRVYQAMLDRGWVKH

SEQ ID NO: 8720 - protein, 390 aa, Corynebacterium glutamicum
MSTNYEAIIIGAGQAGLAAAHELSRRGFTPGKDFLVLDSNDGPGGAWRHRWDSLTLGKAHGIADLPGLPMNRPDPKTPASTLVAGYYGAYENEFSFAVVRPVKVSRVEPTSEDPSSPLRVSSDDGREWITRMVLNATGTWTNPYVPYIPGIDKFQGKQLHTVNYRKAEDFKGKKVLVVGGGLSAVQFLLELEGLAETTWATRRPPNFTQREFDAGWGIAVERAVRERTFNGKAPASVVRTTGIPQIPDYLAGVDRGLIVSRGMFEEITPTGVVFGEPPAERSEGLGPSAGTTLAVPESWKPYPAGTHLDVDVIFWNTGFRAALRHLAPMKLRGQGRGIELIDEVSPASDARVLLVGYGSTASTVGATRAGRVAGRVAAKRLLVDVSPHVN

SEQ ID NO: 8721 - protein, 722 aa, Prochlorococcus marinus
MQGQTTTVSFDGREIRLTTGRYAPQAGGSVLIECGDTAVLVTATQSPGREGADFLPLICDYEERLYAAGRIPGSFMRREGRPPERATLISRLIDRPLRPLFPSWMRDDIQVVATCLSLDERVPSDVLAVTASSMATLLAEIPFYGPMAAVRVGLLGDDFVLNPSFREIERGDLDLVVAGTPDGVVMIEAGANQLSEQDVIEAVDFGYEAVTELIKAQQSILKESGIDHKKPDEQEIDETLPNYLDKNGRKPIGELLKKFELTKKERDLKLEEIKTNLGEKIDSLKEDNAVKKAISSNPKLLTTSFKSLTKKLMREQIIKDGKRVDGRALDEVRKIEAAAGILPKRVHGSGLFQRGLTQVLSTATLGTPSDAQEMDDLNPSSDKTYIHHYNFPPYSVGETRPMRTPGRREVGHGALAERALIPVLPPKESFPYVLRVVSEVLSSNGSTSMGSVCGSTIALLDAGVPLKAPVSGAAMGLIKEGKEIRILTDIQGIEDFLGDMDFKVAGTEKGITALQMDMKVTGLEVKTIADAINQAKPARTHILEKMNETIDKPRETLSPHAPRLLSFRIDPELIGTVIGPGGRTIKGITERTNTKIDIEDGGIVTIASHDGVAAEEAQKIIEGLTRKVHEGEIFTGSITRIIPIGAFVEILPGKEGMIHISQLSEARVEKVEDVVKVGDEVTVRVREIDNRGRINLTLRGVSQNNNDMNYPQPTPTPVAPLN

SEQ ID NO: 8722 - protein, 104 aa, Leptospira interrogans
MALAEVNDTNFKSETSGGLVLIDCWAEWCGPCRMVAPVLEELSGELDGLVKIKKLNVDDNQDTAQSLGISSIPTLLLYKDGQLVDKVIGALPKAQIKNFIERHK

SEQ ID NO: 8723 - protein, 468 aa, Chlorobium tepidum
MLTDDLQTAESSVSLTNGVAPSLEKLAAEQKSRKKWLLVQPKSQTSMMVDSGAVSMPLNLIMVATLASKYFDVTFLDERTGDTIPQDFSGYDVVAITSRTLNAKNAYRIGDRAKAQGKIVLIGGVHPTMLTDEASLHCTSVIYGEIESVWEELAIDIFRGKMKSVYKASNLKPMTTMTPPDFSFALNSPHAKKYSQLIPILATKGCPVGCSFCTTPTVYGKSFRYREIDLVLDEMRAHQERLGKKKVRFSFMDDNISFRPKYFMELLEGMAKLGVRWNANISMNFLQKPEVAELAGRSGCELMSIGFESLNPDILKSMNKGSNRLQNYEAVVSNLHKHKIAIQGYFIFGFDDDSEKSFQATYDFIMQNRIEFPVFSLLTPFPGTPYFEEMKDRVRHFDWDKYDTYHYMFEPKKLGGEKLLENFIKLQREVYKGSAIMKRMQGKPLNWVWFVNFLMNRFTRKLTPEMYL

SEQ ID NO: 8724 - protein, 314 aa, Corynebacterium diphtheriae
MTDTTAGTIHDVAIIGSGPAGYTAALYAARAELKPIVFEGIEYGGSLMTTTEVENFPGFPEGIMGPELMQNMREQAEKFGAELRMELVTKVELEGDIKKIWVDDQEFQARTVILATGSAPRYLGVEGEQTLLGRGVSACATCDGFFFRDHHIAVIGGGDSAMEEADFLTKFGSKVSIVHRRDEFRASAIMLERAKNNPKIEFVTNKTVSKVLGDTTVSGLELTDTVTGETSVLDATAMFVAIGHDPRSAMFRDVVTTDAAGYVVVEHPSTKTNVPGVFAVGDLVDNHYQQAITAAGSGCRGAIDAEHYLAALNS

SEQ ID NO: 8725 - protein, 107 aa, Corynebacterium diphtheriae
MSNAIALTQDTFKSIVIDSDKPVLVDFWAQWCGPCKKLGPIIDEIAEELGDEVLVAKVDVDAERNLGAMFQIMSIPTVLIFKDGQKVSEFVGVRPKSEIVAKLRSFL

SEQ ID NO: 8726 - protein, 557 aa, Thiomicrospira crunogena
MSELSFAELFEQSLQEDKFQTGSLIIGTVVGIDKETVLVDAGMKSESAIPKSQFEDANGELEVAVGDEVEVYLETLEDGFGETRLSREKAKRAKTWDRLETALEDSETVTGLVTGKVKGGLTVDVEGVRGFLPGSLVDVRPIRDFGFLEGKEVELKLVKLDRKRNNVVVSRRAVIEAENSVEREALLANMEEGSVLQGIVKNLTDYGAFIDLGGIDGLLHITDMAWRRVNHPSEVIQVGDEIEVKVLKFDREKNRVSLGMKQLQEDPWSDMVARYPIGSEIMGKVANITDYGAFIEIEDGIEGLVHTSELDWTNRNIHPSKVVHLGQEVKVKILDVDQERRRISLSIKQCTVNPWEAFSATHSKGDKISGSIKSITDFGIFIGLDGNIDGLVHLTDISWSQSGEEAVREFKKGDELETVILSIDPERERISLGLKQLEQDPFGEFVAENGKNSIVTGTVKSVDEKGAVIDLAEEVEGYLRASELDEDTRDASSVLKVGDSVEAKIVNVDRKNRNVSLSIKAKAMQDEANAVKDYSAKQPQAQNTLGDLLKGQLSSED

SEQ ID NO: 8727 - protein, 961 aa, Kineococcus radiotolerans
MTSPTPLRTELPEFAPEPAALPFSARHIGPDAAAVARMLQVVGLTSTEELVDRAVPAGIRDGVLDLPEALDETSVTAALRELAGRNRVVPSMIGLGYFGTRTPAVVRRNVLEDPSWYTAYTPYQPEISQGRLEALLNFQTAVTDLTGLDVANASLLDEGTAAAEAMTLARRTSKAPRGAVFAVDADVLPQTLAVLRTRAVPLGIDLVTVDLDTPDPLSVVGECGVFGVLLQYPGTSGRVRDLAAVVADAHARGALAITAADLLALTLLVAPGEFGADVAVGSSQRFGVPMGAGGPHAAYMAVRKGIERSLPGRLVGVSVDADGNTAYRLALQTREQHIRRDKATSNICTAQVLLAVMAGCYAVWHGPEGLRAIASQVARRAAGIAAALRAGGVEVVHDTFFDTVLARVPGRAGDVVAAALAAGVNLRLVDADHVGLTVDETTSEAHVAAALRGFGLDPVEATADPALPAALRRTSDFLTHPVFSRHRSETAMLRYLRRLSDADYALDRGAIPLGSCTMKLNATTELEPVSWPEFADLHPYAPADQLAGTAQLVADLEGWLAEVTGYDAVSLQPNAGSQGEFAGLLAIRAYHLAQGRGERTVCLIPSSAHGTNAASAVMAGLRVVVVTCDEGGNVDLDDLRAKVAEHADDLAALMVTYPSTHGVYEESIREVCGLVHDAGGQVYVDGANLNALVGLARPGKFGADVSHLNLHKTFCIPHGGGGPGVGPVAVREHLAPFLPSTAPGGDLDGRGVGMVSAAPFGSAGILPIPWAYLRLMGPDGLRAATVQAVLSANYVAARLADAFPVLYRGPGGLVAHECILDLRPMTKATGVTVDDVAKRLVDHGFHAPTMSFPVAGTLMVEPTESEDLAELDRFCDAMLAIAAEVREIADGRWAVEDSPLRHAPHTAASLVGEWNHPYTREEAVYPNGMDPRSKYWPPVRRIDGAAGDRNLVCSCPPLSEY

SEQ ID NO: 8728 - protein, 458 aa, Unknown
  Nocardioides sp. JS614
MVATATPGHDVSALHPELRPMYEKVVSRNPGEREFHQAVFEVMQSVGPIAEERSDYAQWSILQRICEPERQIIFRVPWVADDGKVEINRGFRVEFNSALGPFKGGLRFHPSVNLSIIKFLGFEQVFKNALTGMPIGGGKGGADFDPKGRSDGEVMRFCQSFMTELYRHVGEYTDVPAGDIGVGGREIGYLFGQYKRITNRYESGVITGKGLTWGGSQVRTEATGYGTVFFVEQMLQARGEHLEGKRVVVSGAGNVAIYAVEKAQALGAVVVAVSDSGGYVVDEAGIDLELLKEIKEVERGRLTEYVERRSGATHVTDGCIWDVPCDIALPCATQNELDESAAKTLAANGVTLVAEGANMPSTPAAVQLFQAAGVLFAPGKASNAGGVATSALEMQQNASRDSWHFDETEARLQEIMSEIHDTCLATSDHYGAPGNYVVGANLAGYVRVADAMVALGVI

SEQ ID NO: 8729 - protein, 426 aa, Halobacillus halophilus
MVADKPTDAANENNDKLDVLKSTQTVVKKALDKLGYPNEVYELLKEPVRMMTVRIPVRMDNDHIKIFTGYRSQHNDAVGPTKGGVRFHPNVSEKEVKALSIWMSLKAGIVDLPYGGGKGGIVCDPREMSFRELEGVSRGYVRAISQIVGPTKDIPAPDVFTNSQIMAWMMDEYSRIDEFNNPGFITGKPLVLGGSHGRETATAKGVTICIEEAAKKKGISVEGARVVVQGFGNAGSFLAKFMHDRGAKVIGISDAYGGLHDPDGLDIDYLLDRRDSFGTVTNLFKNTISNEELLELDCDILVPAAIENQIREENAHNIKASIVVEAANGPTTLDATRILSERGILLVPDVLASSGGVTVSYFEWVQNNQGYYWTEEEVEEKLHKVIVKGFDNVYKTAETRRVDMRLAAYMVGVRKMAEASRFRGWI

SEQ ID NO: 8730 - protein, 1343 aa, Debaryomyces hansenii
MYPRGPNQNQRPPESQRPAPLNQRPVAQSQRAPFQQQRNQFPPRNQASTSSHNGLEQQRRLVADKLIADCYSKRIIDRSGKPCVETSYQTHVSIKEYSSFPSRPPPDNLPPNQIGTVKDRVLVLCIKYSGRVLIQKGKYNENKDVYQIGRTWDMDELKTITKCGNDGIILTLNKDYYWSIEGGMERTWKFARFLTNAYGGFMGRYPTLNGFSIEDFKLSSSPQKKHLGNSSPSMGANDSGNDIVVNEPQPHPQLLKTKSLKRKNLPKPVLPPQPLPQQTYPDQGKQNDFYKDMDFTANGKLPSKPMKVMQVDRPSTSSLDQVENQNASTNRFNQSRELQETNEEFVDNYVTVDDNEPSNVPTTPKRDSKHPYQVNSPRRSADTTQDSQNFVFHADNTYSPEKLREYVKTNEERSTSPLRNYKPRRMSTEVEQRKVSEPLESAAALGIQLEEQLDGVTNKDISTDSAHSFQIPARNVSPDYSIEEVENDSDEEQETQHRASMSERKQVPIDQEESINQHQPPNAHVDNTINSSIQDIENYMDSQLYFAPGDESVDNSKQISQNQTLESDISQREISEGNIIPDLLQGNDLEFRSDQLEDETTSMQEYTEQSEVGLNIDNKDSEFQREKDAELEEIMDDVNWSISDNSDSLIRKLTKELNNVKFRNVKDLVTLDFGKDSVSNDVTTSISEIENLTHIFKKMEIDFKFLAPEVNLIENNSKGLQVKSVNKKLLYNDLSNILNKVSMHSDDLRAIESFKEFDRLNKLEAIEVKLIGLFNALETITLDYNENTDNLSSMRALRQYQSNYERVTSSFIRHFSRFIKDQFRLFSQQMMQNMDNIYPQAMFRELNNLLIYSGFLYFVKGVSLSDFQDINGNFNLMMSDLLERMITHKLKNLKFSSSSVSAHLSQSLDNDMPLKKSRTLRLSTRREKHISKANQEEFQGLKQNKDSNEIDDPKAVVDIINSTRDVIFVLQYVTGRLFHYDSNIIDFNEYCQNKPYQERRIALDNPSLDIEDDMNYSNDSISNLNAVFGGYINIFMKKVTPTELNIPLLLCYLQNLLDENKKSNQEFLCFNFLKKASDKFKIIWSKFIKSQLNLLNKSAIIAHCGILPAIKNVNQVLLITESSLDQPGRLFGSLDQSQVRAMLAESYKEISEATIHLFMRDDPLLKNHDFDDKEREHRNVSIIQNIFYLTEQLAVFSSPGITKMRTQLNSVFNKVLDSYFNKLLHKNIGKLVEFVDNYEALVKMNNGKPKKYNKKYVKSLLTGYTSKDVSVKAAEIHKKLEKHFITGGDMFEKDLFDKLWTDMEYQFIDYFSRLNNILKNDFDREIDYAITKQDIHSVFVSIH

SEQ ID NO: 8731 - protein, 121 aa, Oryza sativa
  misc_feature (3)..(3): Xaa can be any naturally occurring amino acid
  misc_feature (15)..(15): Xaa can be any naturally occurring amino acid
  misc_feature (17)..(17): Xaa can be any naturally occurring amino acid
  misc_feature (22)..(22): Xaa can be any naturally occurring amino acid
  misc_feature (26)..(26): Xaa can be any naturally occurring amino acid
  misc_feature (29)..(29): Xaa can be any naturally occurring amino acid
  misc_feature (46)..(46): Xaa can be any naturally occurring amino acid
  misc_feature (51)..(52): Xaa can be any naturally occurring amino acid
  misc_feature (64)..(65): Xaa can be any naturally occurring amino acid
  misc_feature (67)..(67): Xaa can be any naturally occurring amino acid
  misc_feature (70)..(70): Xaa can be any naturally occurring amino acid
  misc_feature (74)..(74): Xaa can be any naturally occurring amino acid
  misc_feature (76)..(76): Xaa can be any naturally occurring amino acid
  misc_feature (82)..(82): Xaa can be any naturally occurring amino acid
  misc_feature (85)..(85): Xaa can be any naturally occurring amino acid
  misc_feature (88)..(88): Xaa can be any naturally occurring amino acid
  misc_feature (91)..(91): Xaa can be any naturally occurring amino acid
  misc_feature (93)..(93): Xaa can be any naturally occurring amino acid
VEXLDLRAAKRLLLXFXRRLRXNLEXRMXHPDDPARFADSKIALHXETDRXXLLAGAPDLFPDXXPXGLXSSLXSXLTHDNXDLXADXAFXLXDLTDFDDTNRLQFLACGSKLTCQFFSRR

SEQ ID NO: 8732 - protein, 170 aa, Zea mays
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 8733 - protein, 371 aa, Unknown
  Azoarcus sp. EbN1
MRDKIRNARRIVVKVGSALVTNNGAGLDKAAMGDWARQIATLRGAGKQVVLVSSGAIAAGMQRLGWQKRPHEMHKLQAAAAVGQMGLVKAYEDAFSRHNLHTAQILLTHDDLADRKRYLNARSTLTTLLELGVVPIINENDTIVTDEIKFGDNDTLGALVANLIEAHALVILTDQQGLYTADPRRDPNATLVCEGRAEDRSYEAMAGGAGTGISRGGMITKIRAAQRAARSGAHTCIASGNEVDALIRLTQAEPLGTLLYATSSPLQARKQWLADHLQLAGDLILDDGAVVALRSGRSLLPVGVVEVGGEFERGAAVACRSAGGDEIARGLVNYSSSECRRIARKSSTQIEKLLGYIDEPELVHRDNMVLR

SEQ ID NO: 8734 - protein, 608 aa, Fulvimarina pelagi
MSETLERLQTQEKSEARKKAEAWFEDFEKALAAGDAEAAANMFAATSFWRDLVTFTWNIKTVENPAGVKDMLSATLDRVRPKNFQLSDEPTEDGGVTTAWFTFETDIARGEGLARLQDGKAWTFLTAMTELKGYEENRGTQRPLGAVHGHGSDQLNLRQRIDHEKETLGYEKQPHVVIVGGGQGGIALGARLRQLGVPTIILERRNRPGDSWRNRYKSLCLHDPVWYDHLPYLKFPENWPVFAPKDKIGDWLEFYTKVMELNYWEKSEATSAQYDGSKGEWVIEVNRDGKKLTLRPKELVFATGMSGKANLPKLPGQDTFKGEVQHSSQHPGPDAYKGKKVVVVGSNNSSFDICGALYEAGADVTMVQRSSTHIIRSEPLMEHGLGDLYSERAVESGVDTHTADMIFASLPYRILHEFQKPVYDKVKELDKAFYDGLEKAGFKLDWGDDGSGLFMKYLRRGSGYYIDIGAAQLIIDGKVKLASGQVKEFTETGIRLEDGTELPADLVVFATGYGSMNGWVEDLVDRETALKIGKVWGLGSDTTKDPGPWEGEQRNMWKPTQVEHLWMHGGNLHQSRHYSLYLALQLKARYEGIPTPVYGLQDVHHAGI

SEQ ID NO: 8735 - protein, 97 aa, Alocasia macrorrhizos
ATYKVKLVTPQGQQEFDCPDDVYILDQAEEEGIDLPYSCRAGSCSSCAGKVKQGEVDQSDGSFLDDEQMEQGWVLTCVAFPTSDVVIETHKEEELTA

SEQ ID NO: 8736 - protein, 185 aa, Unknown
  uncultured marine gamma proteobacterium EBAC31A08
MKHYINGLNLLEDYIQDNNKILFGAGCFWGVERKFWDIPGVNITTVGYAGGDTDNPSYEDVCYKNTNHAEVVEVVYDVNKISLKELLKVFWECHDPTQGMRQGNDKGTQYRSVIYCSSNEDLEISLKSKTQYQETLQANGYGDITTEIVLSPKYFLAEEYHQQYLAKNPNGYCGLGGTNCSFPND

SEQ ID NO: 8737 - protein, 98 aa, Alocasia macrorrhizos
ATYKVKLVTPSGQPLEFECPDDVYILDQAEEEGIDLPYSCRAGSCSSCAGKVKNGNVDQSDGSFLDDDQIGEGWVLTCVAYPTSDVVIETHKEEELTA

SEQ ID NO: 8738 - protein, 409 aa, Trifolium pratense
MGVCLSAQIKAESPYNTGLNSKNSNSAGNDLSSTNSKVSTGSVPQTPRSEGEILKSTNVKSYTLAELKSATRNFRPDSVLGEGGFGSVFKGWIDENSLAPAKPGTGIVIAVKRLNQESFQGHREWLAEVNYLGQFSHPHLVRLIGYCLEDEHRLLVYEFMPRGSLENHLFRRGSYFQPLSWSLRLKVALDAAKGLAFLHSSETKVIYRDFKTSNILLDSDYNAKLSDFGLAKDGPTGDKSHVSTRVMGTYGYAAPEYLATGHLTTKSDVYSYGVVLLEMLSGKRAVDKNRPSGQHSLVEWAKPYLANKRKVFSVLDSRLEGQYSSDESYRVATLALRCLSTESKYRPNMDEVVRILEQLKVPNVNVGNQRRYRRKSADDVTHARTHKKSCASARAHTSYPRPSASPLYA

SEQ ID NO: 8739 - protein, 853 aa, Oryza sativa
MASKGTEGGHGGVERKEQQQQRGYQLPRDSRGSLEVFNPSSASSFRTAAAAPKSASPFLAIPDREEDNVVAQQRAAEWGLVLQTDHHTGLPQGVSARPSSGSARTSSEDNPQQQQSAAAIPRVSEELRAALSVFQQTFVVSDATHPNHPIMYASAGFFNMTGYTSKEVVGRNCRFLQGSGTDPHEIDKIRQSLANGSNYCGRILNYKKDGTPFWNLLTIAPIKDEDGRLLKFIGMQVEVSKYTEGKKDTVVRPNGLSESLIKYDARQKDHARSSVSELLLALKNPRSLSESSNNTLKRKSQESLSMSMSEVPSKRSSESGSRRNSRSGTRSSLQKINEVPDQVNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRATVRKIRDAIDNQAEVTVQLINYTKSGKKFWNLFHLQPMRDQKGDVQYFIGVQLDGTEHVQDDAAKEGVVLVKKTADNIDEAAKELPDANLRPKDLWANHSKVVLPNPHMKDTASWRAIQKVLESGESIGLKHFRPVKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYAAEVVVALEYLHCQGIIYRDLKPENILLHRDGHISLTDFDLSCLTSCRPQEIITGAGHTSAVDWWALGILLYEMLYGYTPFRGKTRQRTFANILHKDIRFPASISVSLAARQLMYRLLHRDPANRLGSYEGANEIKGHPFFRGINWPLIRATVT

SEQ ID NO: 8740 - protein, 503 aa, Oryza sativa
MAAKWAMKKKLVGGDAGYVLEDVPHLTDYLPELPTYPNPLQDNPAYSVVKQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPGKHTGFLYIDKIRFTIPIENR

SEQ ID NO: 8741 - protein, 102 aa, Oryza sativa
  misc_feature (19)..(19): Xaa can be any naturally occurring amino acid
MALVEGNNSMSGGAGTFSXEQEALALKSWAIMKKDTDNIGLRFFLKIFKVAPSASQMFSFLRISNLPLQMNPKLKTHTMSVFVMTCEADAHLQKARNVTVRD

SEQ ID NO: 8742 - protein, 702 aa, Clostridium perfringens
MNHTHETIIAGRPMKVEFGKLGMLSDAAILMSYGDTVILTNVNASEKPREGIDFFPLSVEYEERLYSVGKIPGGFIKREGKPSEKAILNGRAIDRPLRPLFPKGYRNDVQVVCTVVSVENDNLPEILAINAASMALCLSSIPFTTPVAAVQVGLIGEEFILNPTSKEREESSLQLTVCATKERVMMIEAGGDEIPEDTMINAIKFGFDKCQDIIKFQEEAVSMFGKEKKVPELHKVPEEIEEAVREFAFDMISESMHITDRDERNAAMDEVKAKINEEFEEKYPDNMSDIGEAVYDMQKEVVRHMLLKEGKRPDGRAFDEVRNIGCEVGLLPRTHGTGLFTRGLTQVMTVATLGSISEIQILDGIGEEESKRYMHHYNFPAYSVGEVRPLRGPGRREIGHGALAERALEPLIPSEAKFPYTIRLVSEVLSSNGSTSQASVCGSTLALLDAGVPIKRPAAGIAMGLITSKDLTEEEVLTDIQGLEDFFGDMDFKVAGTEEGITSIQVDTKIKGLSEKVIHDAIYGARKARLMILDKIKECIPAPREEVSKYAPKTSTLQIDPEKIRDVIGAGGKVINKIIADTGVKIDIKEDGLVYVSSAESEGVKEAVKIIEGLTKEVKAGEIYLGKVTKIAQFGAFVEVLPNKEGLVHISKLDNKRVEKVEDVVSVGDEILVKVTEIDSQGRINLSRKDAIKEAEEENKQQ

SEQ ID NO: 8743 - protein, 246 aa, Unknown
  Burkholderia sp. 383
MAVTMRQMLEAGVHFGHQTRFWNPKMAPFIFGHRNKIHIINLEKTLPMFTDAQKYVRQLAANRGTILFVGTKRQSRDTIAQEAQRAGMPYVNARWLGGMMTNFKTLKVSIKRLKDMEAAVESGETEKMSKKEALLFEREIAKLQKSIGGVKDMGGIPDAIFVVDVGYHKIAVTEANKLGVPVIAVVDTNHSPEGVDYVIPGNDDSSKAVALYAEGVADAILEGRANAVNEVVQAARGDDEYVEENA

SEQ ID NO: 8744 - protein, 131 aa, Solanum lycopersicum
GTAVVARADGRLALGRLGALCEQLQELNSQGYEVILVTSGAVGVGRQQLRYRKLLNSSFLDLQKPQTELDGKACAAVGQNGLMALYDSLFSQLDVTSAQPLVTDNDFRDPDFRRQLNDTVNSLLSLKVIPI

SEQ ID NO: 8745 - protein, 458 aa, Halobacillus halophilus
MQKQQTIIEESLKALMEDESFLPDLQAQTREQAFKSLVALLSTPNHIHKSFLRVTLDDNTIVRIPAFRVQHSDTVGPYKGGVRFHESVNEGEVSNLAKLMTLKNALHELPFGGGKGGVVIKPKEYNIKELNLICKKYVQYFDDILGPDKDIPAPDVGTGEREMDWMMGEFKNIHPGEPYRNSFTGKSVVNGGSLGRREATGKGVYFTFRYMMHNFLNENRKWLSDTDNIFANTALNHHDQKLSMAIQGFGNLGSVAALEAYQCDYLQNKIVAVSDHNVMLYNNDGLDVPALIKFTEESDGDLPTTEEELEEHEIKAEIRERDELLEMDCDVLLLAALEDQIHEDNMERIQASMIIEGANGPITEDADRYLADKGVLIVPDILANAGGVIVSYYEWIQGREAQFMTEDQVFERLFDKMKYTMDTILPQFFGDPFPLRQNCYIHSVMKLSTIMYRQGKLY

SEQ ID NO: 8746 - protein, 266 aa, Corynebacterium glutamicum
MRIALLQISTNSDKMDNFALLRDAAEKAAEQGARVLVFPEATSQSFGTGRLDTQAEELDGEFSTAVRKLADELDVVIVAGMFTPADTVQRGEKTISRVNNTVLISGAGLHQGYNKIHTYDAFGYRESDTVKPGDELVVFEVDDIKFGVATCYDIRFPEQFKDLARNGAQIIVVPTSWQDGPGKLEQWEVLPRARALDSTCWIVACGQARLPEELRDERKGPTGIGHSMVTNPHGEVIASAGYEPEMLIADIDVSGLAKIREALPVL

SEQ ID NO: 8747 - protein, 906 aa, Arabidopsis thaliana
MASSFSSQAFFLLTLSMVLIPFSLAQAPMMAPSGSMSMPPMSSGGGSSVPPPVMSPMPMMTPPPMPMTPPPMPMTPPPMPMAPPPMPMASPPMMPMTPSTSPSPLTVPDMPSPPMPSGMESSPSPGPMPPAMAASPDSGAFNPIFSSFEMIIELVSLDRFLVFQRPQISICWWFVNMQIFGDTLTSSIHNFNKRTENLLMGSCSKLEFLPPADVYLESLKDPNLRKCLRLKSVRPISKTIPVSMKSSSSQSYDVFPNFRGEDVRHSLVSHLRKELDRKFINTFNDNRIERSRKITPELLLAIENSRISLVVFSKNYASSTWCLDELVKIQECYEKLDQMTGEFGMVFGETCKGRTENEKRKWMRALAEVAHLAGEDLRNWRSEAEMLENIAKDVSNKLFPPSNNFSDFVGIEAHIEALISMLRFDSKKARMIGICGPSETGKTTIGRALYSRLKSDFHHRAFVAYKRKIRSDYDQKLYWEEQFLSEILCQKDIKIEECGAVEQRLKHTKVLIVLDDVDDIELLKTLVGRIRWFGSESKIVVITQKRELLKAHNIAHVYEVGFPSEELAHQMFCRYAFGKNSPPHGFNELADEAAKIAGNRPKALKYVGSSFRRLDKEQWVKMLSEFRSNGNKLKISYDELDGKGQDYVACLTNGSTYGQCSNSQFQRNMDASPGGNKTSNQSTKDSPRASQVEKEKIEYCEPHVYITPAIFSDGTRAPKYVESRILSSNLELGFYINQSFNKWLFVLSSRRVTQVHHAKTWWPENCEKVYENHNNIYGIDRSIDGGDKFEGKSKVSDGGLDGKDQGIVCLLNGDHFKNLLGDSIHSPNILRLSNLGPKSIVSAAQVDEKNFEYCEQGVYITLGILSGGIIVLKHLEFRYNVKYILTYTIFFGCYPVFLNRSLHNLQ

SEQ ID NO: 8748 - protein, 568 aa, Oryza sativa
MMAAEGIIVQSFNADLLYEPWEVVDDEGQSFTMFAPFWNRCLSMPYDPAAPLLPPKRINSGDLSMCPSDDLIFEDDSEEGSNALLARAWSPGWQNRDKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDRANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 8749 - protein, 356 aa, Glycine max
MSLLSDLINLNLSDITDKVIAEYIWVGGSGMDMRSKARTLSGPVKDPSKLPKWNYDGSSTGQAPGQDSEVILYPQAIFKDPFRRGSNILVMCDAYTPAGEPIPTNKRNNAAKIFGHPDVAAEEPWYGLEQEYTLLQKDVQWPLGWPLGGFPGPQGPYYCGTGANKAFGRDIVDSHYKACIYAGINISGINGEVMPGQWEFQVGPSIGISAADELWVARYILERITEIAGVVLSFDPKPIQGDWNGAGAHTNYSTKSMRNDGGYEVIKKAIAKLEKRHKEHIAAYGEGNERRLTGRHETADMNTFVWGVANRGASIRVGRDTEKAGKGYFEDRRPASNMDPYVVTSMIAETTILWKP

SEQ ID NO: 8750 - protein, 143 aa, Triticum aestivum
  misc_feature (85)..(85): Xaa can be any naturally occurring amino acid
  misc_feature (102)..(102): Xaa can be any naturally occurring amino acid
  misc_feature (104)..(104): Xaa can be any naturally occurring amino acid
  misc_feature (129)..(130): Xaa can be any naturally occurring amino acid
  misc_feature (135)..(135): Xaa can be any naturally occurring amino acid
  misc_feature (137)..(138): Xaa can be any naturally occurring amino acid
  misc_feature (140)..(140): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKXWVPCLEVQQRSGFIFRXEXNALPGTKNGRYWDNVELPKFRVQRXXQVFNXVXXVXKDT

SEQ ID NO: 8751 - protein, 395 aa, Corynebacterium glutamicum
MNNSEWANKNYYADLGVSSSASEDEIKKAYRKLARENHPDKNPGDKAAEDRFKKAAEAYDVLGDDKKRKEYDELKALLASGGIRGGFGSGGAGFPGGFRTSTGGFDTSDLFGGGQGGGFSTDGGLGDIFGGLFNRGAGSHQSARPTRGADVQTEITLSFVEAAKGTTIPVELTGDAPCNTCHGSGSKSGHPAKCGTCDGTGFTSENKGAFGFSAPCATCGGTGEIITDPCDNCHGRGTVRKSRSITVRIPTGVEDGQKVRLAGQGEAGPNGKPAGDLFVKVHVKKDDVFTRDGSNILITIPVSFSELALGGAISVPTLNKPVKLKLPAGTPDGRTLRVRGRGIEARDSTGDLLVTVQVSVPKNLDDNAAEALRAYAEAETNSGFDPRANWAGQNR

SEQ ID NO: 8752 - protein, 154 aa, Triticum aestivum
  misc_feature (117)..(117): Xaa can be any naturally occurring amino acid
  misc_feature (126)..(126): Xaa can be any naturally occurring amino acid
  misc_feature (135)..(135): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWXLPMFGCTDXTQVINEVRXKKEYPEGVGPALSGFENME

SEQ ID NO: 8753 - protein, 115 aa, Arabidopsis thaliana
  misc_feature (28)..(28): Xaa can be any naturally occurring amino acid
  misc_feature (103)..(103): Xaa can be any naturally occurring amino acid
LLGTQLLLMGWVETRRWVDFFNPDSQSXVEWATPWSKTAENFANYTGDQGYPGGRFFDPLVLPGKNRDGVYDPDFEKLERLKLPEINHSRLAMVPMLIFYFEXGQGKTPLGALGL

SEQ ID NO: 8754 - protein, 142 aa, Thiobacillus denitrificans
MELACPHCLAVNRVPDERLAESPKCGKCGAVLLPAKPLDLTADSFDRFIARAGLPVLVDFWAEWCGPCKMMAPVFQQVAAEMATRVRFAKVDTEAEPQVSMRHHIKGIPSLILFRNGAEAARTSGAMDGHALKRWLAAQGIR

SEQ ID NO: 8755 - protein, 463 aa, Zea mays
MRPRLPPNVPSLPSSLSLLANSLSSPVTNTPTRPDSFPAYLQLAHLMVSQERQEPAVPSSSSSSAKRAATSMDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYTSAHADRFAAKLPWKETLSFGYHDGAASPVVVDYFVGTLGQDFEPMGWVYQRYCEEMKELSLTIMELLELSLGVELRGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRRARRSLAFFLCPREDRVVRPPASAAPRRYPDFTWADLMRFTQRHYRADTRTLDAFTRWLSHGPAQAAAPPCT

SEQ ID NO: 8756 - protein, 108 aa, Pseudomonas aeruginosa
MSEHIVNVTDASFEQDVLKADGPVLVDYWAEWCGPCKMIAPVLDEVARDYQGKLKVCKLNIDENQDTPPKYGVRGIPTLMLFKDGNVEATKVGALSKSQLAAFLDANI

SEQ ID NO: 8757 - protein, 149 aa, Oryza sativa
IAGIRVSQPQNPRRRARDSMAAFTSTTTAAAASPTPCRPVQAKKQTFSSFDELLEKSEKPVLVDFYATWCGPCQYMVPILQEVSEKLGDKIQVVKIDTEKYTSIANRYQIEALPTFIIFKNGKPCHRFEGALPANQLIQQIESALEVAK

SEQ ID NO: 8758 - protein, 482 aa, Thiomicrospira crunogena
MSKADIGLVGLAVMGQNLVLNMADHGYHVCVYNRSKEKTDDFIQNRVEDRPVSGASTLEELVGCLKAPRKVMLMVKAGDVVDSFIDQLVPLLDKGDMIIDGGNSLYTDSTRRTQALKEKGILFVGTGVSGGEEGARTGPSIMPGGNPDAWASVKPIFQDIAAKSDNAPCCDWVGPEGAGHYVKMVHNGIEYGDMQLITEAYQLMREGLGLSADECHQVFSDWNNGVLDSYLIEITADILSFKDKDGEPLVDKILDAAGQKGTGKWTGISSLELGMPLTLITESVYARCLSALKTERVAASKLYPRKKIVSKTNKDAMLQAIHDALYASKIISYAQGYMLMSEAAKEFDWELNYGGIALMWRGGCIIRSTFLAEIKKAYDESPNLSNLLRAPFFEDAIKNAEENWRKAVVFGVESQIPTPALSSALAFFDGYRSERLPANLLQAQRDYFGAHTYERVDAPRGEYFHTDWIQSGGNVSSSTYEV

SEQ ID NO: 8759 - protein, 555 aa, Haemophilus ducreyi
MSELSFAQLLEESFAATPRLGDVVKGTVVAIQKGYVIVDTGFKSESSIPAEEFINAQGELEVQIGDQVDVVLKAVEDGFGETVVSRGDAKRNEAWIALEKAFEEQATVIGFVNGKVKGGFTVELNGVRAFLPGSLVDTRPVRDSLNLEGKELEFKVIKLDQKRNNVVVSRRAVIESENSQDRDEVLANLVEGSVITGTVKNLTDYGAFVDLGGVDGLLHITDMAWKRVKHPSEVVAVGQEVTVKVLKFDKEKTRVSLGLKQLGQDPWAAIAHNHPVNSKLTGKVTNLTDYGCFVEILDGVEGLVHVSEMDWTNKNIHPSKVVSVGDVVEVMVLEVDEERRRISLGLKQCKANPWEHFAATHNKNDKVTGKIKSITDFGIFIGLEGGIDGLVHLSDISWNVTGEEAVRNYKKGDEVEAVVLQVDAAKERISLGIKQLESDPFTNFVDSTKKGAILTGKVVDVDTKGVKVELEGGVEAFIRANEATRERVEDITTVISVGDSIEAKYTGIDRKSRLVNLSVRAKDEAEESAALAQVNKQDVEMPNAMTAAFQAAKGE

SEQ ID NO: 8760 - protein, 476 aa, Bacillus anthracis
MQNKIIVMFQKDFRLYDNPALFEAAQSGEVVPVYVHDETFSMGSASKWWLHHAIIDVKKQLEALGSTLIIRKGSTQEEILSLVEQLGITAVYWNICYDPDRLQSNQKMKMMLEHKGMICKEFNSHLLLEPWVIKKKDNTEYKVFTPFYNAFQKQVIHKPISKVQSIKGGNSLPVSLSVSELHLLPTIPWTSHMESIWEPTEEGAYKTWKEFFSSKLASYSEGRDFPNQNAHSMLAPYLSFGQISVKLIYHYLINKSTESQCSLFEKQVNSFIRQLIWREFSYYLLYHYPFTAYKPLNKSFEHFPWNNEEELLRVWQKGDTGYPFIDAGMRELWQTGFMHNRTRMAVASFLVKHLLIPWQEGAKWFMDTLLDADIANNTMGWQWVAGSGADASPYFRIFNPITQGEKFDKNGEYIRKWVPELKDMPNKYIHKPWEAPEHILQKANIQLGHTYPLPVVDHKAARERALCAYKSMKEFV

SEQ ID NO: 8761 - protein, 309 aa, Arabidopsis thaliana
MASFVMGYFLLFAVAFMCLDARTDKTQDYTSFQYHKGALLTGDVSINLIWYGKFKPSQRAIVTDFVASLSSSRRSTMAQNPSVATWWKTVEKYYQFRKMTTTRGLSLSLGEQILDQGYSMGKSLTEKNLKDLAAKGGQSYAVNVVLTSADVTVQGFCMNRCGSHGTGSGSGKKGSRFAYIWVGNSETQCPGQCAWPFHAPVYGPQSPPLVAPNNDVGLDGMVINLASLMAATATNPFGDGYYQGPKTAPLEAGSACTGVYGKGSYPGYAGELLVDATTGGSYNVKGLNGRKYLLPALFDPKTDSCSTLF

SEQ ID NO: 8762 - protein, 485 aa, Unknown
  Taxus x media
MDALKQLEVSPSILFVTLAVMAGIILFFRSKRHSSVKLPPGNLGFPLVGETLQFVRSLGSSTPQQFIEERMSKFGDVFKTSIIGHPTVALCGPAGNRLVLSNENKLVQMSWPSSMMKLIGEDCLGGKTGEQHRIVRAALTRFLGPQALQNHFAKMSSGIQRHINEKWKGKDEATVLPLVKDLVFSVASRLFFGITEEHLQEQLHNLLEVILVGSFSVPLNIPGFSYHKAIQARATLADIMTSLIEKRRNELRAGTASENQDLLSVLLTFTDERGNSLADKEILDNFSMLLHGSYDSTNSPLTMLIKVLASHPESYEKVAQEQFGILSTKMEGEEIAWKDLKEMKYSWQVVQETLRMYPPIFGTFRKAITDIHYNGYTIPKGWKLLWTTYSTQTKEEYFKDADQFKPSRFEEEGKHVTPYTYLPFGGGMRVCPGWEFAKMETLLFLHHFVKAFSGLKAIDPNEKLSGKPLPPLPVNGLPIKLYSRS

SEQ ID NO: 8763 - protein, 368 aa, Desulfitobacterium hafniense
MKIKVSRIFLSVTMLIFLSIVGTGCSEAAVPAESSKRFPDNPNLGVSYEGKELQEIWMAGGCFWDVDAYLSRIYGVADVTVGYANGNSENPTYEDVCYRNSGHAETAYVRYDPERVDLETILEYFFKIIDPTSLNRQGNDVGTQYRTGIYYQNEADREIILKVITEEQSKYEKPMVTEVIPLAHFYEAEEYHQDYLVKNPDGYSHIDFSPLEEQKLVNIDPGPYNKPSDDLLRKTLTDLQYAVTQKDATERAFANDYWDHHEQGLYVDVVTGEPLFTSRDKFDSGTGWPSFTRPIASEVIIEKEDSTLGMKRIEVRSRAGDSHLGHLFNDGPPEDGGLRYCINSAALRFIPLSELQAEGYGQYLSRIE

SEQ ID NO: 8764 - protein, 553 aa, Magnaporthe grisea
MLGLPSKPSSGFRLITSSVIITNTRTSPPAMATSTKRKAAGVPALTQSETARLVETIKDWTIARGLSVRPPPSVVAANADPAGILATSVPVTLFPSPFPANCFEQAHDAQKPYNELYAKISQDEDFIRQMVEEVAGGDDFIAKLWETHCKVKEEGYSQQLSLGLFRSDYMVHQDLTDPNAVPQVRQVEFNTIASSFGGLSAQTSLLHQHLAFTEYPLLQDSRAAGSLNLPDNRSTRGLAAGIRAAFTAYGDSDLGHDRCVIFLTQDGERNVFDQRHLEYEVQRGSNSGDAVIPVFRLPFSQILKHTSIADGSKRQLLYRLPSNPARVFEVAVVYMRSGYGPGDYPDEEAWQGRLQLERSNAIKCPTVLTQLAGMKKVQQVLATPPSSPSPFKLGRFVPEKTPAWESLWGTFANIYPMDESEAGLEGRRLALDPELCIKHVLKPQREGGGNNHYKAAIPAFLASLPDKSHWNSYILMELITPPPVGNVILRNGEIEQGGVICELGVFGTCLWNNATGAMLRNEQEGYLLRTKGDQSEEGGVAAGFGCMDSVALV

SEQ ID NO: 8765 - protein, 137 aa, Unknown
  Mesorhizobium sp. BNC1
MARRQVALIAHDQKKDDLVAFAHDHQAWFAKCDLVATGTTGGRIAEACPDLQIRRLKSGPLGGDQQIGALIAERAIDLLIFFVDPLTPMPHDVDVKALMRLAIVYDIPMALNRATAENILALEEAAGPEPIVEQGGS

SEQ ID NO: 8766 - protein, 217 aa, Unknown
  Azoarcus sp. EbN1
MTTQDGGFVSRLSGRLASLLGLALIVAAAGAGHAVPATSPATAIFAGGCFWCMEPPFDRLDGVASTTSGYIGGHVPNPAYEAVSSGRTGHAEAVRIEYDPEKISYEQLLDVFWRNIDPTDPGGQFCDRGSQYRAQIFYQNDGQRAAAERSRAALVANKPFAQPVITEIVPATKFYPAEEYHQDYYLKNPLRYKFYRHRCGRDERLEFLWGVDDGEKK

SEQ ID NO: 8767 - protein, 488 aa, Burkholderia pseudomallei
MNEEILINITPQETRVALVQQGAVQELHVERTLSRGRVGNVYLGKVVRVLPGMQSAFIDIGLERAAFLHVADIWQPRAGDAPAAATHQPIEKIVFEGQTLMVQVIKDPIGTKGARLSTQISIAGRTLVYLPQEPHIGISQKIESEAEREAVRARLTAVIPSDEKGGYIVRTIAEDATSDELAADVAYLRKTWATIVAQGQRVPPTSLLYQDLDLAQRVLRDFANDDTTRIQVDSRETHQRLVEFAAEFTPAVSPKLHHYTGERPLFDLYNIEAEIQRALSRRVDLKSGGYLMIDQTEAMTTIDVNTGGYVGARNFDDTIFKTNLEAAHTIARQLRLRNLGGIIIIDFIDMENAEHRDAVLAELKKALSRDRTRVTVNTFSQLGLVEMTRKRTRESLAHVLCEPCPTCQGKGQVKTSRTVCYDILREILRESRQFNPREFRVIASQQVIDLFLDEESQHLAMLIDFIGKPVSLQVESNLSQEQYDIVLM

SEQ ID NO: 8768 - protein, 527 aa, Unknown
  Burkholderia sp. 383
MRDADNGIVTSLCGSDVMSGSDSSSSRPDLAQGIALDDLADGAMIEGHVGDAAVLLVRRADELFAVGAQCPHYGAPLADGLLEGDTIRCPWHHAAFCLRTGELLRAPALDGLPCWRVERRDGRAVVLDARPAAVPPALNAAGLPVSVVIVGGGAAAIAAAVTLRQEGYPHPVTLLTADADPPYDRPNLSKDYLAGTADADWLPLRAPSFYADHHIDVRCGTRVARIDPARQAVELADGSRVGYGALLLATGAEPNRLTVPGADLPHVCVLRSRADCDALIAKLKTARRCVVVGASFIGLEAAAALRTRGLDVQVVAPDAHPMARVLGDALGSTIQALHESHGVVFHLGATPAQITPDSVTLSTGDVLPADLVVVGIGVHPNVALAQDAGLAVERGVTVDRFLQTSAPGIYAAGDIARWPDPLTGERIRVEHWVVAERQGIVAARNMLGQQRPFDAVPFFWSQHYDLTVNYVGHAEQFDRVEIDGDLGAHDCTIAYWRGNTRLAVATIGRDLDSLKAEAAFEQQIAAA

SEQ ID NO: 8769 - protein, 178 aa, Arabidopsis thaliana
MPAVVFLNSWRRPLSIPLRSVKTFKPLAFFDLKGGKGMSEFHEVELKVRDYELDQFGVVNNAVYANYCQHGRHEFLESIGINCDEVARSGEALAISELTMKFLSPLRSGDKFVVKARISGTSAARIYFDHFIFKLPNQEPILEAKGIAVWLDNKYRPVRIPSSIRSKFVHFLRQDDAV

SEQ ID NO: 8770 - protein, 192 aa, Borrelia garinii
MYHLGDEYSQKAKREGYLARSVYKLIEINEKFSLFSSGNVLDIGASPGSFSQYAYKKLKRGVLVSVDINDISLRYVNNFYFIKGDIFSDDTASKINKFGPYSLVISDVAPKTTGNRLVDTSNSFNLNMRIIDLSFEVLLKKGNLLVKVFQGGDEMQIFKKFEKYFKFVKKIRPKAVRKNSFEIYFLGKSFGK

SEQ ID NO: 8771 - protein, 410 aa, Alkaliphilus metalliredigenes
MNFDTLKKFDEEIYEVIQKETKRQRGSIELIASENFVTTAVMEAMGSQLTNKYAEGYPDKRYYGGCEEVDVAENLARNRLKKLFNAEHANVQPHSGANANIGVYFATLEPGDTVLGMNLSHGGHLTHGSPVNISGAYYNFVAYGVDSVTHRIDYEEVMRVAQEAKPKMIVAGASAYPRAIDFKKFREIADAVGAYLMVDMAHIAGLVAVGLHQNPCEYADFVTTTTHKTLRGPRGGAILCKEKYAKIIDKAIFPGLQGGPLMHVIAAKAVAFKEALEPGFKAYQEQVIKNAKALGEELKKQGFDLVSDGTDTHLLLIDLRNKNITGKDAERLFDEVGITVNKNTIPFDPQSPFVTSGIRIGTPAVTTRGMKEEEMKKIAGVMNIIIDHPEKVSEAQKVVDELCNQFKLYE

SEQ ID NO: 8772 - protein, 179 aa, Dendrobium grex
LTLTKCCMQRGSHFRSRSGSQEARSGSSMSRCNSMDTKFCYYNNYNVNQPRHFCKNCQRYWTAGGSMRNVPVGAGRRKNKHTGSVYRHTVITPDSLASLQVDGPDLVDHKPLSPFKVNGTILKFGPDAPLCESMASILNLGEQNLSSQLDFTAGAENREETSCSSACKPVKKKDITQHN

SEQ ID NO: 8773 - protein, 328 aa, Thiobacillus denitrificans
MKLTVLGAGAWGTALAASWASQHAVTLWGRNARDVDTMRASRVNTHYLPGCPLPSSLALSADFDRALEAAELIVIAVPSSGLRATLAALARRPALPPILWVCKGFEPGTRRLPHQLVAELLPAGAETGVLSGPSFAQEVAHGYPTALTLASADIALAQRLAEALSGNRLRLYAHDDVVGVEIGGALKNVMAIAAGICDGLNFGHNARAALITRGLAEMTRLGVDSGGRFETFMGLSGLGDLILTTTGDLSRNRQVGLRVAKGQPLDRILDELGHVAEGVTTAREVAALAAERGVEMPIARMVCRILFEGLPASEAVDSLLNREIRSEF

SEQ ID NO: 8774 - protein, 284 aa, Arabidopsis thaliana
GRGSAGYDLNAFTFDPIKESIVSREMTRRYMTDMITYAETDVVVVGAGSAGLSAAYEISKNPNVQVAIIEQSVSPGGGAWLGGQLFSAMIVRKPAHLFLDEIGVAYDEQDTYVVVKHAALFTSTIMSKLLARPNVKLFNAVAAEDLIVKGNRVGGVVTNWALVAQNHHTQSCMDPNVMEAKIVVSSCGHDGPFGATGVKRLKSIGMIDHVPGMKALDMNTAEDAIVRLTREVVPGMIVTGMEVAEIDGAPRMGPTFGAMMISGQKAGQLALKALGLPNAIDGTL

SEQ ID NO: 8775 - protein, 598 aa, Unknown
  Magnetococcus sp. MC-1
MCGICGVMYFQPQTPQPAMLEKMVEKLHQRGPDGGGIEIDGQLGLGHRRLKVIDLSENGHQPMQDDALGLTIVFNGCIYNYQALRQSLLELGYSFFSTSDTEVILKAYHAWGWQCVQRFNGMFAFAIYERQSGRVVLARDRLGIKPLYIHQDKSHLRFASSIPSLLAGGGITTTLDPIALHHFLSFHSVVPAPRTLLQQVQKLPPATVRIVEKNGSETNHTYWNLQMGPQAGDAERTEAEWQQLLDQALRAAVSRRLVADVPVGLLLSGGLDSSLMAGLLVESGQLSRGGLSTFSIGFEQAGGEEGDEFQYSDIVAAHFGTDHHKIFIETNNLPELLRETVRAMSEPMVSHDAVGFYLLSREVAKHVKVVQSGQGADEVFAGYHWYPKVDAGQDAFQDYRKAFFDRSHEECCEMVHRDIAAAWQQDYSSAFVESWFAHPHSGTAAVDKALHLDQNIMLVDDPVKRVDNMTMAWGLEARVPFLDHELVELAARIPGHLKLQQGGKGILKEVARPIIPHAVIDRAKGYFPVPALKHMDGPVLKLAKEVLTSPRATQRGLIQPSYINRLLDHPTQHITPLHGSKLWQLTLLELWLQTHDIH

SEQ ID NO: 8776 - protein, 815 aa, Acidobacteria bacterium
MKPEPKVATVEFTGGKSLSFETGKLAKQAHGSAIVRSGQSVVLATACANADPREGIDFFPLTVDYREYTYAGGRFPGGFIKREGRPSEKEILTSRQIDRPIRPLFPEGFRCETQVIAMVLSADSENDPDVCGINGASAALAVSDIPFNGPIGAVRVGLIEGQNIVNPTYDEMRASKLNIMVVGTAEGIVMIESGAHEATEEEVVSAIEFGHGEIKKICAVISKLAKEVGKTKRTVAPVELDQPYLDGLRKKIGADLADALNTEKYPKSESYAKVKEIKSKLKEEIPADDDAALKKLGKYYELLREDIFRQQVTKEKRRPDGRAFDQIRQIWIEVDVLPRTHGSAVFTRGETQALVTTTLGTGDDMQRMEGFEGEAKKRFMLHYNFPPFSVGEVAFLRGAGRREIGHGALAERALSAVLPSEDKWPYAMRVVSDILESNGSSSMASICGGSLSLMDAGVPLKAPVAGIAMGLVKEGDDYAILTDIAGAEDHYGDMDFKVAGTTQGITALQMDIKIGGITAQIMREALEQARRGRLFILDKMNEVIQSPRTELSEFAPRFYTLQIPTDKIRDLIGPGGKVIRGIVEATGVKIDVEDSGKVNVASSDQEAAKKALKMIGDITATAEVGKTYLGTVTRLADFGAFVEILPGTDGLLHISEVAEHRIKDVKDELHEGDQVLVKVLAVDGNRIKLSRKAVLKEQRAKMATEGGGDGGPAPEVEHSEHGAPGGVTFEGGYEGGDEPEVEEGEPNFNRDDAPGSHGATQPHSGGDRPDRGPRPHGGGGGAGRGGRGRRPGGGGGGGRGGHGGRGGGGGGRGRG

SEQ ID NO: 8777 - protein, 200 aa, Yarrowia lipolytica
MVWPFSRFSSKPVDEKSPKISPKLQQPEGCEIATVAAGCFWGVEHVFRHKYEGKGLYDCRVGYSGGAKESPSYLKVCTGLTGHAEALQISFDPKQISYPELIELFFKMHNPTTLNRQGSDKGTQYRSAIFTHNDTQQKEAEAVKNKMEETFYKNPIVTEIEPISSFFDATENHQKYLNKNVNGYTCPTHFIRTLPEKHVA

SEQ ID NO: 8778 - protein, 415 aa, Pyrobaculum aerophilum
MQSESGFLAYVLAQLKRSVELGGFPEDFYAMISRPKRILHVYIPVKMDSGRIEVFEGYRVQHNDALGPFKGGIRFHPEVTLADDVALAILMTLKNSLAGLPYGGAKGAVRVDPKRLSQRELEELSRGYARAIAPLIGDLVDIPAPDVGTNSQIMAWMVDEYSKIAGRNAPAVFTSKPPELWGNPVREYATGFGVAVVAREMAKRLWDGIEGKTAAIHGAGNTGAWAAYWLEKMGVKIVAVSSTKGTVYNKAGIPAAEILRYYKREIPFEKIPGEFIKDPEASLNVEADLLVPAAIENVIRSDNAGQVKARLVVEGANGPTTPEAERVLYQRGVVVVPDILANAGGVIMSYLEWVENLQWLSWDEEETRKRLEAIMVNNVARVYQRWQKEKWTMRDAAIVTALERIYKAMKLRGWI

SEQ ID NO: 8779 - protein, 154 aa, Brassica napus
  misc_feature (36)..(36): Xaa can be any naturally occurring amino acid
  misc_feature (47)..(47): Xaa can be any naturally occurring amino acid
  misc_feature (88)..(88): Xaa can be any naturally occurring amino acid
  misc_feature (91)..(91): Xaa can be any naturally occurring amino acid
  misc_feature (152)..(152): Xaa can be any naturally occurring amino acid
EYKNCLKEEKKKRKQADGGVSCLRSSEMMRVGIGGXESPPLDLDEVXVLAVDDSLVDRIVIERLLRITSCKVTAVDSGWRALEFLGLXNEXASAELDRLKVDLIITDYCMPGMTGYELLKKIKESSSFRQVPVVIMSSENVLTRIDRCLEEXAE

SEQ ID NO: 8780 - protein, 227 aa, Oryza sativa
MAMAMSAVRGDFAADRAECADKLMALSTCLTFVQDGASGGAAAPTPDCCSGLKAVLAASRKCLCVLIKDRDDPNLGLKINVTKALSLPQLCNAPANISDCPRLLNLPPNSKDAQIFEQFAKQQAAMQGSPSASPGGSAANQISFGDLTPQAVDVNMSIKSKYNMGEQTFSHQGGSSAPAAGAQKSGAAVLRWLGVDGVGGGGARAVALLLFLLSSAVAVAAPLLLVF

SEQ ID NO: 8781 - protein, 578 aa, Debaryomyces hansenii
MLQNKEETISLGTYLFERIHQLKVQSIFGVPGDFNLTLLDKIDEVKNLTWRGNANELNAAYAADGYSRVRSTESSANGFACLVTTFGVGELSALNGIAGSYAEHVGLLHVVGIPATSAQDKQLLLHHTLGNGDFTVFRRMSSSITQTTGMVADAASGPQEIDRVIREAYINQRPSYLAFPTNMVELEVPKSALDTPIDLSIPDNDPETENEVLDRVTELISNSKNPIILVDACCARHGATGEARKLIDLTKFKFAVTPMAKGAKYIDEDHDRFAGVYVGTLSYPSVKEQVESSDLILSLGAMLSDFNTGSFSYSYQTKNVVEFHSDYTKIRSANYPNVRMKHVLQKLLESNKLKEAASKYEPVKVEKDPFPEEKRDELSKITQQWLWSKLSGWLRENDIVITETGTSSFGIIQTQFPKNTLGISQILWGSIGYTVGATCGAVMAAEEIDPNRRVILFVGDGSLQLTVQEISSMIKNKTKPYIFVLNNNGYTIEKLIHGETADYNSIQPWDHLKLLETFKAEDYESIRVSTVKELLDLFSDHKFAKNDKIRLIELMFDTMDSPQNLIEQARITAQTNSN

SEQ ID NO: 8782 - protein, 605 aa, Solanum lycopersicum
MATTTSHATNTWIKTKLSMPSSKEFGFASNSISLLKNQHNRQSLNINSSLQAPPILHFPKQSSNYQTPKNNTISHPKQENNNSSSSSTSKWNLVQKAAAMALDAVESALTKHELEHPLPKTADPRVQISGNFAPVPENPVCQSLPVTGKIPKCVQGVYVRNGANPLFEPTAGHHFFDGDGMVHAVQFKNGSASYACRFTETERLVQEKALGRPVFPKAIGELHGHSGIARLMLFYARGLFGLVDHSKGTGVANAGLVYFNNRLLAMSEDDLPYHVKVTPTGDLKTEGRFDFDGQLKSTMIAHPKLDPVSGELFALSYDVIQKPYLKYFRFSKNGEKSNDVEIPVEDPTMMHDFAITENFVVIPDQQVVFKMSEMIRGGSPVVYDKNKVSRFGILDKYAKDGSDLKWVEVPDCFCFHLWNAWEEAETDEIVVIGSCMTPPDSIFNECDEGLKSVLSEIRLNLKTGKSTRKSIIENPDEQVNLEAGMVNRNKLGRKTEYAYLAIAEPWPKVSGFAKVNLFTGEVEKFIYGDNKYGGEPLFLPRDPNSKEEDDGYILAFVHDEKEWKSELQIVNAMSLKLEATVKLPSRVPYGFHGTFINANDLANQA

SEQ ID NO: 8783 - protein, 143 aa, Zea mays
  misc_feature (2)..(2): Xaa can be any naturally occurring amino acid
  misc_feature (36)..(36): Xaa can be any naturally occurring amino acid
  misc_feature (53)..(53): Xaa can be any naturally occurring amino acid
  misc_feature (76)..(76): Xaa can be any naturally occurring amino acid
MXSLENKGSEWRRVGGRHGFGIHHLNILEGLRRTPXAFLHLSTNFYSRVYEDXEEWFPRDIPGVQEGRMAIQNQYXEFLDPRRMGRAHPLFSPRGRGTSPGPYRERAAEPFLWVYPSRGWQEAGGLTPTMATKAFWDRKLEKA

SEQ ID NO: 8784 - protein, 435 aa, Spiroplasma citri
MNIFIFHRDFRIEDNLGLAQLANEEKKIYLLFIFTKEQIKANNYFSSRSFQAMVHCLKQLTKKVHVNFLKSENEQTGIKFLLEQGYKINKIYTNRDYTPFALNRSKAMRQLSKEYNFIYREFDDYVLLEPWTIKTTQNGYYTVFTPFWNKLKEHFNDNHIITYKVNPFLPQHLKDLEILQDITNVKSSDFNLPLEFEKVKTAMFQLNQNYQQTRDLVDLENGTAKISTALKFGVVSIRQCYLWSIEKFGTFDNAFARQLAWRDFYYQVTYNAQLHQQWCFSENWNKKITINWTNNLEWFQKWQNGETGYDFIDAGMKELKETGLLHNRARMVCASFLVKNLQIDWHKGEQYFAQQLIDYDPIINQCSWQWVAGTGFDAQPFFRIFNPELQQKKYDPTSSYCNKFLKNRPTINKIVDYKISVKKALEIYKDCIKTV

SEQ ID NO: 8785 - protein, 293 aa, Triticum aestivum
  misc_feature (83)..(83): Xaa can be any naturally occurring amino acid
  misc_feature (103)..(103): Xaa can be any naturally occurring amino acid
  misc_feature (153)..(153): Xaa can be any naturally occurring amino acid
  misc_feature (172)..(172): Xaa can be any naturally occurring amino acid
  misc_feature (183)..(183): Xaa can be any naturally occurring amino acid
VTLHNKFVQKSRLLPVRNSRDIVDPRVRDGSLPGDFGFDPLGLGKDPAFLKWYREAELIHGRWAMAAVLGIFIGQAYSGVPWXFEAGAQPGAVAPFSFGSLLXTQLLLMGWVESKRCLDFFNADSQSVEWATPWSRTAENFANFTGEQRYPGXGKFFDPLRLGGETKDGVYXPDTEKLERVKXPEIKHSRPRHALPCIIFQLSKPGQGQNPRSGPLRSIKTIFFAYRRCVEKGHFPLTSNTGPLALDGNRLEGPKNPQPPLSSGPGTSFRGEGGGNTKGGIHRTLFFSPNRIT

SEQ ID NO: 8786 - protein, 494 aa, Mycobacterium smegmatis
MPTTISTPRYLLDQARRRFTPTPNTIPGMGAIEKRLKRKQWDQFVFSTPPAGSGLKPIMGDSGLPVLGHMIEIFRGGPDFILEQYRRNGPIHYAYSPALSSVMALGPDATQTVFSNRNKDYSQRAWDPVIGPFFEGGLMLLDFDEHMYHRRIMQDAFTRSRLTGYIPHIDSVASQVLANDWVSDDPRFLFYPAIKELTLDIASEVFMGVPAGTDKKLVTTVNHAFTTTTRAGNAIVRTPVPPLKWWRGIQARKTLEDYFLSRIDEKRRAESTDMFSVLCHSADEDGQTFTDDQIVSHMIFLMMAAHDTSTSTMTTMAYHLAANPEWQDRLRDESERIGDGPLDIEALEKLETYDLVINEALRMMTPLPFNFRQAVRDTELLGYFIPAGTNVVTWPSINHRLPELWTDPEKFDPERFAEPRSEHKKHRYAFAPFGGGAHKCIGMVFGQLEIKTVMHRLLRQYRLELPRPGYTPRYDYGGMPVPIDGMPIVLRPLR

SEQ ID NO: 8787 - protein, 285 aa, Zea mays
MDPEVRERVLQGNTNLLINTFQEMKLFALNVMSIFGEKEMRYIEELKQCYMSLEKGFHSMTRKTLTDAQISDNVIDVMFVAREATATVLTWMFMFLDDHTAFLKAVTEGVKAFEPDLIAKANSFVHGGCVSELYHLASIVCASVNGKTCMQACTTTSMADELVVSEEVDEVLNALPNRQPWPPPRQFAILADGVQVRPLPWPSFYCHAGGDYHGDVCITPPSVHGTNPASDAMVGMKIVAIGTDDKDYIHIEEPRKAVEANKDTLAGDSPFSDATPAPDSCYARW

SEQ ID NO: 8788 - protein, 189 aa, Lupinus luteus
RVFTQKIHDLIGTHVDVPAPDMGTGPQTMAWILDEYSKFHGYSPAVVTGKPIDLGGSLGRDAATGRGVLFAAEALLNEYGKSVSGQSFVTQGFGNVGSWAAQLISEKGGKVVAVSDVTGAIKNSNGIDIPSLLKHSSEHKGVKGFRGADPIDPKSILVKDCDVLIPAALGGVINKENANEIKAKFIIEA

SEQ ID NO: 8789 - protein, 189 aa, Lupinus luteus
RVFTQKIHDLIGTHIDVPAPDMGTGPQTMAWILDEYSKFRGYSPAVVTGKPIDLGGSLGRDAATGRGVLFATEALLNEYGKTVSGQRFVIQGFGNVGSWAAQLISEKGGKVVAVSDVTGAIKNSKGIDIPSLLKHSREHKGLKGFHGADPVDPNSILVEDCDVLVPAALGGVINRENANEIKAKFIIEA

SEQ ID NO: 8790 - protein, 951 aa, Haemophilus influenzae
MRFILRFFKYLIRELTMKRMLINATQKEELRVALVDGQRLFDLDIESPGHEQKKANIYKGKITRVEPSLEAAFVDYGAERHGFLPLKEIAREYFPDDYVFQGRPNIRDILTEGQEVIVQVNKEERGNKGAALTTFVSLAGSYLVLMPNNPRAGGISRRIEGDERTELKEALSSLDVPEGVGLIVRTAGVGKSPEELQWDLKVLLHHWEAIKQASQSRPAPFLIHQESDVIVRAIRDYLRRDIGEILIDSPKIFEKAKEHIKLVRPDFINRVKLYQGEVPLFSHYQIESQIESAFQREVRLPSGGSIVIDVTEALTAIDINSARSTRGGDIEETALNTNLEAADEIARQLRLRDLGGLVVIDFIDMTPIRHQREVENRIRDAVRPDRARIQISRISRFGLLEMSRQRLSPSLGESSHHICPRCQGTGKVRDNESLSLSILRLLEEEALKENTKQVHTIVPVQIASYLLNEKRKAISNIEKRHNVDIIVAPNEAMETPHFSVFRLRDGEEVNELSYNLAKIHCAQDENTEESLLSRNVETTAVIEQPAVESAVVALSISEAAPTPVERKSNEPSLLAKIIAKIKGLFATKSEENKPKNNRTSRNPNRNQRRSQDRRSSRRPRSENNETERTEEQVRNVRERNQRRPRRNLVEESIAESAVNSTPVFEAKEERTEPVTQRRQRRDLRKRVRVEDNETVVENNFSTTEKMPEVDVITVQNNDEKPVHQNQRSERQERQRRTPRHLRAANNQRRRRNQEPKSPMPLFAAVVSPELASGKAWIDYSTVNLPKENHFLSVDELLEQEKTKKGFITPAMGIVVEEKSPDVKPALDFITQPANESVQKKVQESLDRLSSYKPQEVVESIDPAINVDEPETLEKVSKFVRTYEFNGRLGTISSVPHTKAEMTLAKANDEMPEAFPIRAWQDSRYYFYGKGAAGHHCAISHVYSEPTRAKSE

SEQ ID NO: 8791 - protein, 189 aa, Lupinus luteus
RVFTQKIHDLIGVQRDVPAPDMGTNAQTMAWILDEYSKFHGHSPAVVTGKPIDLGGSLGREAATGLGVIFATEALFAEYGMSISGMTFAIQGFGNVGTWAAKSIYDRGGKVVAVSDISGAITNPNGIDIPALLKHKESNGNLTEFSGADAMDPNDLLVHECDVLIPCALGGVLNKENAADVKAKYIIEA

SEQ ID NO: 8792 - protein, 340 aa, Psychrobacter arcticus
MATDNTAPRHEKLIILGSGPAGYSAAVYAARANLKPVMVTGMEVGGQLTTTTEVDNWPGDAHDLTGPALMERMKAHAERFGTELVYDHINAVNLNVRPFELTGNNGSYTCDALIISTGASAQYLGLESETKFRGLGVSACATCDGFFYKDKKVAVIGGGNTAVEEALYLSNIASEVTLVHRRDSLRSEKILQDKLFEKAKNGNVKIEWNHSVKEVVGDDMGVNGVVIESMLDGSTKQLDVFGMFVAIGHKPNTDLFKGQLEMKDGYLIVNSGLNGNATQTSIEGVFAAGDVADHVYRQAITSAGTGCMAALDAEKYLDAIGEAVAKDHTYASTLTADKEA

SEQ ID NO: 8793 - protein, 569 aa, Unknown
  Mesorhizobium sp. BNC1
MSQFNPSRDDFASLLDESFSGRDAVEGSVVKGIITAIEKDMAIIDVGLKVEGRVPLKEFGARAKDGQLKPGDEVEVYVERIENALGEAMLSREKARREESWTKLEEKFNKGERVEGVIFNQVKGGFTVDLDGAVAFLPRSQVDIRPIRDVSPLMHTPQPFEILKMDKRRGNIVVSRRTVLEESRAEQRSEIVQNLEEGQVVEGVVKNITDYGAFVDLGGIDGLLHVTDMAWRRVNHPTEILNIGQTVKVQIIRINQETHRISLGMKQLESDPWEGIGGKYPLGKKVQGRVTNITDYGAFVELEPGIEGLIHVSEMSWTKKNVHPGKILSTTQEVEVVVLEVDPVKRRISLGLKQTLENPWEAFARNHPVGSVVEGEVKNKTEFGLFIGLEGDVDGMVHLSDLDWSRPGEQVIEEYNRGDMVKAQVLDVDIEKERISLGIKQLGRDVVGEAVASGELRKNAVVTCEVIGVRDAGLDVRLVDHDIESFIKRSDLSRDRDEQRPERFAVGQKVDARVTQFDKKSRKLSVSIKALEIAEEKEAVAQYGSTDSGASLGDILGAALKKQSGGKEE

SEQ ID NO: 8794 - protein, 120 aa, Alkaliphilus metalliredigenes
MADKITKVEIITRPSKFDELKEALNDIGVTGMTLTRVQGCGVQKGRKENYRGITYIPELIEKIKIETVICEVPVDLVVETAKKVLYTGEVGDGKIFITEISNVIRIRNGDEGKVALDNEK

SEQ ID NO: 8795 - protein, 118 aa, Zea mays
NGSACCVKKIEAIIKPFKLDEVKEALHEVGVSGITVTEAKGFGRQKGHTELYRGAEYVVDFLPKVKLEVVVEDSLAERVVEAIAAAAQTGRIGDGKIFVIPVETALRIRTGERDEDAI

SEQ ID NO: 8796 - protein, 554 aa, Pseudomonas fluorescens
MAYYRTPHDVTALPAWQALKDHRQAMQDFSMREAFNADPQRFSQFTLSSCGLFLDYSKNLITSETRDLLVNLAKEVGLSDAIKSMITGELVNASEGRPALHTALRRPVGDKLSVNGVNVMPEVHKVLNQITELVGRIHDGLWRGYTEKPITDVVNIGIGGSFLGPELVSEALLSYAQKGVRCHYLANIDGSEFHELSAKIRAETTLFIVSSKSFNTLETLKNAQAARAWYLAQGGSEAELHRHFIAVSSNNAAAVAFGIREENIFPMWDWVGGRYSLWSAIGLPIALAIGMSNFKELLSGAYTMDQHFQSAPFEQNMPVLLALLGVWYGNFWGAQSHAILPYDHYLRNITKHLQQLDMESNGKSVRQDGTPVATDTGPVIWGGVGCNGQHAYHQLLHQGTQLIPADFIVPIVSFNPVADHHQWLYANCLSQSQALMLGKTRAEAESELREKGLSEAEIAKLAPHKVIPGNRPSNTLVVERISPRRLGALVALYEHKVFVQSVVWGINAFDQWGVELGKELGKGVYNRLVGSDETLADDASTQGLINYFRGRHRG

SEQ ID NO: 8797 - protein, 273 aa, Panax ginseng
PYYVAPEVLLKHYGPEADVWTAGVILYILLGGVPPFWAETQQGIFDAVLKGHIDFESDPWPLISDSAKDLIRKMLCSRPSDRLTAHEVLCHPWICENGVAPDRALDPAVLSRLKQFSAMNKLKKMALRVIAESLSEEEIAGLKEMFKAMDTDNSGAITFDELKAGLRKYGSTLKDTEIRDLMDAADVDNSGTIDYGEFVAATIHLNKLEREEHLMAAFQYFDKDGSGYITVDELQQACAEHNMTDVFLEDIIREVDQDNDGRIDYGEFVAMMK

SEQ ID NO: 8798 - protein, 353 aa, Arabidopsis thaliana
  misc_feature (201)..(201): Xaa can be any naturally occurring amino acid
MGELDEAFIQAPEHRPNTHLTNSGDFIFSDEIPTIDLSSLEDTHHDKTAIAKEIAEACKRWGFFQVINHGLPSALRHRVEKTAAEFFNLTTEEKRKVKRDEVNPMGYHDEEHTKNVRDWKEIFDFFLQDSTIVPASPEPEDTELRKLTNQWPQNPSHFREVCQEYAREVEKLAFRLLELVSISLGLPGDRLTGFFNEQTSXFLRFNHYPPCPNPELALGVGRHKDGGALTVLAQDSVGGLQVSRRSDGQWIPVKPISDALIINMGNCIQVWTNDEYWSAEHRVVVNTSKERFSIPFFFFPSHEANIEPLEELISEENPPCYKKYNWGKFFVSRNRSDFKKLEVENIQIDHFKA

SEQ ID NO: 8799 - protein, 108 aa, Oryza sativa
MAITGSKKPGQLKQMLRRCSSSLGIKGAGGDDDGLPGDVPRGHFAVYVGISRRRYIVPVACLAAPEFQELLRKAEEEFGFDHDMGITLPCDEATFHGVLASASATSIR

SEQ ID NO: 8800 - protein, 377 aa, Unknown
  Acinetobacter sp. ADP1
MIEVIDGQRQLKACKRIVVKIGSSLLTANGQGLDLDAISHWAMQIADLHNAGHEIILVSSGAVAEGMVRMKLTSRPTDLPSLQACAAIGQMGLIHTWSSVLEKHTIQTAQVLLTHDDLADRRRYLNSCDALQNLIEWRVIPVINENDTVSTDEIRFGDNDTLAAMVAGQVHADLLIILTDQQGMFDSDPRSNPNAKLLTTVNAMDDALFEMAGGGGVLGRGGMVTKVRAARLAAKSGCPTLIASGESDHVLSRLMSGELLGTLFSTDKDRITAHQQWLAAHLQTAGRLVIDAGAVEAIKQRHRSLLPVGVKAVEGHFNRGDVVECVDQSGQRVAVGRVNFSSRSAEIIKGLASDKVHQVLGEARSLEMIHRNHMAIY

SEQ ID NO: 8801 - protein, 646 aa, Oryza sativa
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMAAALPAAARTEQQQQHGHGGHQHHDLLPSDAFSVLQDIVSTVDAAGAPPRAPHMSMAATSLGNSREQSPDRGVGGGVLATLFAKPAAASKLYSPVPLNTWASPSPAVSSVPARAGVSIAHLPMFAAWTDA

SEQ ID NO: 8802 - protein, 728 aa, Oryza sativa
MDASAGSSAPHSHGNPGKQGGGGGGGGGRGKAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARLGGGRQGTMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKPAGAEDGTGGDDSPEAAAAAAAGKADGGGCKGKSPHGVRRSRQEAAAAASMSQMAVSI

SEQ ID NO: 8803 - protein, 56 aa, Streptococcus pyogenes
MPNAMFTVELENGHQILATVSGKIRKNYIRILVGDRVTVEMSPYDLTRGRITYRFK

SEQ ID NO: 8804 - protein, 329 aa, Oryza sativa
MSPPAATFENPLAVSDITVPVQKNLAVKAPTNGHAKTLAEMENKWESFTFSPIRESQVSRAMTRRYFTDLDTYAESDIVIVGAGSCGLSTAYELAKKRPDLKIAIIEASVSPGGGAWLGGQLFSAMVMRKPADAFLNDLGVPYEDEGDYVVVKHAALFTSTLLSKVLSFPNVKLFNATAVEDLITRPAPTAENPAAVRIAGVVTNWTLVSMHHDDQSCMDPNTINAPLVISTTGHDGPFGAFSVKRLVSMQQLEKLGGMRGLDMRTAEDAIVKRTREVVKGLIVGGMELSEVDGANRMGPTFGAMALSGVKAAEEALRVIDERKAENVD

SEQ ID NO: 8805 - protein, 505 aa, Oryza sativa
  misc_feature (81)..(81): Xaa can be any naturally occurring amino acid
  misc_feature (343)..(343): Xaa can be any naturally occurring amino acid
MDAAHKRKRPDADEDGAAGAVDLSSLEGADDVEVLDLRAAKRLLLAFERRLRDNLEARMKHPDDPARFADSEIALHAETDXLRILAGAPDLFPDLVPLGLASSLSSLLTHDNADLAAAAASLLADLTDSDDPDDLAGLHSLADALVEANALDLLVHNLSRFSEADPDEAEAVHHTLSVVENLLELRPQLADIVCDRTKLLRWLLARLKAREFDANKQYASEILAILLQDSPANQKRLGNINGVDGLLQAVAMYKSRDPKTSDEEEMLENLFDCLCCVLMPMENKERFVKAEGVELMIIIMKQKKLAYSSAIRTLDFAMTRFPPACERFVDVLGLKTAFAAFMXIPVNKKNKKESYQEALEERVISLIASLIRLLGKFVENECEKIDRLMEFYTRYSERVKAETERLDSLDLDDLEMDEDERYNRKLEAGLYTLQLIALILGHIWHSGNSQMRTRIELLLRQNKLTKDDVKDILEEYHDNIGDLDGPEEKERAQGRTKEIIASLSL

SEQ ID NO: 8806 - protein, 641 aa, Rhodospirillum rubrum
MCGLVGIYHPTASRPVDRALVEAMNQRQFHRGPDDGGVFIGPGIGLGHRRLSIVDLGGGRQPMTNDGGGVVLVYNGELYNNAELVAELKAAGHVFRTASDTETVIHAWEEWGEDSVRHLRGMFAYALWDDRSQTLFLARDRLGIKPLHYTCLADGRVMFGSELKSLTGVEDIPKVVDPLAIEDFLAYGYVPDPRSIFKDILKLEAGHTLTFRRGEAPGRPHCYWDVSFTTPSRPAKTDDLCAEVIDRLDEAVRCHLVADVPVGAFLSGGVDSSAMVALMAGATDRPVETCSIAFSEARFDESAYAKTVAERYGTHHRVHTLPAQALSEVGPLTAIYDEPFADSSALPTLKVCQAARETVTVALSGDGGDELFAGYRRYRFHTAEEAVRRILPQAARGPLFGALGRVYPKLDWAPQVLRAKSTFQALGRDRVEGYFNAVSVIPDGLRRGLYSKTMRAELAGYGASEVLRRHMTRAPADHPLSIAQYVDLKTWLPGDILTKVDRASMATSLEVRVPMLDHRFVEWTAGLSPDLKLSGGTGKYLLKRALRPLLPDEVLYRRKMGFSIPLTDWLRGPWSGRTRALAGRSALVTSGLFDGAAVAKLVEQHLGGNWDHGAALYALIVLDDFLTAHVGAACLPARMSA

SEQ ID NO: 8807 - protein, 638 aa, Oryza sativa
MAASRVALSVPVAAAVALLLLALPRAAVSYPWGLCNDTAGEFPARRSSYLASINLIAATLPGNASASPDLFATAEGVGAPPDQVSALALCRGDANASTCLACLTQAFLDLPNACAYHKVAAIFYDSCLLAYSNATIAAGDFSSEKIPIYGFYSNANATTEQARFNRLVAALVNATADYAARNSTRRRYASGEADFNAEFPKVYSWAQCTPDLTPASCRSCLAQIIGTYIGFFENRVGGFVRAVWCSFQYSTTPFLDGPMLVRLQGTSGASPAPSPAAVVPAVNQTPPAATPTLEGDANYSTEAEDIENLDSMLIDISILRSATGDFAESNKLGEGGFGAVYKGVLPDGYEIAVKRLSKSSTQGVEELKNELALVAKLKHKNLVSLVGVCLEQQERLLVYEFVPNRSLDLILFDTEKSEQLDWEKRYKIINGIARGLQYLHEDSQLKVVHRDLKASNILLDVNMNPKISDFGLARIFGRDQTQAVTKNVIGTYGYMAPEYLTRGNYSVKSDVFSFGVMVLEIVTGRKNNHSYNSQQSEDLLTMIWEQWVAGTVLEMVDPSMNSFFSESDVMRCIHIGLLCVQGDPANRPVMSSVVLMLGTDTVELHAPAKPTLFARKGGGDESGVASGGMSIVSLEEQS

SEQ ID NO: 8808 - protein, 260 aa, Unknown
  Mycobacterium sp. MCS
MKAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPDEIAAPAVFLASPEASYITGAVLPVDGGMTAGVTFRAFEAV

SEQ ID NO: 8809 - protein, 157 aa, Medicago truncatula
MSMDMIATERVCYVHCNFCNTILAVNVPYSSLLTIVTVRCGHCANLLSVNMVAPLLQPFPPPQLPQKQHIIDEEASSKEIGSSSSKCNKIASFEAVEHPRIPPIRPIEKRHRVPSAYNRFIKEEIQRIKASNPDISHREAFSSAAKNVSIISNIKII

SEQ ID NO: 8810 - protein, 286 aa, Pseudomonas syringae
MSDYQETLYEGYGQRFRMEKMLHEVRTDHQHLVIFQNPRMGRVMALDGVIQTTEADEFIYHEMLTHVPILAHGAAKRVLIIGGGDGGMLREVAKHMSVEHITMVEIDATVVEMCKEYLPNHSSGAFDDSRLNLVIDDGMRFVATTEEKFDVIISDSTDPIGPGEVLFSENFYQACHRCLNEGGILVTQNGTPFMQLSGVQTTAGRMNGLFADWHFYHAAIPTYIGGAMTFAWGSTDKSYRKLPLETLRQRFSGSGIVTRYYNPEVHIGAFALPQYVLQAVGKASND

SEQ ID NO: 8811 - protein, 550 aa, Arabidopsis thaliana
MKLDEEFLHDRDHSFLTDDEENQAALACSDDEHDGDDDGRRGGENSDSSSPLSRDRSDNNLSDVSNPPWPQSYRQSMDLLTGMTPPSVSFMPQSSSRRLASSFQKKQQSSFCDSLSSSSSKPLLSQPVPDKEETILPVNPQSQLKLSVTDLPLPEPNLCSFSQSVLNGTNVLCGLGLITMPYAIKESGWLGLPILLFFGVITCYTGVLMKRCLESSPGIQTYPDIGQAAFGITGRFIISILLYVELYAACVEYIIMMSDNLSGLFPNVSLSIASGISLDSPQIFAILTTLLVLPTVWLKDLSLLSYLSVGGVLASILLGICLFWVGAVDGIGFHATGRVFDLSNLPVTIGIFGFGYSGHSVFPNIYSSMKDPSRFPLVLVICFSFCTVLYIAVAVCGYTMFGEAVESQFTLNMPKHFFPSKVAVWTAVITPMTKYALTITPIVMSLEELIPTAKMRSRGVSILFRTMLVTSTLVVALSVPFFAIVAALIGSFLAMLVALIFPCLCYLSILKGKLSNTQIGLCIFIIVFGVVSGCCGTYSAISRLANQMTD

SEQ ID NO: 8812 - protein, 567 aa, Symbiobacterium thermophilum
MRKEILLTVDIDQTRAAVLEDGELVELYIEQPVHERIVGNIYKGKVENVLPGMQAAFVNIGLERNAFLYVDDAQPGRAPLEGETPLPRSGRRPTIGELVRTGQDILVQVAKEPIGTKGARVTRNITLPGRFLVLMPHVDYVGVSRRITDERERDRLKQIAHAVKPDGMGLIVRTVAEGASEEELAHDAAFLERHWQQIAARARTARAPSLVHHDQGLIHRLVRDGLDDSVSLFLVDQRSAYDTALAVVELHAPQLKDRVKLYTRSDQTLFDYYGVEMEIEKALRRRVWLRSGGYIIIDQTEALTAIDVNTGKFVGSTNLADTVFRTNLEAAREIARQLRLRDIGGIIIIDFIDMDREDHRQQVIQALEEALRRDRTRANILGLTQLGLLEMTRKKSRQNLSEVLTKPCPACDGRGKVLNEQTMAHRVRAEIRRIMKQSSSEALLMEVHPSVAALVIRPGGANLRALEEELARTIYIRGNSEVSPDSWSLKALGTREEVEAKALPVSAGQVLQLRIEEPHASNAADGIARVDGYVIDVADAGRLVGQVVPVEILKVFRTYAKGRVAPH

SEQ ID NO: 8813 - protein, 486 aa, Neisseria meningitidis
MNYFPIFANLAGRPVLVVGGGAVAARKISLLLKAGAEVRVAAKHLNAELSALAAENKILWLAEEFRAEHIRTVFLIIAASSDQALNRRVFHLAESCQKPVNVVDDRDHCSFIFPSVIDRNPVQIAVSSSGSAPVLARLLRERLEALLPPSLGDMAEISGRWRDAVKGKLKSVTERRRFWEKQFNGRFAALVKNRQNTLAERELAGQLEQSRQNDQGGSVSLVGAGPGDAGLLTLKGLQEIQQADVVLYDALVSDGILSLVRRDAERIFVGKRARGGRTPQEDTNALMVRLAREGRRVVRLKGGDPFVFGRGGEELETLARHQIPFSVVPGITAAVGATAYAGIPLTHRDYAQSAVFVTGHRKADAPDIEWQTLARSRQTLVIYMGALKAALIAERLQQHGRSPDTPAAVISQGTLPAQKTATGTLANLAELAETAPNPALIVIGEVVGLHEKLAWFGENAKKESNPAEHAYFALDGLGTGQEQQAA

SEQ ID NO: 8814 - protein, 393 aa, Brucella suis
MNHSPQSARPVSIMRRFLDSEAAGGITLMAAAALALIVANSPFAQTYFDALHLYIGPLSLAHWINDALMAIFFLLVGLEIKREMLDGQLASWPNRMLPGIAAAGGVILPAIIFAVLNHDNPAKLRGWAVPSATDIAFALGVLSLLGSRAPSSLKVFLATLAILDDLAAVVIIAIFYTAEISMPYLGAAFITAAVLFVMNRMGVVKLLPYLISAVILWFFVFNSGVHATVAGVVAALMIPLKPAPGRPDDMTSPLHKLEHALAKPVAFIVVPIFGFANAGISFKGLEASVLGDTLTLGILLGLFLGKQFGVFGAAWLAIKTGLAEKPMGASWVQLYGVAILCGIGFTMSIFIGLLSFPSDLMQTETKIGVLSGSALSAICGYLLLRAAARPKRG

SEQ ID NO: 8815 - protein, 423 aa, Acetabularia peniculus
IPPDQQRLIFAGKQLEDGRTLADYNIQKESTLHLVLRLRGGMQIFVKTLTGKTITLEVQSSDTVENVKSKIQDKEGIPPDQQRLIFAGKQLEDGLTLADYNIQKESTLHLVLRLRGGMQIFVKTLTGKTITLEVESSDTVENVKSKIQDKEGIPPDQQRLIFAGKQLEDGRTLADYNIQKESTLHLVLRLRGGMQIFVKTLTGKTITLEVESSDTVENVKSKIQDKEGIPPDQQRLIFAGKQLEDGRTLADYNIQKESTLHLVLRLRGGMQIFVKTLTGKTITLEVESSDTVENVKSKIQDKEGIPPDQQRLIFAGKQLEDGRTLADYNIQKESTLHLVLRLRGGMQIFVKTLTGKTITLEVESSDTVENVKSKIQDKEGIPPDQQRIIFAGKQLEDGRTLADYNIQKESTLHLVLRLRGGAF

SEQ ID NO: 8816 - protein, 136 aa, Unknown
  Shewanella sp. MR-7
MSQLLHTMLRVGNLERSIAFYTQVLGMKLLRTSENPEYKYSLAFVGYGEESTGQAVIELTYNWGTEKYDLGTAFGHIAIGDEDIYARCEAIAAAGGKVTRAPGPVAGGTTEIAFVEDPDGYKIEFIQMKSATQGLG

SEQ ID NO: 8817 - protein, 97 aa, Glycine max
  misc_feature (24)..(24): Xaa can be any naturally occurring amino acid
  misc_feature (27)..(27): Xaa can be any naturally occurring amino acid
  misc_feature (59)..(59): Xaa can be any naturally occurring amino acid
  misc_feature (76)..(76): Xaa can be any naturally occurring amino acid
MACRKMITLCLIDCLSLFSLTKNXGLXAKVPFLDKNFIGVAMNMDPDYKMIKQEHCRIXKCVLKRPFDDEERPYLXRHGMQLMEQVSDVSGYGWMHG

SEQ ID NO: 8818 - protein, 184 aa, Triticum aestivum
YRKSHIPDGPGYQEKFYFNPGDTGFKAFKTKYATIGVGICWDQWFPETARAMVLQGAEILFYPTAIGSEPQDMNLDSREHWKRVMQGHAGANLVPLVASNRIGKETVETEHGNSTIKFYGNSFIAGPTGEIVKLANDKDEEVLVAEFDLDEIKSTRHGWGIFRDRRPDLYKVLLTLDGKTSSSS

SEQ ID NO: 8819 - protein, 605 aa, Glycine max
MITLTDFYHVMTAMVPLYVAMILAYGSVKWWKIFSPDQCSGINRFVALFAVPLLSFHFIASNNPYEMNLRFLAADTLQKIIILVLLAVWSNIAKRGCLEWAITLFSLSTLPNTLVMGIPLLKGMYGDFSGSLMVQIVVLQCIIWYTLMLFLFEFRGARMLISEQFPDTAASIVSIHVDSDVMSLDGRQPLETEAEIKEDGKLHVTVRKSNASRSDIFSRRSQGLSSTTPRPSNLTNAEIYSLQSSRNPTPRGSSFNHTDFYSMMAAGGRNSNFGASDVYGLSASRGPTPRPSNYDEDGGKPKFHYHAAGGTGHYPAPNPGMFSPSNGSKSVAANANAKRPNGQAQLKPEDGNRDLHMFVWSSSASPVSDVFGAHEYGGGHDQKEVKLNVSPGKVENNHRDTQEDYLEKDEFSFGNREMDREMNQLEGEKVGDGKPKTMPPASVMTRLILIMVWRKLIRNPNTYSSLIGLTWSLVSFKWNVEMPAIIAKSISILSDAGLGMAMFSLGLFMALQPRVIACGNSTAAFAMAVRFLTGPAVMAAASIAVGLKGVLLHVAIVQAALPQGIVPFVFAKEYNVHPDILSTAVIFGMLIALPITLVYYILLGL

SEQ ID NO: 8820 - protein, 245 aa, Zea mays
DRPSQPAASQTRAFSRPLPFNHHRHHHCHYARGTARHGTTELQSAPAPIRTSALIRQMASPARRLLQTNSVQYPTLPAADPPSPLAVDSDVVVILAALLCALICVVGLASVARCARSRAAPAAARRGLRKKALRALPSLAYEDAVAARAGDGAAEVLAECAICLSEFAPREEVRVLPQCGHAFHVACIDTWLAAHSSCPSCRRVLVVGDAASKRPPQPKRCRKCEAAMDEPSSSSGSAGDTATGS

SEQ ID NO: 8821 - protein, 226 aa, Gossypium hirsutum
MLQCLDGLKHLFASVLHCCDIDLCKQSRGLEDPELLARETVFSVSEIEALYELFKKVSSAVIDDGLINKEEFQFALFKTNKKESLFADRVFDLFDTKHNGILGFEEFARALSVFHPNAPIDNKIDFSFQLYDLKQQGFIERQEVKQMVVATLAESGMNLSDDVIESIIDKTFEEADTKHDGRIDKEEWRSLVLRHPSLLKNMTLQYLKDITTTFPSFVFHSQVDDT

SEQ ID NO: 8822 - protein, 249 aa, Gossypium hirsutum
MLQCVAGVKHLFASVLQCCDIDLYKQSRGLGDPELLARETVFSVSEIEALYELFKKISSAVIDDGLINKEEFQLALFKTNKKESLFADRVFDLFDTKHNGILGFEEFARALSVFHPNAPIEDKIECMCCLHRDLYLHLWPSFINLEIRFSFQLYDLKQQGFIERQEVKQMVVATLAESGMNLSDDVIESIIDKTFEEADTKHDGRIDKEEWRSLVIRHPSLLKNMTLQYLKDITTTFPSFVFHSQVDDT

SEQ ID NO: 8823 - protein, 623 aa, Unknown
  Burkholderia sp. 383
MRSRPARPSGSHAFESSFGTTCVDVDRTRFWLWAPASRTAAVEIEGEDAPAVAMTAVGDGWFEATVPCGPGTLYRYRLDGGLAVPDPASRFQPGGVEGPSQVVDPAAYRWRHDAWRGRPWHETVLYELHIGACGGHASVERRLPEIAALGVTAVELMPVNAFPGMRNWGYDGVLPFAPDASYGRPEELKALIDAAHGLEMQVFLDVVYNHFGPEGNLLPRYAPAFFRADRQTAWGPAIDFSREQTSTFFIENALYWLDEFRIDGLRIDAAHAIDDDAWLRELARRVRAYVGDTRHVHLVLENERNAASLLGPGGFDAQWNDDFHNSAHVLLTGERDGYYRAYADAPLRHLARTLGEGFAYQGEPSPLHDGAARGEPSAHLPPTAFVAFLQNHDQVGNRAFGERLRTLANEDAVRAATALLLLAPSIPLLFMGEEDGSTQPFQFFTDYRGALADAVREGRRREFAAFPAFADAAHRDAIPDPNDIATFVRSTLHGSSDETTPDTDAWRRFYRSALAVRAALVTPNLPGARALGVDLLTGDGDPQALVARWRLGDGSTLTIALNLGSHDAVLPALPVGKIVFETPPRARDRLRDLRLPPRACIAWRDGKVNHDARQHRINGQGRS

SEQ ID NO: 8824 - protein, 708 aa, Unknown
  Burkholderia sp. 383
MPTALPARLESGRSYPLGATWDGLGTNFAVFSAHAQRIQLCVFDPTGRKELARLDLPECTDEVWHGYLPNAHPGTVYGFRADGPYQPQHGHRFNPTKLLLDPYARKLVGQFRWSDALFGYRVHSSRADLSMDRRDSAPAMPKCVVVDEAFDWRNDRRPRVSWRNTVIYETHVRGASMRRAGLRPPERGTFAAFAHPAFIDHLLSIGVTTVELLPVHAFLQQRALVNRGLRNYWGYDTAAFFAPEPAYLATRRLDEIRIAIRQLHAAGIEVVLDVVYNHTCEGNELGPTLSWRGLDNASYYRLMPDDHRFHVDETGCGNTLNLSHPRVVQMVMDSLRYWATAFNVDGFRFDLGVTLGREEHGFDPGAGFFDALRQDPVLAQRKLITEPWDLGPGGYQLGRHPPGFAEWNDRFRDTVRRFWRGDAGQRPELAARLAGSADLFNHQRRHTWASVNFVTAHDGFTLADLVSYSAKHNDANGEDNRDGRDDNCSANWGVEGPSDDAAIRAVRARVARSMLATLFTALGTPMLVAGDEFGRTQHGNNNAYCQDNELSWLDWDLARSDEAVTLMRFVSRLAALRRMYPVMSTPRYPSGDRDAAPGMAEIDWFDERGDAMTVPAWQDRERRALTMRRVGTGRTGRTEALLVMLNASSETVVFAPPAPVLDYRVLVDTATPDAGPRAWPADGLDVAAHAAAIAVAAVPPDLHSGDSP

SEQ ID NO: 8825 - protein, 1014 aa, Unknown
  Polaromonas sp. JS666
MGRPCAAHVRLSVFYRNKHMLMPSAKPLGELENPSEFIPRHIGIDEADEVHMLSVVGSASRRDLIDGIVPRSIARTSTMAIPAPVTEAAALKQLKAIAAKNQVFKNFIGQGYYGTYTPGVILRNILENPAWYTAYTPYQAEISQGRMEALINFQTMVCDLTGMPIANASMLDEATAAAEAMTLARRSVKSKSNVFIVAGDCHPQTIEVIQTRARPLGIEVKVSTAVTTLPQLMAEGNYFGVLAQYPATTGSIHDLRPLAGQAHVDGAALCVAADLLALTLLTPPGEWDADIVLGNTQRFGMPMGNGGPHAAYLACRDEFKRSLPGRLVGVSVDVHGNPTYRLALQTREQHIRREKATSNICTAQVLPAVIASMYAVYHGPQGLRRIAERVAAYTAIFVRGLQELGYEITDLGAFDSVTVKTGDATNLIAERARQSGANLRCRLNNHLGVSLDETTSRKDIELLWSFFAQPGQTVPVVSAFEEGIESLIPADLRRTSAFLTHPVFNTHHSETGMLRYIRMLSDKDLALDRSMIPLGSCTMKLNATSEMIPITWPEFANIHPFAPQEQLQGYAELDKQLRDWLCQATGYKGISLQPNAGSQGEYAGLLVIKAFHEAHGQGHRNICLIPSSAHGTNPASAQMAGMTVVVTACDAQGNVDMEDLKAKCEKHSANLACMMITYPSTHGVFETHVQDLCQLVHSHGGRVYVDGANMNALVGVAAPGEFGGDVSHLNLHKTFCIPHGGGGPGVGPVCVVADLVPYLPGHATAGYAGGGRAFGEGTSFSAGPPQGKEAPSGGSALHEVKSVGAISAAPLGNAAVLPISWMYCRMMGAEGLKQATEIAILSANYISSRLKDHYPTLYASENGHVAHECILDLRPLKETSGVTAEDVAKRLIDYGFHAPTLSFPVAGTLMVEPTESETLDELDRFIDAMIAIRQEIRRIEKGEWPQDDNPLKAAPHTAASLLKGEWMHAYTRDVGAAILSKTQHAKYWPPVGRVDNVYGDRNLFCSCVPVSDYA

SEQ ID NO: 8826 - protein, 435 aa, Bacteroides fragilis
MIMKILSTILLTLLIVLGACTSPQVSPDPFVRVSNGRLTVNGKPYYYIGTNFWYGAILGSQGQGGNRERLLRELDYLKALGINNLRVLVGADGKDGIPTKAEPALQVEAGVYNDTIFDGLDFFLSELDKRDMYAVLFLNNSWEWSGGYSQYLYWAGHGEVPMPNVAGWDAFSNYVAQYAKSEKAHHLFRDHITHVVNRVNRYTGKKYSEDPAIMSWQIGNEPRPFGEDNKKSFAVWIADCAALIKSMDSNHLVSIGSEGMAGCEGDLSLWTSIHADANVDYTTIHIWPNNWGWIDKKDIPGTIGQAIENTCSYIDMHVQEAFKINKPLVLEEFGLPRDSVKFTSNTSTVQRDRYYRAVFDIVEKHAAEKGVFQGCNFWAWGGFAEPQHLFWQRGDDYMGDPGQEEQGLNSVYATDSTINMIKEAVSDINQIIQKQ

SEQ ID NO: 8827 - protein, 1138 aa, Unknown
  Burkholderia sp. 383
MMKREDSLDDVRRAQFPSLAPGGTPRRRRARRRAPALCADDPLWYKDAIIYQVHVKSFYDSNNDGIGDFPGLIAKLDYIAELGVDTIWLLPFYPSPRRDDGYDIADYRDVHPDYGTLADVRRFIREAHARGIRVITELVINHTSDQHPWFQRARRAKPGSTHRDYYVWSDTDTKYAGTRIIFLDTETSNWAHDPVAGQYYWHRFYSHQPDLNFDNPAVVREVMQVMRFWLDLGIDGLRLDAVPYLVAREGTNNENLPETHAILKRIRATIDAEYPNRMLLAEANQWPEDVQEYFGDEDECHMAFHFPLMPRIYMSIASEDRFPIVDIMRQTPELAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAVNVEAQTRDPHSLLNWTRRILSTRRASQAFGRGTIRFLRPENRKVLAYLRELDGDDPVLCVANLSRASQAVELDLSEFAGRVPIEMTSDSPFPPIGQLPYLLTFPPYGFLWFVLAEHGREPSWRQPHAEPLPEYVTLVMRRGDARPDIEQLHVLAHDALPSWLARRRWFASKDRAIGAARLNVVTPVPGEPFQYAEAWVESDEPGDVERYVVPLAAAWGGETSQPLFAQLALARVRRGHSVGYLTDAFALPAFAHGMLRKLRDGATVPTSDDGRLAFLPEDALAALDPGDNADVRWLAAEQSNSSLVIGDAIVLKLVRKVAHGVHPEAEMSRYLTRIGYPNTATLAGEVVHVDPDGTPHTVAILQRYADNQGDAWTRSFDFLRRAVDELALPAADEEEPDDTDEEPDALLGYAAFAGIIGTRLGQLHVALAQPSDDPAFAPEHATPEHVDGWCADAIASFEHALDVLHTRLDALDPATRAAADTLLASRDAAVRALGELVPRTLDAQCIRIHGDFHLGQVLDVQGDALLIDFEGEPARPLERRRAKSHPLRDVAGLLRSLSYVSAIAQFAIEKAPPQAAGRKRALFDRFGQAAADRFVDCYRAAAELAPARFVDPRYAYRLLALFLIDKASYELCYEAANRPDWLSVPVGGLAALVERLLDGGAASDDGDTP

SEQ ID NO: 8828 - protein, 460 aa, Oryza sativa
MHLCTEAAVTRRRLLLLLLLLVTCSCLSARERSNSSSSSSRRVVRHLPGFDGALPFELETGYVEVDRIAGVRLFYYFIRSESSPADDPLLLWLTGGPGCSAFSGLVYEVGPLTFDVHGHGHGQLPRLLYKPESWTKRTNVIFLDSPVGTGFSYADTDAGFRTGDTIAVHHILVFLNNWFQEVHPDFLSNPLYIAGDSYSGMIVPAVTFGIATSSPKPSLNLKGYLLGNPVTDHNFDAPSKIPFAHGMGLISDQLYQAYKKSCSVKHNTQQQSVQCTNTLDAIDECVKDIYGNHILEPYCTFASPHNPRIDKPFTSGTAEYTMSRIWANNDTVREALGIHQGTVPSWQRCNYDILYTYDIKSSVRYHLDLTTRGYRSLIYSGDHDMIIPFIGTQAWIRSLNFSVVDEWRPWFVDGQVAGYIRSYSNNLTFATVKGGGHTAPEYMPKQCLAMLARWVSGNPL

SEQ ID NO: 8829 - protein, 443 aa, Oryza sativa
MVYISNAQDASKLIVTAKGGGGEADDAAASSAAVVLDLWRQPAKIPAPFVWPRADVALPPSSPPTGELDVPVVDLAAALRDAAGMRRAVAQVAAACASHGFFQVSGHGVPPSLARAALDGAAGFFRLPPAAKQRARRAPGTVTGYTAAHADRFVDNLPWKETLSFGHRHANAAGNNSSTVADYFSTLGDDFKHLGEVYQEYCEAMEEVTKAIMAVLGESLGVGGGYYREFFEDSSSIMRCNYYPPCPEPERTLGTGPHCDPSALTVLLQDGDVDGLQVLVAGAWRPVRPLPGAFVVNIGDTFMVPVDTYQVSADTLDVSFRPNRVPADTYQVSGDTSEALTNGRYKSCLHRAVVHREQERRSLAFFLCPREDRVVRPPAGAGAGERRLYPDFTWADFMRFTQRHYRADTRTLDAFARWLRPPACSGAAPVVGPPTTATQAATV

SEQ ID NO: 8830 - protein, 156 aa, Acidobacteria bacterium
MEKATFAAGCFWGVEETFRTTPGVVATAVGYTGGHTENPTYHDVCTDTTGHAEAVEVTYDPAKVSYDDLLKIFWENHNPTQMNRQGPDVGAQYRSAIFFYSPEQEAKARASKEALEKSGRFSKPIVTQVVPAEPFYRAEEYHQQYLLKRGRTHCHI

SEQ ID NO: 8831 - protein, 214 aa, Zea mays
PAVPVRNSRVPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGRAVNFLTPANPIEKIEGAAKAGRELRFYNSEIHRAAFVLPTFVRRELEAYTPPSTSAENEKPKESVSEPQKIKILSNNAILTAS

SEQ ID NO: 8832 - protein, 723 aa, Prochlorococcus marinus
MQGQTQSISFDGREIRLTTGRYAPQAGGSVMMECGDTAVLVTATRSTGREGIDFLPLICDYEERLYAAGRIPGSFMRREGRPPERATLIARLIDRPMRPLFPSWMRDDLQIVATCLSLDERVPADVLAVTGASMATLLASIPFQGPMAAVRVGLLGDDFVLNPSYREIERGDLDLVVAGTPDGVVMVEAGANQLPQGDVIEAIDFGYEAVCELIKAQQTILKDAGIKQVQPEPPTQDQDTKLSTYLEKNCSKSIGEVLKQFEQTKAERDSKLDAIKAKTAEAIDSLKEDDAVRKSVNANSKVLSNNFKALTKKLMREQIIKQGKRVDGRKLDEVRPISSAAGVLPKRVHGSGLFQRGLTQVLSTATLGTPSDAQEMDDLNPGPEKTYLHHYNFPPYSVGETRPMRSPGRREVGHGSLAERAIIPVLPPKDSFPYVLRVVSEVLSSNGSTSMGSVCGSTLALMDAGVPLKAPVSGAAMGLIKEDAEIRILTDIQGIEDFLGDMDFKVAGTKDGITALQMDMKITGLPVKTIAEAVNQARPARIHILEKMLEAIDAPRTTLSPHAPRLLSFRIDPELIGTVIGPGGRTIKGITERTNTKIDIEDGGIVTIASHDGAAAEAAQRIIEGLTRKVNEGEVFTGTITRIIPIGAFVEILPGKEGMIHISQLSEARVEKVDDVVKVGDQVTVRIREIDNRGRINLTLRGVPQNGEETQSEPAPTPVAPLN

SEQ ID NO: 8833 - protein, 146 aa, Rhodospirillum rubrum
MRFLHTMVRVADLDASLDFYCAKLGLREISRQDNEKGRFTLVFLAAPADEETARETKAPLVELTYNWDPEVYTGGRNFGHLAYKVDDIYATCQKLMDAGVTINRPPRDGNMAFIRSPDGISIELLQEGAPLAPAEPWASMANTGSW

SEQ ID NO: 8834 - protein, 437 aa, Haemophilus influenzae
MEILMKSGDLNKYDLVKNTLVLVLAGGRGSRLHELTDKRAKPALYFGGNRRIIDFALSNCINSGLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTIGCIEVPRSEAHEFGVMAVNENLKVKAFVEKPKDPPAMVGKPDVSLTSMGIYVFDADYLYKMLDREVGTPNTSHDFGKDVLPKCLEEGALYAHPFSRSCMGRNTEGEIYWRDVGTLDSFWQSNIDLVSENPQLDIYDQSWPIRGNPVQAYPSKFFYKHSNVHPVDNSLIGGGCVITDASISNSVLFDRIKIDSFSKVDHCVVLPQVKIGKNCVLKNCIIDRECEIPDGMQIGVDMEEDKNRFRISSTGKVILVTPKMLKILEGHEIGEEGHLD

SEQ ID NO: 8835 - protein, 444 aa, Oryza sativa
MDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASDSLGYRFDLLLPGVDHAVPLAESSIAASKGGKFAIDLTSMQPQSRGGTPGCSPRGSGDFSQWPLSSYSYRGFVMSSSVQGEGRCSKPTVEVGVPHVGCAEDAAAFVALAAAVDLSMDACRLFSHKLRKELSHLRSDVLR

SEQ ID NO: 8836 - protein, 347 aa, Oryza sativa
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGGAAVAPAKSVAAAPVNNKPAAKKEKRAADVDRSLPFKKRCKMVDHVAAAVAATKPTAAGEVVAAAPKDQDHVIVVGGENAAATSMPAQNPISKAAAASPAFFHGLPRDEITDAAMLLMTLSCGLVHS

SEQ ID NO: 8837 - protein, 435 aa, Yarrowia lipolytica
MEIAQKAHLAATVLKTVSNDDRTATLKMVHDALREAKDEVIAANVKDLDAAKSANLSPSLIKRLDLSTGDKYDSMLQGILDVASLDDPVGKVTLARKLDDNLELYRLTCPVGVLLVIFEARPEVIANITALAIKSGNAAILKGGKESLHSFTAIAKAVTKALEKSKVPPGAIQLIATRDEVSSLLSQDQYIDLVIPRGSNELVKHIKDNTKIPVMGHADGICAIYVDQDANAKMAADIVVDAKTNYPAGCNSVETLLINEKVISDKWPTVASALVDANVEIRATPELIEALPADLKSHCKTATEEDFKTEFLAHIIAAKSVPTVEDAMAHINSHGSSHTDCIITDNETTAGKFLKGIDSAGVYWNASTRFADGFRYGFGTEVGVSTNKIHARGPVGLEGLVNYQYILKGNGQIAASYLGAGGDKPFKHEDLPLEN

SEQ ID NO: 8838 - protein, 435 aa, Leptospira interrogans
MSETPIVSNHDLGKYVDQKVVIQGWVHGIRGSNARQFLSLRNSGKILQVLAEKEILGEEVFQTVKHLRQETSVTVIGNLVKNEKSPIGFELVMESIQIVGESENYPITPKEHGIDFLISQRHLWLRSSKQLAILRVRDNLSFAIRKYFHERDFLLIDTPILTGSVGESAGTLFSTEYFDLGNAYLAQTGQLYLETAIFAHNKVFCYGPTFRAEKSKTRRHLTEFWMVEAEVAFATHAENLKLQEDFVKTVIKETVQNSFQDLKVLERDPAPLLAYLEKDFPVIDYTKALEILQSKGEDIVWGDDINSEREQILTVEFGGPVFIQKYPREAKAFYMKVNPEDPRTVLNADLIAPDGVGEIIGGSEREENYENIVQRLKEEKLPVESYDWYLDLRKYGSVPHSGFGLGSERLIAWICGLAHVRECIPFPRMMERLYP

SEQ ID NO: 8839 - protein, 403 aa, Listeria innocua
MSSTKSFINTKTLLFGLISVFLCGMGFSIIMPVVPFLIAPYVSNSSEQALMVTLLTSVYALCVFFAAPGLGALSDRFGRRPVLLICFIGSAIGYFVFGLGGALWVLFLGRIIEGITGGSISTLFAFFADITPEEQRTKYFGWVSAAAGAGAALGPAFGGVIAHFGYAMPFFFGAAITFINLVFGYFYMPETLKEENRLKRIPLIRLNPFSQLLNILTIKHLGRLLIAAFLIWIPNGSLQAVMSQFAIDNFSWKPALIGLMFSIMGVQDILSQAFVMPKLLLRLSDKQIAILGMIAEIIGYALIAASSIFILPQLLVIGMFVFGFGDSIFNPAFNGMVSKSASASEQGRIQGGSQAIQSLARIIGPIIGGQIYITLGHAAPAVMGVILITVAIFILYKRTRPQI

SEQ ID NO: 8840 - protein, 136 aa, Actinobacillus pleuropneumoniae
MAHDSCKQSLIQWTLQHKASLTPHTLYATGTTGHLLARESGLNIQALLSGPMGGDQQLGGLIAEKKIDILIFFWDPMNAAPHDPDVKALMRIATVWNIPVAINETSANFLLSAALFDQEIGINVPDYDGYLAERLA

SEQ ID NO: 8841 - protein, 1029 aa, Oryza sativa
MHLRLLLLLVGVAAAAADADADADALLAAKAAMSDPTGALASWGGNGTRTNTTAAAAAHCAWAGVTCSSRGAVVGLDVSGLNLSGALPAELTGLRGLMRLSVGANAFSGPIPASLGRLQFLTYLNLSNNAFNGSFPAALARLRGLRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRGDIPDFVGDLPSLEVLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVSGAAAPNLGEISLSNNQLTGALPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENIIGKGGAGIVYKGAMPNGDHVAVKRLPAMGRGSSHDHGFSAEIQTLGRIRHRHIVRLLGFCSNNETNLLVYEYMPNGSLGELLHGKKGGHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPVGEFGDGVDIVQWVRMMTDSNKEQVMKVLDPRLSTVPLHEVMHVFYVALLCIEEQSVQRPTMREVVQILSELPKLAPRQGEVLSHAVDGFASNPPAPVPSGSAEALTGDAKDQQQQQTNSESTTPPDLISI

SEQ ID NO: 8842 - protein, 555 aa, Ashbya gossypii
MATTNTFSDFKLASELPAWAKLQELYEKKGKTLSLKEAFATDEQRFQKYSRTFSNHDGSKILFDFSKNLVDDEILGALAQLAREANVTQLRDQMFNGEHINSTEDRAVYHVALRNRANKPMYVDGKNVAPEVDAVLQHMKEFSEQVRSGAWKGYTGKSIKDVVNIGIGGSDLGPVMVTEALKHYAGPLKVHFVSNIDGTHLAETLKEVDPETTLFLVASKTFTTAETITNATSAKNWFLSKTGNNPAHISKHFAALSTNETEVAKFGIDTKNMFGFESWVGGRYSVWSAIGLSVALYIGFDQFEDFLKGAEAVDKHFTSTPIEDNIPLLGGLLSVWYNNFFDAQTHLVVPFDQYLHRFPAYLQQLSMESNGKSVTRGNVFANYSTGSILFGEPATNAQHSFFQLVHQGTKVIPSDFILAAQSHNPIENNLHQKMLASNFFAQAEALMVGKDEAQVKAEGATGGLVPHKVFSGNRPTTSILVQKITPANLGALIAYYEHVTFTEGAIWNINSFDQWGVELGKVLAKVIGKDLDTTGETTSHDASTNGLINQFKAWL

SEQ ID NO: 8843 - protein, 378 aa, Clostridium perfringens
MSENLTMSELMDSFELKHFHKGEIVKGKVISVKNDEIIVNIGHFADGVVPRNEISNDKNFDINSINVDDDIFVMVLSGDDGEGNVLLSKKRADAIKVWDDLKEAFEEEKSIKVSLKEVVKGGIVGDFNGLRVFMPASQCAGRRIENLEELVGKTLEVRVIEFNKENRKVVVSRRVIDEEIRNNEKKALWSSIKEGEKRKGKVTRLAKFGAFVDIGGVEGLVHLSDMSWSRVHKPEEVVSVGDEVEVFVSEVDMDRERIALSLKDVIKNPWETLEGLKVGDVVSGKVTNFIKVGAFVEVLPGIEGLVHISEITDENIAKPSDILELGQEVKVKILNIDDENKKMSLSIKDAVETSNEYMQYNDEEEGYSLADLFKGLNL

SEQ ID NO: 8844 - protein, 423 aa, Arabidopsis thaliana
MDEVSPAVAVPFRPFTDPHAGLRGYCNGESRVTLPESSCSGDGAMKDSSFEINTRQDSLTSSSSAMAGVDISAGDEINGSDEFDPRSMNQSEKKVLSRTESRSLFEFKCVPLYGVTSICGRRPEMEDSVSTIPRFLQVSSSSLLDGRVTNGFNPHLSAHFFGVYDGHGGSQVANYCRERMHLALTEEIVKEKPEFCDGDTWQEKWKKALFNSFMRVDSEIETVAHAPETVGSTSVVAVVFPTHIFVANCGDSRAVLCRGKTPLALSVDHKPDRDDEAARIEAAGGKVIRWNGARVFGVLAMSRSIGDRYLKPSVIPDPEVTSVRRVKEDDCLILASDGLWDVMTNEEVCDLARKRILLWHKKNAMAGEALLPAEKRGEGKDPAAMSAAEYLSKMALQKGSKDNISVVVVDLKGIRKFKSKSLN

SEQ ID NO: 8845 - protein, 373 aa, Desulfotalea psychrophila
MTIDYYETLSVERDADQGTIKKAYRKLAMKYHPDRNQGDKEAETLFKECTEAYEVLRDESKRRIYDTYGHEGLKNNGQRDTGGAGDIFSHFGDLFGFGGGGGRSQARRNGPIEGNDLRYDVSISFMESIQGVSKEVKLSRRETCWTCEGTGSRPGYQPQTCPTCNGRGQVLRSQGFFQVSTTCPECEGEGQVIKEPCNDCHGEGLVKKTKTVAIKIPAGVDTGARMRLRGEGEGGRRGGPSGDLFVIVHVSSHEFFERDGDTIYCRLPVSMTTAALGDTVDVPTVHGKKNLKIPAGSQSGERFTLRGEGVPSLRGRGNGDMVVELHVETPTGLCEEQKKMLRDFHSFCEEHGQHEKTKGFFAKLFDEVLGKNK

SEQ ID NO: 8846 - protein, 236 aa, Coffea arabica
MTRRYWNINLEEMMEAGVHFGHGTRKWNPKMEPYISAKRKGIHITNLTRTARFLSEACDLVFDAGSRGKQFLIVGTKNKAADSVAWAAIRARCHYVNKKWLGGMLTNWSTTETRLHKFRDLRMEQKTGRLNRLPKRDAAMLKRQLSRLQTYLGGIKYMTGLPDIVIIIDQHEEYTALRECITLGIPTICLIDTNCDPDLADISIPANDDAISSIRLILNKLVFAICEGRSSYIRNP

SEQ ID NO: 8847 - protein, 361 aa, Aspergillus nidulans
MLLPKQMFIYAIYPTNSVDYHAVVLISLISPPLHPIYVQFLISGGASYPIALVLHSGQFCPGHAKDSLEEVIQLAIAKNFQVFCLTEHMPRGEQDYYPEEIEANQTKAWMIANEANYFREATRLREKYADQIKILIGFECDWIRPESRTLVETSMRAFPFEFFMGSIHHTKTIPIDYDREMYEKARDLAGGSDEKLFEAFFDEQLDMLKQLKPVVVGHFDLIRLKSDDPERSFKQWPGVWERILRNLDYVAGYGGILELNSAALRKGMSEPYPKAEICQEFLARGGRFCFSDDSHGLDQIGLNYARMLEFIETNTDIKTLYYLDLGNEPETQTPVDSRFPRTVVKSISMEEVKKMAFWQTN

SEQ ID NO: 8848 - protein, 320 aa, Borrelia burgdorferi
MLEFETIDINLTKKKNLSQKEVDFIEDVIIVGSGPAGLTAGIYSVMSNYKAAILEGPEPGGQLTTTTEVYNYPGFKNGISGRNLMLNMREQVVNLGAKTFPETVFSIKRKGNIFYLYTENYIYKSKAVIIAVGSKPKKLETLKNSGLFWNKGISVCAICDGHLFKGKRVAVIGGGNTALSESIYLSKLVDKVYLIVRKNNLRAIAMLRDSVAKLPNIEILYNSEAIEVDGKSSVSSVKIFNKKDNVVYELEVSAVFMAVGYKPNTEFLKGFLDLDEEGFIVTKDVVKTSVDGVFSCGDVSNKPYAQAITAAAEGLLHLLS

SEQ ID NO: 8849 - protein, 216 aa, Coprinopsis cinerea
MGRRPARCYRYCKNKPYPKSRYNRGVPDPKIRIFDLGRKRANVDEFPFCAHLVSDEYEQLSSEALEAARICANKYMTKTSGKDSFHLRVRVHPFHVLRINKMLSCAGADRLQTGMRGAWGKPYGTVARVNIGQVILSIRSRDNNAHVVMEALRRARYKFPGRQKIIVSKKWGFTNVNKEEYLKLKEEKRVLQDGAYVQFIRPKGNLEQNLRNQLRA

SEQ ID NO: 8850 - protein, 310 aa, Chlorobium tepidum
MATIANITNTIGRTPLVRLNKLAKGLDADILLKLEYFNPLGSVKDRIGRAMIEAAEAEGKIDARTLIVEPTSGNTGIALAFVCAQRGYRLLLTMPETMSIERRKLLRYLGAELVLTPGAQGMKGAIEEAARIVEAEKNSFNPGQFRNPANPLIHQATTGPEIWNDTEGRVDMLVSGVGTGGTITGTSRFIKALKPNFKSIAVEPKDSAVLSGGQPGPHKIQGIGAGFVPDVLDVSLLDEVVTVSNDDAISTARALASQEGILCGISSGAAVHAAIEVAKRSSSAGKTIVAIIPSTGERYLSTALFEDIEA

SEQ ID NO: 8851 - protein, 1023 aa, Unknown
  Arthrobacter sp. C2-2
MTTADVSYLTDQGPGSGRRVPARSWLHSDAPALSLNGDWRFRLLPAAPGTAGAGSVLPSGETVEGVAAESYDDAAWDTLPVPSHWVMGQDGKYGRPIYTNVQYPFPIDPPHVPDANPTGDFRRRFDVPAQWFESTTAALTLRFDGVESRYKVWVNGQEIGVGSGSRLAQEFDVSDALRAGSNLLVVRVHQWSAASYLEDQDQWWLPGIFRDVTLQARPAGGITDAWLRTGWSARSGAGTGTIDPEITADATAFPVTLSVPELGVNVTWKSAEEVAPLALENVEPWSAEVPRLYEASVSSAAESISVRLGFRTVRIVGDQFLVNGRRVVFHGVNRHETHPDRGRVFDEAGAREDLALMKRFNVNAIRTSHYPPHPRLLDLADEMGFWVILECDLETHGFEAGGWVENPSDVPAWRDALVDRMERTVERDKNHPSIVMWSLGNESGTGSNLAAMAAWAHARDSSRPVHYEGDYTGAYTDVYSRMYSSIPETDSIGRNDSHALLLGCDSAESARQRTKPFILCEYVHAMGNGPGAMDQYEALVDKYPRLHGGFVWEWRDHGIRTRTAEGMEFFAYGGDFGEVVHDSNFVMDGMVLSDSTPTPGLYEFKQIVSPIRLGLSLPAGGKPTLAVANLRHTADASDVVLRWRVEHDGAVAASGEVAAEGSDGPLRAGESATIALPAMPAAPLGETWLTVEAVLRDATGWAPAGHPLGAVQLDLSAPAVPTRSPRPATPLDGALPVSLGPATFDAGTLVSLAGQPVSGPRLELWRAPTDNDRGAGFGAYGPGDPWLNSGRGVPAPSSEAVWKQAGLDRLTRRVEDVAALPDGIRVRTRYAAADSTHSVAVEENWQLDGGELCLRIDITPSAGWNLVWPRIGVRWDLPTDVDGAAWFGAGPRESYPDSMHATVVARHAASLEELNVPYARPQETGHRSDVRWLELDRAGAPWLRIDAEPDAAGRRPGFSLARHTAQEIAAAGHPHELPTPSHSYLYVDAAQHGLGSRACGPDVWPDFALRPEARTLKLRISPA

SEQ ID NO: 8852 - protein, 280 aa, Debaryomyces hansenii
MSGLNSPPSYAPTSTSSYTPSNANHIKYHREIDKSAVIKSPLHKNIYDSLAEIYSIVTVMEMIEKSFLKDYITDKDKYTSTTLRLINQYQIIIKGFQEDQSKQTILADIVPGASVDSDDFSEKLANTYNLHAPLAIKRLQTGVPVTIEHLGTQVESSSHPTHNISNVNTSTNTKASGRLVAEVTGNFITCMDALKLNYKTKDQLHPLLSDLVVSLNDLVTMNDSNDENNGKTIEFPGKSKLISWLIKLNNLEDQELVQSDIDTFLNDLDLAYKNFYTSLE

SEQ ID NO: 8853 - protein, 532 aa, Prochlorococcus marinus
MAITDIFQLNNNDKWERYCDLLYSDDSLGFWLDISRMDVAINDFEDFNEIYSKAFDALESLENGSIANIDEGRQVGHYWLRNPKVAPSAEISDSITKEIQNISKFGASILNGEITNRHGKKYTDVFWIGIGGSGLGPLLIKESFKRESIGLNLHFLDNVDPEGISHKLNSILPNLDSTLFVVVSKSGGTPEPLIGMEQAMKFVLDHSQNWSSRAIAITSKGSKLDVLANNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKEAATKIIKLQKEIEELLDDGKQRTLNEINDALSSDSTESIYLILRKLSENSDHYSMIGNQSNPDKLIISKT

SEQ ID NO: 8854 - protein, 661 aa, Vibrio vulnificus
MTTSLARPYPLGATLHDKGCNFAVHSPDCASIRLALFDDNNEFKTFELCEEYAGIRYTFVENVQHGQKYGFIIDTDNGPLLLSDPYAKALDGPLHYQTPYSAEKSFSMPKCVVYQDDFDWQGTESPRIPREEMVLFETHVKGLSKLNPEVPPAAQGRYLGLVSDAMLAFYRQQNINTLQLLPVAACMHEPHLLDMGKVNYWGYNPYLFMVPDPRYADKDAILELKTAIRELHRNGIQVILDVVYNHTAEGGAGPTIFNLKGLDSRCYFKHGTHFANFTGCGNTVDLTYQPALNLVMDTLRYWISEFKVDGFRFDLAATLGRQGDDYSRDAAFFKAVAQDPVLKETKLIAEPWDIGPNGYQVGNFPFGWNECNDKLRDITRSFWRGDQGYLKEFATRLMGSRDIYSAANWPYKLTVNYITYHDGFTMQDLVSYKHKHNEDNGEQNRDGHGDNRSENYGAEGPTENLMIIATREKQKRNFMASLLFAFGIPHILTADVLSHSQKGNNNAYCQDNETSWLNWEHSERKHDFRHWLAQMVENRQRYMVPFIRAFSGPSRNLNRIYWRRVDGVHMEHDDWNRLSAVSLHIGIGEKGDEMVYLINQTSAPARFTLPDDNQQQWTYICDTNVRNVSPELAQGEVLLSPVSMAILHYHPQESTPPTAAV

SEQ ID NO: 8855 - protein, 919 aa, Neisseria gonorrhoeae
MKRMLFNATQAEELRVAIVDGQNLLDLDIETLGKEQRKGNIYKGIITRIEPSLEACFVDYGTDRHGFLPFKEVSRSYFLGYEGGRARIQDVLKEGMEVIVQVEKDERGNKGAALTTFISLAGRYLVLMPNNPRGGGVSRRIEGEERQELKAAMAQLDIPNGMSIIARTAGIGRSAEELEWDLNYLKQLWQAIEEAGKAHHDPYLLFMESSLLIRAIRDYFRPDIGEILVDNQEVYDQVAEFMSYVMPGNAGRLKLYEDHTPLFSRFQIEHQIESAFSRSVSLPSGGAIVIDHTEALVSIDVNSARATRGADIEDTAFKTNMEAAEEVARQMRLRDLGGLVVIDFIDMENPKHQRDVENVLRDALKKDRARVQMGKLSRFGLLELSRQRLKPALGESSHAACPRCAGTGVIRGIESTALHVLRMVQEEAMKDNTGEVRAQVPVDVATFLLNEKRAELFAMEERLDVNVVLIPNIHLENPHYEINRIRTDDVEEDGEPSYKRVAEPEEDESAKPFGGEKAKAARPEPAVKGVRHTSPAPTAAPEKKTSWWDSFKAWLKRIFGGSETQAVPAAETSEKRSTANRSGSRANNRRQNPRRSKREGSKIEVREAAGKTAGQKARADKAETRNNGNRRRNERGDRATERANEAEIQSRNVQPAAPVADAAPPETEGQTGKRRRNGSRNERGQTAPETAAVAETAVQTAENTPPEPYTAEDKGSKPKSERNRRERDSRDAKERRERNNQRDRRQNGKKRNIPSAAKIEQYLNIHDTADKVRSAAAHVFGETDANAPITVSIADPLIATPVQTASSAVSNGDALIYDAAEKIRRAAADILPEGAAPKAAAQEMPSETATFTAAAEQARETAQTGGLVLIETDPAALKAWAAQPEVQAGRGLRRSEQPKPSEAATVPAEEMIQVETRQG

SEQ ID NO: 8856 - protein, 483 aa, Thiobacillus denitrificans
MSEEILVNVTPQETRVAVLHLGAVQELHIERAKCRGLVSNIYMGRVVRVLPGMQSAFIDIGLERAAFLHVADIWEERHNGETERPIEQILHEGQNLMVQVIKDPIGTKGARLSTQISFAGRYLVYLPQETHIGISQKIEGEEEREQLRQKLHQLIPQDATGGFIVRTMAETAEDAEMLADIDYLRRLWSSIQSRGNCVVPCLLYQDLDLSLRVLRDFVNRDTTRILIDSRETYQRMAEFAQNYTHAVLDKLQHYGADRPLFDLHAIEDEIAKALGRRVDLKSGGYLIIDQTEALTTVDVNTGGFVGARNFDDTIFKTNLEAAQAIARQLRLRNLGGIIIIDFIDMDNVEHQDAVLTELKKALTRDPTRTTVSGFSTLGLVEMTRKRTRESLAHVLCEPCPTCAGRGEIKTAQTVCYDVLREILREARQFDAREYRILAAQSVIDLFLDEESGSLAQLIDFIGKPVSLQVETTYPQEQYDIILL

SEQ ID NO: 8857 - protein, 55 aa, Arabidopsis thaliana
AEGNEKGPIFSFRGVDNSVYYMLAPKGEFYNYSDCGNTFNCNHPVVRQFILDCLR

SEQ ID NO: 8858 - protein, 465 aa, Solanum lycopersicum
MGSGAIDDSSKFDDDGRPKRTGTVLTTSAHIITAVIGSGVLSLAWATAQLGWIAGPVALIAFSAITWFASILLADCYRAPDGSRSYTYMDAVRAHLGGRKVQLCGLAQYSNLFGVTIGYAITTSISMVAIKRSNCFHRKGHDAGCHESNNPFIIIFGVMQILLSQIPNFHKLSFLSIIAAAMSFAYSFIGLGLSIAKIAKDGVSANTSLTGTIVGKDVSSRDKMWNTFSALGDIAFAYAFSIVLIEIQDTLKSHPPENKSMKKATFTGISVSTIFYLLCGLLGYAAFGNKAPGNFLTGFGFYEPFWLIDFANVCIVIHLVGAYQVFCQPIFGFVEGWSRQKWPESKFITKEYMINLSHLGLFNFNFYRLVWRTLYVVFTTILAMLFPFFNDFVGFIGAASFWPLTVYFPIQMYIAQAKIPKYSFTWIWLNILSFVCLIISLLAAAGSVRGLIKSLQEFEPFQSRS

SEQ ID NO: 8859 - protein, 603 aa, Unknown
  Silicibacter sp. TM1040
MLERSELADNALQALHDEDYDRPFNTQNLNADTLIFTRGRQGQSLDGDWNFCVDLLDTGLRQKWFAMTPETPADRVEPWDYDPYMGDTVPVPSCWQMQKEKWYFFEGSAWYTRPLTHTPTPERRQVLRIGAAQYDCKVFLNGAFLGNHYGGSTPFCVELTEALKPGQNWLMLCVNNTRTLDRVPMRNTDWFNYGGVYREVTLYDLPSVVIRDLFVRLEGNAIRVSAEVDGECASAQLLIPELGIDVELPLIAGKGDLTLPASPELWSPDNPKLYDVSLTAGEDQVRDRVGFRSISREGTEILLNGTPLFLRGISVHEDDATQGKVTSETDIRRRFAHAKELGCNFLRLAHYPHHERASEIADEMGLMLWEEVPVYWAIDFANPATRRDAENQLRELIRRDRNRASVIIWSVGNENPDTDARLDFMRGLADLAKTEDPTRLTSAACLVNHTKLKIEDRLAEYIDIIGLNEYYGWYEENFDELNEIGRNSAPDRPVVISETGADGDSTEQGPERGLFSLAYQDEVYAKQIATLRTLDYVKGMSPWILYDFRVERRQGIFQRGWNRKGLIAGDKATKKPAFHRLAAYYAERAAVEHQPPFAPEETA

SEQ ID NO: 8860 - protein, 315 aa, Oryza sativa
MSSWLFRRSGPSGFSWASTADQVTAGLSAAGLTAIVTGASSGIGAETARVLAIRGAHVVMAVRNLAAAQPVRDAILADAPAASLDLMELDLASMDSVRAFASDFAAKGLPLNILINNAGVMATPFSLSKDGIELQFATNHVGHFLLTHLLLETMKKTSRESNVEGRIVNVSSEGHRFAYREGIRFAKINDESEYNSIGAYGQSKLANILHANELARRFKDEGVNITANSLHPGSIITNLLRHHSILDVLHRTLGKLVLKNAQQGAATTCYVALHPQVKGVSGKYFSDSNVNEASEKGNDMELAKRLWEYSIELIT

SEQ ID NO: 8861 - protein, 287 aa, Tropheryma whipplei
MFWRGGLPLVTIRNLLDNGVHFGHTTQRWNPKMKGFILTERCGSYILDMRETIRGIVTAVDFIRDTVARGGEVLFIGTKRQAQQVIFKQASRVGQHYIAHRWLGGLLTNFSTVSKSLVRMKELEEARLDDSVSTKKEQLIRGRELQKLRRSLGGIRNMTKLPALLWVVDTNREGIAVEEARKLGIPVVAILDSNCDPDLVQFPIPGNDDSIRSIELLTGIVADAVAQGLVERHKAPQDDIEPMAEWEKQLLQSGDSSGETRPISGTDRPLDGDLSKGPAPQDEELSD

SEQ ID NO: 8862 - protein, 336 aa, Actinobacillus pleuropneumoniae
MSEMYSAPVTVLGAGSYGTALAIALARNGHKTYLWGHQPEKMAVLATERMNNAFLPDIAFPDALEIESDLVQAIAKAKDILIVVPSHVFADVLKQIKPLLSAHHRIMWATKGLERNTGRLLQTVAQEILGNQYPLAVLSGPTFAKELAQGLPTAIALSSTDSQFADEMQQRIHCAKAFRVYLNNDMIGVQLGGAIKNVIAIGAGISDGMGFGANARTALITRGLAEISRLGASLGANANTFMGMAGLGDLVLTCTDNQSRNRRFGLMLGQGKSAEEAMAEIGQVVEGFYNTKEAYLLAQTQGVEMPIVEQIYQMLFCGKNAHDVATSLLGRERKGE

SEQ ID NO: 8863 - protein, 180 aa, Mesorhizobium loti
MPIVRDKDIEVLFSASAIARRNLELAKEIAGHDYHDLLVISVLKGSFIFAADLIRAMHDVGLSPEVEFIFISSYGAGTTSGEVRVLRDIDNEVAGRDVLLIDDILESGKTLTFTRDLMLSRGAKSCSIAVLLDKRMRRQTALVADYVGFDCPDYFVVGYGMDVAHAFRELPFVGVVKGDA

SEQ ID NO: 8864 - protein, 549 aa, Mycoplasma mobile
MKLLKWQDKIIYQIFPRSFFDTSNDGNGDIKGIIKKLNYLSWLGVDALWLCPVYETEFADAGYDVLDYYKVWEKFGTLKDFKTLIKKAKELNIEIIMDIVLNHTSTSHEWFKKAIEDPTSKEFNYYIWQDKATDEKSIFGSSAWEYVPSIKKYYFHLFSISQADLNWENPATIDAMADVINYWYTLGVKGFRLDAIQHIHKDFSEKDTSFFSFGKKMTSLLQDLKSKIDKEDIFLIGESSGIQPELIPNWTEGKNKIVDNFFNFSWWWIGWNQISGRNGYNPDWSFKDFYSKQFIEYQESNKILDNAFTVFWSNHDTSRALSRWGNENIFWEESAKTLALFQFTLKGLMCIYYGEEIGMLNTFFDSKEELRDVDAINSFSFWVDEKKYYTENEMLRAHNINSRDNTRTPMLWDEKQVNFGFSKAKNTWIKLNQNSKNTSVEKQIKNPNSILNFYRKLIQLRKDSKFKNILLFGTSKVQTFNNFEVSSITREFNGEKIISYINLSSHSHSIVFPKNAEIILSSYSEQPFKIDYLRAYESIMFYTNEKKND

SEQ ID NO: 8865 - protein, 179 aa, Haemophilus ducreyi
MKKHHIESLISRKEVQTRIAELAEQINNHYQQTNCQNLVVVGLLRGSFMFMADLVRLIDIPVEVDFMTVSSYGSSTESSRDVKILKDLEGEINGKDVLIVEDIIDTGFTLNKVRDILRLRDPRSVSICTLLDKPSRREVAVPVEWVGFAIPDEFVVGYGIDYAQKYRNLDFIGKVVMDE

SEQ ID NO: 8866 - protein, 758 aa, Desulfitobacterium hafniense
MEFSRRNFLKTCAISAAMMTVGCTSQTKTIQVDPPEPAPSAPKQIDVDQWVKSVCRYCGTGCGVLIGVKDGKVAAVKGDPDNEGNKGLLCAKGYYLPQVITHSERVTKPLIRKNGKLEPCTWDEAMELVTAKFKESIANNGPDSVAFYGSGQQLAEEGYVANKLFKGAIGTNNIDGNPRLCMASAVGGFTTTFGADEPMGCLEDFEHANVFFIIGSNIAEAHPVLFGRLTDKKKKDPDTKIIIADPRRHRSHEIADISLQFVPGTDMALLHAMAYVIIEEGMADEEFIAKHTSFSNGKEAITFEAYKEFLKEFTPEKAEKVTGLPAAQIQEVARLFGEKGKNTMSMWTMGINQRVAGVWANNLIHNLHLLTGKICKPGSTPFSLTGQPSACGSVRETGALSHLLPGHRVIANEKHRKEVAELWGVPADRISPQAGLHTMELFKACGDGRVKCLYVMCTNPAHSLPNVNAYQEGFEKVFLVVAEAFHPTATTKYADVVLPAAFWCEKEGVYGNTDRRTQHLAKAINPPGEAKPDLDILLDLAQRLGYGELFPFKTPEDVWNEYLKCTTGTHMELATYPALREAHGIQWPVKDHQGNKGAVRRYVAPEDPYVKEGIDFYSAKDHKAVIFARPYLGPAEVVDEEYPYYLTTGRILEHWHTLTMTGKCPTLMRAVPKQYVELNPQDAAELGIKEGDTVRLVSRRGKVEIPVRVGKPGEPRPGLLFALWFEPDPLVNAVTIDAVDAASKEPEFKICAVKIEKV

SEQ ID NO: 8867 - protein, 381 aa, Mycoplasma mobile
MVKKEMIAMILAGGQGTRLKNLTKKIAKPAVPFGAKYRIIDFTLSNCINSGIDTVGVLTQYRPLSLLKHIGSGIPFDLNRLNGGVVLLSPYVKESEGYWYAGTAHAIFENIDFMNEYDPTYALILSGDHIYKMDYSKMLDFHKEKNANVTIATINVSFEEASRFGILNTNENNMVEEFEEKPKIPKSTKASMGVYIFNYQLLKDTFEELKSKGNNFQDFGHNILPYILKKYSKIFAYEFNGYWKDVGTISTFYEANLDLIKNHKNLDLREKNWTIFTKSSSHSPQYITSGGNVVNSLVANGAKIEGHVSNSVIFENVKIGKNTIIEDSVIMSNAIIGENSFIKKTIIMENTVVKEKMVLNSLNNQSLNEEDGIILYDGKEK

SEQ ID NO: 8868 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKENKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 8869 - protein, 722 aa, Mycoplasma mobile
MNKTALLDLYNPHDLEAFLDDFNEIVIKAPKNFYTHNDSFSLENINTNEKLNNLQIAYIDDKNTFSYLHLFIKSNFIDFKNYYKIIGKYNYEIALKFGQIIKKEIFDEIFFYSGNDLGPTYSKQSTTFKVWSPTSYKLRLKIKKSFNDIAEYFDMERQEKGIWQITISRDLESYLYQYEVENNFITSETIDPYAKASTANGKYSYVINLDLLEKYNFVYKSKLANKTDRIIYEISIRDFTDSNEFKYPGKYLGLTEEGIKNKDGFSIGIDHIKNLGINTVQIMPFYDFATVDEERDVENQYNWGYDPLQWMVPEGSYSTNSYDPYLRLIETKKMINNFHKNDIDVVMDVVFNHVYDAFSFSWHILAPHYFYRYNTDLSLSNMSGTGNDVASEKKMVRKYIVDVVKHWQETFKIDGLRFDLMGLLDIETILEVDENTKNNNSNFIIYGEGWVMNSESTKKILANMENSRFLANIGFFNDYFRDVFKGNQWNVYSKSFSAGDWQQGHKALNSITGSLGLYEYAKKFNFLSQSVNYVECHDNYTLFDFFKIKLSSFSDFTIKKIHALTTAITLISQGIPFIHAGQEIFRTKYNVENSYNFPIEINRFEWNKLKENYWNVELIKKIIEIRKKYNLFRLETIQLVKEHVKIFVGNNSLIYYLLEDSDYSIQVNININQNDIEIDLDSNFWTCILNSQNLENNEIKNNKILIEAHGFYIFIKNKKKVK

SEQ ID NO: 8870 - protein, 458 aa, Prochlorococcus marinus
MEMIKKEENIENLVIIGSGPAGYTAAIYAARANLQPLLVTGFNSGGIPGGQLMTTTFVENFPGFPDGVLGPELMDLMKAQAERWGTNLYESDVISIDTSKRPFELKTLEGIIKTNSIIIATGASANRLGVINEDKFWSKGISACAICDGATPQFRNEELAVIGGGDSACEEAAYLTKYGSKVHLLVRSEKLRASAAMIDRVKGNSKIEIHWNTKVEKAIGTDWLDKIEAINTEKGYVEIKVKGLFYAIGHTPNTKFLDNKIELDKKGYIACKSGRPETSIDGIYAAGDVVDSEWRQGVTAAGTGCMAALAAERWLAEKNLSKIIIREKAEPEKTLPSSSFNEEETDENTFDLNSKWQKGSYALRKLYHESNKPILVIFSSPSCGPCHVLKPQLKRVINEFDGAVQGIEIDIDKDQEIAKQAGINGTPTIQLFKEKLLKKQWQGVKQRSEFKEAIQNII

SEQ ID NO: 8871 - protein, 339 aa, Hordeum vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGERYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLRSIEHRAMTNSVLARTSVATFIMPTQECLIGPAKEFLSEENPPCYRTIMFRDFMRIYNVVKLGSSLNLTTNLKNVQKEI

SEQ ID NO: 8872 - protein, 701 aa, Pseudomonas fluorescens
MNPVIKKFQFGQSTVTLETGRIARQASGAVLVTVDDDVSVLVTVVGAKQADPGKGFFPLSVHYQEKTYAAGKIPGGFFKREGRPSEKETLTSRLIDRPIRPLFPEGFMNEVQVVCTVVSTSKKTDPDIAAMIGTSAALAISGIPFDGPIGAARVAFHESTGYLLNPTYEQQAASSLDMVVAGTSDAVLMVESEAKELTEDQMLGAVLFAHDEFQVVINAVKELAAEAAKPTWTWAPAPEATELLAAIRSEFGEAISQAYTITIKADRYARLGELRDQVVAKLSGEEGQPSAADVKAAFGEIEYRTVRENIVNGKPRIDGRDTRTVRPLNIEVGVLPKTHGSALFTRGETQALVVATLGTARDAQLLDTLEGEKKDPFMLHYNFPPFSVGECGRMGGAGRREIGHGRLARRSVSAMLPAADVFPYTIRVVSEITESNGSSSMASVCGASLALMDAGVPMKAPVAGIAMGLVKEGEKFAVLTDILGDEDHLGDMDFKVAGTAKGVTALQMDIKIKGITEEIMEIALGQALEARLNILGQMNQIIGQSRTELSANAPTMIAMKIDTDKIRDVIGKGGATIRAICEETKASIDIEDDGSIKIFGETKEAAEAARQRVLGITAEAEIGKIYVGKVERIVDFGAFVNILPGKDGLVHISMLSDARVEKVTDILKEGQEVEVLVLDVDNRGRIKLSIKDVAAAKASGV

SEQ ID NO: 8873 - protein, 181 aa, Brassica napus
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 8874 - protein, 338 aa, Roseovarius nubinhibens
MHLARFPRRFIAHLPTPLERLDRLSAELGGPEIWIKRDDCTGLSTGGNKTRKLEFLMAEAELQGAEIVMTQGATQSNHARQTAAFAAKLGMKCHILLEDRTGSNEANYNHNGNVLLDHLHGATTEKRPGGGDMNAEMEKLADEWRADGKKVYTIPGGGSNPTGALGYVNCAFELLAQANDGGLKIDHIVHATGSAGTQAGLITGLKAMNAQIPLLGIGVRAPKPKQEENVYNLACATAEKLGCPGVVAREDVVANTDYVGQGYGIPTESGMEAIKMFAELESILLDPVYSAKGAAGFIDLIRKGHFKKGERVVFLHTGGAAALFGYDGAFDFSSRWVG

SEQ ID NO: 8875 - protein, 655 aa, Claviceps purpurea
MDSNGNRLHLDFGSNDRLPVNDRAYPTTPSTFPQPVLSPPTAQQQQQQQQQQQTCGGLQPPQQQPNGASGSASASTPASASTSAVGYAPQGYFSQPGAAQSANNEFAQNGYLQGRSNTPGTNDPNVGLAHQFSHQNLGGSVRSAPRGPPSSQRPRTAGSQPAGAYAGYSNSNAPPLPTQSGTSTVSEFRPAPERNPDRYGPNAMSNQKKCSQLAVDFFKDSVKRARERNQRQSELEQKLQDPTQSSVRKEQLWSTAGRKEGQYLRFLRTKDKPENYNTIKIIGKGAFGEVKLVQKKGDGKVYAMKSLIKTEMFKKDQLAHVRSERDILAESDSPWVVKLYTTFQDAYFLYMLMEFLPGGDLMTMLIKYEIFSEDITRFYIAEIVLAIEAVHKLGFIHRDIKPDNILLDRGGHVKLTDFGLSTGFHRLHDNNYYQQLLQGRSNRPRDRNSVAIDQINLTVSNRSQINDWRRSRRLLAYSTVGTPDYIAPEIFTGHGYTFDCDWWSLGTIMFECLVGWPPFCAEDSHDTYRKIVNWRQTLYFPDDITLGVEAENLIRNMVCNTENRLGRGGAHEIKNHPFFRGVEFDGLRRIRAPFEPRLTSNIDTTYFPTDEIDQTDNATVLKAQALQMGHPMEESPEMSLPFIGYTFKRFDNNFR

SEQ ID NO: 8876 - protein, 636 aa, Guillardia theta
MRRSVLSAAAVLSLSLSLLSLTPSNASTGVSSFSSSHRIPSLTRSALRLSKEGKGEDDKYGDPEAYVPQGGSKVTRNFMTCEDLRMSLRGGAGSDAIVPDQKLQIVFVSAEIAPWSVTGGLGAVCDGLPRALAKLGHRVMSIAPRYDQYYDAWDTEFTAEVPLGDTTTTVRFFHAFKKGVDRVFVDHPLFLEKVWGLSKQKLYGPKWGKDYEDNQLRFAMFCAAAMAATEKLSLGGYPYGQDVIFVANDWHAALVPMYLKKAQKEGTGWFKAKSACLLHNMVFQGRFPYDPNAASRLRLPQAMVDEMVTKQPLKVGRQKKASKGLKESVEIPNPPMDVLNFLTGAIKFSDAVLTVSPQYAKEVASSSAKGAELEKILTKTGIKGILNGVEDIVNPSNAELGLDIMYDGASLEKKAQGKTAMQKSLGFAVDENIPMFVFMGRLDAQKGVDIMFEAIDSALKGGMNAQFVTMGSGIEELEEVAAELEERYPNNFKAVLSFKGQEKYKTYAAADFAIMPSRYEPCGLVQMEGMRFGTLPIVCPTGGLLDTVSDMETGLVMEHEVDQDDITPADVEMLVKNFNRAISLYGNKDKYKQMQVNAMAAAKDYSWTRAAKQYVNTFLEIGGPNQLNMKDWFDII

SEQ ID NO: 8877 - protein, 155 aa, Glycine max
  misc_feature (41)..(41): Xaa can be any naturally occurring amino acid
  misc_feature (49)..(49): Xaa can be any naturally occurring amino acid
  misc_feature (56)..(56): Xaa can be any naturally occurring amino acid
  misc_feature (76)..(76): Xaa can be any naturally occurring amino acid
  misc_feature (86)..(86): Xaa can be any naturally occurring amino acid
  misc_feature (108)..(109): Xaa can be any naturally occurring amino acid
  misc_feature (123)..(123): Xaa can be any naturally occurring amino acid
  misc_feature (126)..(126): Xaa can be any naturally occurring amino acid
  misc_feature (129)..(129): Xaa can be any naturally occurring amino acid
  misc_feature (136)..(136): Xaa can be any naturally occurring amino acid
  misc_feature (139)..(139): Xaa can be any naturally occurring amino acid
MALASTSATASAAVLKNPFLGARRALANAASLGAAKPVTRXAWWVVAAXSARKSWXSPRSRSDAEFINPSWARWLXLPGDFGFDPXLGLARDPAFLKWYREAELIHGXXWRWPAVLGIFIGQXYAXVPXWFEAGAXPGXRWRPFSFGSLLGTRCV

SEQ ID NO: 8878 - protein, 572 aa, Arabidopsis thaliana
MADEIVPPATQLAAVSLENDGSTVQRAQFSNRVLIRTILDRPDGGAGLAGQTVRIGGWVKSGRDQGKRTFSFLAVNDGSCPANLQVMVDPSLYDVSNLVATGTCVTVDGVLKVPPKGKGTQQQIELNVVKVIDVGTVDASKYPLPKTKLTLETLRDVLHLRSRTNSISAVARIRNALAFATHSFFQEHSFLYIHTPIITTSDCEGAGEMFQATTLINYTERLEQDLIDNPPPTEADVEAARLIVIERGNVVAELKAAKASKEAITAAVAELKIAKETFAHIDERSRLRPGLPKKDGNIDYSKDFFGRQAFLTVSGQLQVETYACALSNVYTFGPTFRAENSHTSRHLAEFWMVEPEIAFADLEDDMNCAEAYVKYMCNWLLEKCYADMELMAKNFDSGCIDRLKLVASTPFGRITYTKAIELLEEAVAKGKEFDNNVEWGIDLASEHERYLTEVLFQKPLIVYNYPKGIKAFYMRLNDDEKTVAAMDVLVPKVGELIGGSQREERYDVIKKRIEEMGLPIEPYEWYLDLRRYGTVKHCGFGLGFERMILFATGLDNIRDVIPFPRYPGKADL

SEQ ID NO: 8879 - protein, 656 aa, Burkholderia cenocepacia
MCGIDGFLNSVAFDEETARGTLARMTASLAHRGPDGQGIWVDPEAGIALGHRRLAIVDLSVHGRQPMASACGRYVLVFNGEIYNHRELRAELERAGRAPAWRGHSDSEVLIAAIVAWGVEATLRRATGMFAFALWNRASRVLTLARDRIGEKPLYYGRIGDALVFASELKALRGYPGFDGTVDRDALCLYLRQSSVPAPYTIYRGIRKLPPGTYIQFEHARDTPRLRAYWTLEQVIEAGRAQPFEGTPDEAVGQLDAILRQAVARQMEADVPLGAFLSGGVDSSAIVALMQAQSATPVDTFTIGFHEAGYDEAGYAKAVARHLGTRHTELYVTADHALGVVPKLPSIYDEPFSDASQIPTFLVSELTRRHVKVSLSGDGGDELFGGYTRYFLTPRLWRKLHRVPGAVRARIAAALHALRPDHADQLAAVAQGAWGGGVEARESTSRIGDRLHKLGHVMTAESRIGLYRLLMSSVHHPERIALSGQEPPTPLDTVSAWPAHLSFAEQAMAIDTLTYLPTDILAKVDRAAMAVSLETRMPFLDHHVVEFAWRVPASVRLPEGQSKALLRRLLDRYVPSALIDRPKQGFCAPVDHWLRGALRDWAEALLRPSRLREEGFFDAAAVERLWRQHQTGRMNWQHQLWTVLMFQAWLEAQRAA

SEQ ID NO: 8880 - protein, 131 aa, Glycine max
  misc_feature (41)..(41): Xaa can be any naturally occurring amino acid
  misc_feature (70)..(70): Xaa can be any naturally occurring amino acid
PPQIVFSLPQQGVCGAFTQNPQHRKSFLKLTPHKVKKNFFXNKKNQSPIPLFLKFSKNTNFFKGKSPRFXNIRRGPPKTGFSFFKNKSLKGPRFFQFDYVKGRVLRAFPPPPKNQVLFFTPSKGPPEYCLN

SEQ ID NO: 8881 - protein, 426 aa, Thiobacillus denitrificans
MMDVKSYMQTLGRQAREASRAIARADTEQKNRALLTMAAAIRRDAARLLAANAQDMEHARAAGYDAALLDRLQLSEKTVAGMAEGLEQIAALPDPVGEIDGLKFRPSGIQVGKMRVPLGVIGIIYEARPNVTADAAALCLKSGNAAILRGGSEALRCNQAVAACVREGLEAAGLPAAVVQVVETTDRAAVGELITMKDYVDVIVPRGGKGLIERITGEARVPVIKHLHGNCHVYVDDRADLAKAVKIVENAKTQRYGTCNTTESLLVARAVAAAALPQIGAMLAGKGVEMRGCPESLAILQAAGVPADKLRPAVESDWYEEYLGPIIAVKVVDDLDAAMIHINTHGSQHTDAIVTEDYGRARRFLREVDSASVVVNASTRFADGFEYGLGAEIGISTDKIHARGPVGLEGLTSQKWVVLGDGHVRA

SEQ ID NO: 8882 - protein, 602 aa, Thiomicrospira crunogena
MCGICGEIYWDGQMASETKLVPMLAELEKRGPDDGGTWVQNHVGLGHRRLSIIDLSDGGHQPMLDDEISLVFNGCIYNYETLSAELIELGHEFRSHSDTEVILKAYRQWGMECVSRFEGMFAFAIWDDHQHQLLLARDRFGIKPLYYAPVEGGVRFASNTQALLASGGINTDIDPVGLHHQFTLHAVVPAPHTILKGIRKLEPGHWMIVNPDGQMYKKSYWHLEAKRPTADNAPQTEKEWIDAIHESLKQAVHKRLTAADVPVGVLLSGGLDSSLIVALLAEAGVEDIRTFSIGFEDVPEEKGSEFEYSDLVVEQYQTAHQKYLIPNETVLPRLTEAVDAMAEPMFGQDAIAFYLLSEKVSEDVKVVMSGQGADEVFAGYFWYPMMAKAAESLKDASRPVDAFAPYYFDRSHEEWLEMIEDEFHVYDVTSELINDRLSDKGADSYLDQVLRLDTTTLIVDDPVKRVDNMTMAWGLEARVPFLDHHLVELAMSAPTDLKLKDFKYILKKIARGIVPNEVIDRPKGYFPMPALKYVRGPFYEMMKSILTSPQAKARGIFKPAYIQKLLDHPEADESFTAIKGSKLWHAALLELWLQRHVDPYVQ

SEQ ID NO: 8883 - protein, 476 aa, Unknown
  Nostoc sp. PCC 7120
MTLQSFGVIGLAVMGENIALNVERNGFPIAVYNRSREKTDAFMAQRAGGRNVKAAFTLEEFVAALERPRKILVMVQAGKPVDAVIQQLKPLLDEGDIIIDGGNSWFEDTQRRTQELEPAGLRFLGMGVSGGEEGALNGPSLMPGGTQSSYEYLSPIFNKIAAQVDDGPCVTYVGPGGSGHYVKMVHNGIEYGDMQLIAEAYDLLKNAGGLNAKQLHEVFTEWNTTDELNSFLIEITANIFPYIDPETKLPLVDLIVDAAGQKGTGRWTVQTALELGVSIPTITAAVNARIISSIRDERIAASKQLTGPSGKYDGDTKEFINKVRDALYCSKICSYAQGMALLSTASATFNWNLNLSEMARIWKGGCIIRAGFLNKIKKAFNENPALPNLLLAPEFKQTILDRQAAWREVIITAAKLGIPVPAFSASLDYFDSYRRDRLPQNLTQAQRDYFGAHTYLRTDKAGAFHTEWVPIAEAKK

SEQ ID NO: 8884 - protein, 460 aa, Selaginella kraussiana
MELRGRRSTSQSPASTQDSTEVSMEQHLPPPRHPHPQQHEMGAMMVLMEESSNAHHHHLGSTSSMPPHQEQQQNPYRPSAAGEHQQQFFLPGMIKEESSPHHQQQQQNFLLPSSVFSMENICWPTNDQADLMESMSPESADLCRNLSSQLEHFRKEIGTYHGAESSSQQHHLVSSASGSSSGSYGVDKSLSVVPAVSLASDLLGSTSSQSSESEMLRAAIVSHPHYPELVVAHMNCHKVAASPEVVSQIDEIIQNFKDFQPPVAASLGANPELDQFMVAYYSMLLKCEKEVRKTFKEAVAFCKKLDQQFQVITNGSASSVTSVESDDRNEAYDSSEDEDSGAEVEIEVDPMAKDKELKEQLMRKYSGYISSLKHEFLKKKKKGKLPKDSRQILLNWWSVHYKWPYPSESEKASLAESTGLDQKQINNWFINQRKRHWKPSDELTALSGQPSQSTEASSGS

SEQ ID NO: 8885 - protein, 715 aa, Escherichia coli
  misc_feature (140)..(140): Xaa can be any naturally occurring amino acid
  misc_feature (382)..(382): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYXISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 8886 - protein, 487 aa, Oryza sativa
MGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 8887 - protein, 315 aa, Selaginella kraussiana
MTSAAASSSSKFTAPASTMDEWYMLSSYQSLIDANEGLEHAAGALEHHQQQQSSSSKQKSSLQLSEKEMKAAISGHPQYLELIKAHMSIKKVGASSQKVAEINEVIRMHQDSQPSSVHTNIGANPELDQFMVAYCDVLNMYENQLNKAFTGAIEYCKQQEQELKLVSVSDEPIDALSSVELDDDVEDDEEAESDDVAADGGDIDPLIGDKEIKRALMKKYGGYLGGLTQEYLKKKKKSKLPSAATKTLRDWWFQHLEHPYPSEAQKATLAATTKLDPKQINNWFINQRKRHWDPSAAAASARGESLQQQGSQDGD

SEQ ID NO: 8888 - protein, 363 aa, Oryza sativa
MEEISHHFGVVGASGVHGGHQHQHQHHHHPWGSSLSAIVAPPPPPQLQQQQTQAGGMAHTPLTLNTAAAAVGNPVLQLANGSLLDACGKAKEASASASYAPDVEAIKAKIISHPHYSSLLAAYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 8889 - protein, 704 aa, Prochlorococcus marinus
MPNAFCLAADTAVSKMHLGTPWPLGSTITTRGVNFSVAAPTAKRVELLLFADANATQPEHILKLQPCHRSGDYWHVEVEGLQTGCCYGYRIFGPHNPGSDSFHPSKVLLDPCTRAISGWDIYQREQAKGSSPNIQACLKGVVCEREHFDFASHPRPRTPWDRSVIYELHVGGFSSGPKSEVTPQRQGTFLGLIDKLPYLRKLGITAIELLPIFAFDPSDAPTGRDNYWGYSPLNWFTPHPKYVHGDDPLQARQQVRELVAACHDEGIEVILDVVYNHTTEGSIDGPTLSWRGFSDALYYHQNDSGEYLDVSGCGNSIAANRPIVRQLILESMRCWAIELGVDGFRFDLGIALSRGEGLKPLEQPPLFEEIEADPELSDLKLFSEPWDCGGLYRLSDFPAHRIGTWNGHYRDDLRAFWKGDEDSAWRMGQRLSGSADLYKGEPAPLGRSLNFITAHDGFTLNDLVSFNRKHNLANGECNRDGENHNNSWNNGIEGPCSDHAVQALRHRQMRNLIATLLLSRGVPMLLMGDEVGRSQGGNNNSWCQDNPLGWMLWNPEQCDMDLHLFVSRLLMIRHQLSELFSPVNHPPEEMPVRLQQSPDDLWMQWHGVEIDKPDWGSWSHTICYSLNRGSSGAVMWMGFNAYSKAMHFDLPEPTSAWHRILDTARPSPDDLPARPNAWTSEDIDLQNHSMLILLAEEYASKLKL

SEQ ID NO: 8890 - protein, 337 aa, Lactobacillus reuteri
MTVRKRARIIYNPTSGRETLRSDLVDILAIYEKAGYETSAFATTPAPNSAKNEATRAAEDGFDLIVAAGGDGTLNEVVNGIAGLEHRPTLAIIPAGTTNDYARALRIPRDDPIAAAKLILKKNKKFKIDIGRAGENYFMNIAAGGTMTELTYEVPSQMKSLFGYAAYFAKGAELMPRIKPVDMLIKYDNQEYRGGASMFMIALTNSVGGFEQIVPDASLDDGKFTMIIVKKSSVIDMLSLMAKALQGKHLDDPRIIYAKATDIEVIPLNKDDRLMVNLDGEYGGDAPMKFHNLKQHLEVIANLDEIPEDAITTSADFKRVEEDFMNGIDDYKDRKKK

SEQ ID NO: 8891 - protein, 573 aa, Debaryomyces hansenii
MCGIFAAFRQPEVEQFKSKALQYSKRIRHRGPDWSGNVIQNSTILCHERLAIVGLDSGAQPITSEDGNYTLAVNGEIYNHIQLRDEFPSYPYKSLSDCEPIIPLFEKYDVDAPKYLDGMFAWVLYDKKNDRIVASRDPIGITTLYMGKSSKNPKTRYFASELKCLTDECDEIFAFPPGHVYDSNTDEITRYFNPSWWEESSIPSKRVDLKEVRETLELAVRKRLMAEVPYGVLLSGGLDSSLIAAIAARETQKAAAGISKDGIDANKELSGVDEKGSLHSSGWNQLHSFAIGLPGAPDLIAAEKVAHFIGTIHHSHTFTLDEGLDALDDVIYNLETYDVTTIRASTPMYLLSRKIKAQGVKMVLSGEGSDEIFGGYLYFANAPSPKDFHEECVKRVKNLHYADCLRANKSTMAWGLEARVPFLDKQFLEVCMNINPEDKLIKPAEGKIEKYILRKAFDTSDDPNAKPYLPEEILWRQKEQFSDGVGYSWIDGLKDAAEAAISDEQFANPKAEWGTDVPTTKEAYWYRCKFDEIFHSKAAASTVMRWVPKAEWGCHADPSGRFATIHEQKVDQD

SEQ ID NO: 8892 - protein, 437 aa, Ralstonia metallidurans
MNGKATRIDLLSFKTPQMRAFHLTWMAFFVCFFAWFACAPLMPVLKGEFGLTPNQIANINIAAVAVTILVRLVIGPLCDRFGPRKTYTGLLAIGALPVLGVAFAQNYETFLFFRLLIGAVGASFVITQYHTSVMFAPNVVGTANAASAGWGNAGGGAAQGLMPLLLATILFLGVDHTMGWRVALLVPGILMLVMAVVYWRFTQDCPEGNFSELRARGIAVSGGKGGGGWASFRAASANYRVWMLFITYGACFGVEIFIHNVAATFYVDRFGLSLSAAGMAAASFGLLALFARALGGYVSDKLAMRRGLDARSLILFVFILGEGLGLLGFAHASTATTAVAAMLVFGLFTHMACGATYALVPFIDRKALGGVAGIIGAGGNVGAVAAGFLMKGLGDLQQTLTWLGVAATLAALCAIAVRFSAEHKAQEQALYDSALAN

SEQ ID NO: 8893 - protein, 112 aa, Pseudomonas aeruginosa
MKLVTAIIKPFKLDDVRESLSEIGVQGITVTEVKGFGRQKGHTELYRGAEYVVDFLPKVKIDVAIADDQLDRVIEAITKAANTGKIGDGKIFVVNLEQAIRIRTGETDTDAI

SEQ ID NO: 8894 - protein, 395 aa, Aspergillus oryzae
MTHIQLSSVSLENSNLYNIKNEPNMTMPSNNQSAVAKSSNSNTSGEPGKFKKMGIRWAPLNIGLERRLQTFVVLCHTLTIAIFLTSFFFACAIPLSWPILLPYLIYISLFSTAATSGTLSGRCNYLRSLRIWSIYASYFPARLHRSERLLPTRKYIFGYHPHGIISHGAFAAFATEALGFSKLFPGITNTLLTLDSNFRIPFYREYALAMGVASVSRESCENLLTRGGTDGEGMGRAITIVIGGARESLDALPHTLRLVLKRRKGFIKLAIRTGADLVPVLAFGENDLYEQVRSDQHPLIHRFQMLIKHTMGFTIPLFHARGVFNYDVGLMPYRRPLNIVVGCPIEVVQQQNRDKIDDDYIDYLHAKYVQELARLWEQWKDVYARDRTSELEIVA

SEQ ID NO: 8895 - protein, 722 aa, Prochlorococcus marinus
MQGQTKSVSFDGREIKLTTGRFAPQAGGSVMIECGDTSVLVTATKSSGREGVDFLPLMCDYEERLYAAGRIPGSFMRREGRPPERATLISRLIDRPMRPLFPGWMRDDIQIVATCLSLDERVPADVLAVTGASMATLMAGIPFQGPMAAVRVGLLGDDFVLNPSYREIERGDLDLVVAGTPDGVVMVEAGANQLSEQDVIEAIDFGYEAITELINAQKEVLKESGIKQEMPKAPEIDDTISTYLDKNCTKSISEVLKNFDQTKEERDNKIEEIKISISAKIDGLKDDNAVKKSLSLNNKLLENSYKALTKKLMREQIIKEGKRVDGRELNEVRAIEADAAVLPNRVHGSALFQRGLTQVLSTATLGTPSDAQEMDDLNPNTDKTYIHHYNFPPYSVGETRPMRTPGRREVGHGALAERALIPVLPAKDTFPYVLRVVSEVLSSNGSTSMASVCGSTLALMDAGVPLKAPVGGAAMGLIKEGKEVRILTDIQGIEDFLGDMDFKVAGTEKGITALQMDMKITGLPIETIGEAINQALPARTHILGKMLDAIETPKDNLSPHAPRLLSFRIDPELIGTVIGPGGRTIKGITERTNTKIDIEDGGIVTIASHDGAAAEEAQRIIEGLTRKVHEGEIFPGSITRIIPIGAFVEILPGKEGMIHISQLSEARVEKVEDVVKVGDQVTVRVREIDNRGRINLTLRGVSQNGGMSNYPEPTPTPVAPLT

SEQ ID NO: 8896 - protein, 475 aa, Wigglesworthia glossinidia
MIDNLIWFRKDLRLNDNPALYYACVDEYKSASGILILNKKKWNEKIVSKNRIRFMYKNIFSLKRNLKKIGIELIFYTCRDFFEYTCLLYNFCYTNKVKELYFNKGIEKEDLEEDKIIIKKLKKITKCICFNGNLLIDPEKIKNKNKKTYKVYSYFLKSCISFISNNNINIIPFPKIRKNKLNLIKSYNDSIKIKKKLSPCYEEHALNKLNNFIKLKINKYHITRDFCINSTSFLSPYINIGVLSLRECINNIKNNNFDFIEKKNSGHFKWFSEIIWREFCHHLIIEYSDFFDSKKLIKWTKYIKWENKIKKIQAWKNGTTGFPIIDAAMRQLKKTGWMHNRLRMITSSFLVKDLLVDWKIGEKYFYYHLIDGNSAINNFNWQWISSSGICSSPYFRMINPITQSKKFKSIYKYIKFWIPELKNIPFNEIHEPYNWIIKNKINYPNQIIEHKTAKINFFKACKKAIYIFKSKNINK

SEQ ID NO: 8897 - protein, 170 aa, Cabomba caroliniana
IDMASEQVCYVHCNFCNTILAVSVPCTSLFNIVTVRCGHCTNLLPVNMAAMLQPQTFAPYDYPLDLSSSSKSNKISQMVKPNEASIAINRPPEKRQRVPSAYNQFIKEEIQRIKASNPEINHREAFSTAAKNWAHFPHIHFGLMLENSRKDKFDELTDKLLMTKSAVYNK

SEQ ID NO: 8898 - protein, 492 aa, Unknown
  Synechococcus sp. RS9916
MNASRTLFWHRRDLRLADNKGLQAAAALGSAVTGVYVLDPAIITPPHHLPPMAPARLWFLVETLRELQQRWRDAGSRLIVVAGDPVAVLPRLAALLEAPTLVWSRDVEPYARERDRQVAKALQADGRKVLVDWDQLLVAPELLKTGGGDPYRVYGPFLRNWRGQVERTEPSTVEAPTGLCDLESEQLEAISSGAGDLGRLCAEGQRELERLQVEHGFRGMELCPCRPGEAAAAEQLATFVDGPLLAYEPDRNFPGVVGTSYLSAALSVGTLSPRQAWCAAQEMKGLARSDEQRQAITVWEQELGWREFYQQALFHFPELANGPYRDQWRRFPWENNEDWFDFWKDGQTGMPIIDAAMRQLNETGWMHNRCRMIVASYLVKDLICDWRWGERAFMELEVDGDLAANNGGWQWSASSGMDPKPLRIFNPATQASKFDADGDYIRRWVPELRHVNTKDLLSGEIAALERRGYPELLVNHKTQQARFKALYATIRS

SEQ ID NO: 8899 - protein, 136 aa, Glycine max
HASDHAYGCELRRRSKWLPSMISSPAVTTVNRAGAGMVAPFTGLKSMAGFPTTKTNNDITSIASNSGRVPCMQVWPPACTKNFETLSYLPYLDDAQLAKAVVYLPKKAWISCWAFELEHVYLYREHIMSPGYYYGR

SEQ ID NO: 8900 - protein, 729 aa, Unknown
  Frankia sp. EAN1pec
MDDSTQAAEAVITTPTGARTVRFETGRLARQAAGAVVAHLGDTMVLSATTVSRSPKEQLDFFPLTVDVEERMYAAGRIPGSFFRREGRPSEDAILTCRLIDRPLRPSFAKGLRNEIQVVATVLALDPDTLYDVVAINAASASTMLAGLPFSGPIGATRVGYVDGDWIAFPTHSELERATFDMVVAGRVLEDGSDVAIMMVEAEATPGTVALVAGGAPAPTEEVVAAGLEAAKPAIRELCRAQSELAAGAAKPQREFPLFIDYHDDVLETLTAAVGEELAAALRIAGKAERETELERVRALAVEKVSGQFEGRDKEISPAYRALTKKLVRSRIVTDGVRIDGRSTTEIRELSAEVDYIPRVHGSALFERGETQILGVTTLAMLRMEQTVDTLNPDRTKRYMHNYNFPPYSTGETGRVGSPKRREIGHGALAERALLPVLPSREEFPYAIRQVSEALSSNGSTSMGSVCASTLSLLNAGVPLKAPVAGIAMGLIREGDAFVTLTDILGAEDAYGDMDFKVAGTQEFVTALQLDTKLDGIPASVLAGALQQARAARLTILEVMAEAIGGPDEMSAHAPRVISVKIPVDKIGEVIGPKGKMINQIQADSGAEITVEDDGTIYIGAADGPAAETARSAINAIANPQMPEVGERYLGTIVKITNFGAFVSLTPGKDGLLHVSKLKQLAGGKRVEKVEDVLSVGQKLQVEITEIDARGKISLAPGAESIDTVSAGS

SEQ ID NO: 8901 - protein, 488 aa, Halothermothrix orenii
FEKHGTYYEIFVRSFYDSDGDGIGDLKGIIEKLDYLNDGDPETIADLGVNGIWLMPIFKSPSYHGYDVTDYYKINPDYGTLEDFHKLVEAAHQRGIKVIIDLPINHTSERHPWFLKASRDKNSEYRDYYVWAGPDTDTKETKLDGGRVWHYSPTGMYYGYFWSGMPDLNYNNPEVQEKVIGIAKYWLKQGVDGFRLDGAMHIFPPAQYDKNFTWWEKFRQEIEEVKPVYLVGEVWDISETVAPYFKYGFDSTFNFKLAEAVIATAKAGFPFGFNKKAKHIYGVYDREVGFGNYIDAPFLTNHDQNRILDQLGQDRNKARVAASIYLTLPGNPFIYYGEEIGMRGQGPHEVIREPFQWYNGSGEGETYWEPAMYNDGFTSVEQEEKNLDSLLNHYRRLIHFRNENPVFYTGKIEIINGGLNVVAFRRYNDKRDLYVYHNLVNRPVKIKVASGNWTLLFNSGDKEITPVEDNNKLMYTIPAYTTIVLEKE

SEQ ID NO: 8902 - protein, 201 aa, Amborella trichopoda
GLASEQLCYVHCNFCDTVLAVSVPCSSLFKMVTVRCGHCTNVLSVDTRGLLHPTAATQLHLGHAFFSPTPHNLLDECSPPSSLLLDHPLMTPSNTGSASTRLQENEALHSPVSRPPEKRQRVPSAYNRFIKEEIQRIKAGNPDITHREAFSTAAKNWAHFPHIHFGLMADQSIKKTNMQDGDDVLITESFFTAANMGVTPY

SEQ ID NO: 8903 - protein, 359 aa, Kluyveromyces lactis
MSEISVKEYVKRQEELEDEANKLMPYDPSHCTYSMGPIRQPIFACRTCNSIGVCYSCSIQCHSTCDLVELFDKRNFSCDCGTERQFEHGEKFTPCNIRKNTTPDIPDMSNRYGQNFKGLFCSCHREYDPNTTTTMLQCVLGLECNEDWFHDHCILGIEENPDPVTEDRKLPGFPELSSFEGFISWVCIDKYSSIFEKLLSHEACDKIIAHKVYRRDLVSDQNSEGMTLESTKKRGLEEMENSSGSYSLFLKEGYREEFKRLRDSLPEGDSLKSFFMHTAPFLTCEEKVYEPPEEQEQGSLVEMGETALAQNLSHQQTLASLVAFQQIKSKLTDFLRPFAENDKVVSESDIKQFFDTQKK

SEQ ID NO: 8904 - protein, 332 aa, Zea mays
MGADGGLNRAAEKPRDGEGGEARVFRCTDYSLPRTTLALALWLGGIHFNVLLVLASLFLLSGRAAAIVVAFQLLFMFAPVNDRDKWGQSVARFICRHAMGYFPITLHVEDYKSLDPSRAYVFGYEPHSVLPIGLSALADLVGFLPLTKIKVLASSAVFYTPFLRQIWTWLGLVPATRKNFYCYLGAGYSCIVVPGGVREMLHMNNDSEVAFLKSRKGFVKIAIQSGCPLVPVFCFGQSYAYKWWRPGGKLFIKIARAVKFTPIIFWGRFGTPFPFPKPMHVVVGKPIEVNKIPHPTIDEINEVHEQFIIAMRDLFEKYKAKAGYPGLHLRVL

SEQ ID NO: 8905 - protein, 467 aa, Haemophilus ducreyi
MSKFPTVSEILSGKIVVGEKVTVRGWVRTRRDSKAGLSFLTVYDGSCFEPIQVIINNDLANYQTEILRLTAGCSVIVTGNIVESPASGQAVELQALEVEVVGWVDDPDTYPMAAKRHSIEYLREVAHLRPRTNLIGAVARVRHCLAQAIHRFFNGQGFYWVATPLITASDTEGAGEMFRVSTLDLENLPRTEHGKIDYSQDFFGKEAFLTVSGQLNGESYACALSKVYTFGPTFRAENSNTTRHLAEFWMVEPEFAFATLADNAKLAEDMLKYVFKAVLEERKDDMQFFAKHIDKEVITRLENFIAAPFAQVDYSDAIEILLKSGKKFEFPVAWGVDLSSEHERFLAEEHFKSPVVVKNYPKDIKAFYMRLNDDGKTVAAMDVLAPGIGEIIGGSQREERLAVLDSRMIEMGLNPEDYWWYRDLRKYGTVPHAGFGLGFERLIVYVTGLQNIREVIPFPRAPRNANF

SEQ ID NO: 8906 - protein, 451 aa, Neisseria meningitidis
MSEYTPQTAKQGLPALAKSTIWMLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 8907 - protein, 444 aa, Zea mays
MGKRSGGRKLPFFTRSSSSSSKRNRSARRLPSLPKQDNATRALLASPSAASPSATPGSAAAGQTAQLPPPLSVTAGGGVAVSGKVNKKKAGTRLWMRLDRWSASEIVELDKASIIRRAGLPPRDLRILGPVFSRSSSILAREKAMVINLEFIRAIVTAEEVLLLDPLMHEVLPFVDQLRQHLPLRSRVGENGECAPDGNGEKQKGSLNEATGAEHELPFEFHVLEVALEVVCSSLDLSVSDLERHATPVLDELTKNVRDEIEHLLDDNEDMEHLYLTRKQVQNQQVEALMSSAASNSIVLAGTGVPRLNSSFRRSLSIATSMHLDNDVEDLEMLLEAYFMQLDGIRNRILSVREYIDDTEDYVNIQLDNQRNELIQLQLTLTIASFGIAANTFIAGAFAMNIPGSLFNTDGSLFWPFVGSTSSGCFVITVLLLGYAWWKKLLGP

SEQ ID NO: 8908 - protein, 168 aa, Xylella fastidiosa
MSSIYTFTFTRLDGRPQALADWRGQVLLLVNVASRCGFTPQYAGLEMLWQRYRDAGLIVIGFPCDQFAGQEPGDEAKIAEFCTLTYGVDFPMAAKIKVNGADAHPLWQWLKHRRRGLFGVAAIKWNFTKFLIGRNGQPIARYSPIKSPEQLEVHIVRALGEEGGGNTH

SEQ ID NO: 8909 - protein, 682 aa, Unknown
  Synechococcus sp. WH 5701
MHDSTQGRSHPIGATLEHGGANFSLFSRTASAVDLLLFDGVNETHPSRVVTLDPQTNRTYHYWHGFVPGVEPGQLYGYRVHGPWDPSRGLYFDPSRVLLDPYGRAVAVPEGSEAMKSVVVDPGAYDWQDDQPLRHPCARTIIYEMHVRGFTAHPNSGVSAERRGTYAGLIEKIPYLQDLGITAVELLPVFAFDRQAAPSGHVNYWGYQPLGFFAPHPGYSCGEDPLEAVDEFRDMVKALHHAGIEVILDVVFNHTAEGGVNGPTFCFRGIDNPNYYLLRDGGSQYADFSGCGNTLNANHPVVRRMIVDSLRYWVGEMHVDGFRFDLASILSRDSAGNVLPNPPVLWDIESDPLLAGTKLIAEAWDAAGLYQVGSFVGDSWREWNGRFRDDARDFFRAAPGSLGRFADRLIGSPQIYGHKEREAEQSINFVTCHDGFTLNDLVSYNGKHNEANGENNRDGTDDNRSWNCGVEGPSDDSAVEDLRNRQIRNFFAVTLLSLGVPMLLMGDEVRRTQHGNNNAYGLDDSSNWFDWALLQRHGDLHRFVKLLIARRLQRDLRSERERTSLNTLIRRASKAWHGTRLNHPDWGDQSHSISLTVKLLQDKAWLHLILNAYWQPLEFALPMITPDGSSPWHRWIDTSRPSPSDIVPWEEAAECPAGPYRAMEHSVVVLIAGAGVGPEQGG

SEQ ID NO: 8910 - protein, 315 aa, Bacillus halodurans
MGEEQKVYDVVIAGAGPAGMTAAVYTSRANLSTVMVERGVPGGQMANTEDVENYPGFDHILGPELSTKMFEHAKKFGAEYAYGDIKEIIDQGDLKLVKAGNKEYKARAVIVATGAEYKKLGVPGEKELSGRGVSYCAVCDGAFFKGKELVVVGGGDSAVEEAVYLTRFASKVTIIHRRDQLRAQKILQQRAFDNDKIEFIWDHVVKQINGTDGKVSSVTIEHAKTGEQQDFKTDGVFIYIGMLPLNEAVKNLNILNDEGYIVTNEEMETSVPGIFAAGDVREKSLRQIVTATGDGSLAAQNVQHYIEELAEKVKN

SEQ ID NO: 8911 - protein, 332 aa, Cicer arietinum
MAKDPVRVLVTGAAGQIGYALVPMIARGVMLGPDQPVILHMLDIPPAAESLNGVKMELVDAAFPLLKGVVATTDVVEACTGVNIAVMVGGFPRKEGMERKDVMSKNVSIYKSQASALEQHAAANCKVLVVANPANTNALILKEFAPSIPEKNISCLTRLDHNRALGQISERLSVQVSEIKNVIIWGNHSSTQYPDVTHATVKTPAGEKPVRELVSDDAWLNGEFIPTVQQRGAAIIKARKLSSALSAASAACDHIRDWVLGTPEGTFVSMGVYSDGSYNVPAGLIYSFPVTCAGGEWKIVQGLSIDEFSRKKLDLTAEELSEEKNLAYSCLS

SEQ ID NO: 8912 - protein, 470 aa, Chlamydophila pneumoniae
MNKKKRFLSLLFLTAVLLGIWFSPHPASINSNAWQLFAIFTTTIMGIIFQPVPMGAIAIIGISTLLLTQTLTLEQGLSGFHNPIAWLVFLSFSIAKGIIKTGLGERIAYFFVSALGKSPLGLSYGLVITDFFLAPAIPSVTARAGGILYPVVTSLSDSFGSSAEKGTQDLIGSFLIKVAYQSSVITSAMFLTAMAGNPLVAALAGHVGVSLSWVLWAKAAIIPGLLSLFLMPIILYKLYPPKITSCEEAIRSAKLRLKEMGPLKKEEKTILMIFFLLVVLWTFGDLLGISATTAALIGLSLLILTNILDWQKDVIANTTAWETFIWFGALIMMASFLNQLGFIPLVGDSAAALVSGLSWKIGFPLLFLIYFYSHYLFASNTAHIGAMYPIFLAVSISLGTNPIFAALTLAFASNLFGGLTHYGSGPAPLYFGSHLVTVQEWWRSGFALSIVNIVIWIGIGSLWWKALGLI

SEQ ID NO: 8913 - protein, 960 aa, Unknown
  marine gamma proteobacterium HTCC2143
MLQYYDPAKGLDVSKDYGTPAFNRQADRNTELVNLTIDGRELAVPAGTSIMRAAALADISIPKLCATDSLEAFGSCRMCLVEIAGRKGFPASCTTSVEQGLVVRTQTDRVAKLRRNVMELYISDHPLDCLTCPANGNCELQDVAGEVGLRDVRYGFDGKNHLSASKDTSNPYFTFDASKCIVCSRCVRACEEVQGTFALTIDGKGFDSVVAAGQAQSFMESDCVSCGACIQACPTSTLMENTVIDQGQPQRSVVTTCAYCGVGCAFKAELKGDQVVRMVPHKGGEANRGHSCVKGRFAFGYTTHQDRITTPMIRETIDDPWRKVSWDDAVNFAAARIKTIQQQYGRNSVGGITSSRCTNEETYLVQKLVRAAFGNNNVDTCARVCHSPTGYGLKTTLGESAGTQTFDSVEVADVVLVIGANPTDAHPVFASRLKKRLRQGAQLIVADPRRIDLINSPHANTPYHLKLLPGTNVAFINAIAHVIVSEGLEATEFIARRCDSEAFGRWKRFVKEQKNSPEAMASITGVPAEQLREAARVYANANNGAIYYGLGVTEHSQGSTMVMGIANLAMLTGNIGREGVGVNPLRGQNNVQGSCDMGSFPHELPGYRHISDDTVRHQFEQAWGVTLDHEPGFRIPNMLDAAVAGHYKGLYCQGEDIAQSDPNTKHVEQALRSLDCLIVQDLFLNETANFAHVFLPGASFLEKDGTFTNAERRISPVRKVMSPLGGKADWEGTTALSNALGYPMNYNHPSEIMDEIASLTPTFSGVSYQRLDQEGSLQWPCNSAMPDGTPTMHVDEFVRGKGYFAITEYVATDEKVNKRFPLLLTTGRILSQYNVGAQTRRTANVDWHERDLLEIHPHDAEDRGISDGDLVQVSSRAGKTVLTADVTERVQAGVTYTTFHHPESGANVVTTDNSDWATNCPEYKVTAVELKKVTAESSWQRDHDAFSIKQRGLVDTEVLP

SEQ ID NO: 8914 - protein, 332 aa, Desulfotalea psychrophila
MNLTQFPRRNYLQGPTPIEAAPRFSKALGGKVNVFIKRDDLLPGCAGGNKTRKLDFCIADAIEKGADTIITCGPVQSNHCRLTLSWAVKEEMDCHLILEERVPGSYKEDGSGNNFLFNLMGVKSTQVVPGGSDMMGEMEKLAKELEAQGKKPYIIPGGASNVLGATGYVACAQEIQQQLFQQNINITDIVVPSGSAGTHAGVAVGMYGINSGIRVSGINVSKPKDVQEENVYKLAYETAKAVGVCGELPRGEITCFDGYVGAGYSLPTDSMVEAVKLLARTEAILLDPVYSGKVMAGMIDLIRNDYFAPGTNVLFLHTGGSPALYAYTDTFK

SEQ ID NO: 8915 - protein, 257 aa, Triticum aestivum
DPGMKGVLATRVSGSADLYQVNQRKPHHGVNFIIAHDGFTLCDLVSYNLKHNDANGEGGRDGCNDNFSWNCGVEGETNDSNVLALRSRQMKNFHVALMISQGTPMMLMGDEYGHTRYGNNNSYGHDTCINNFQWGQLAERRYGHFRFFSEMIKFRQNHPILKRDRFLSKNDVTWHEDCWDNLESKFLAFTIHDHNSGGDIYLAFNAHDYSVDAVIPPAPQQKHWNRVVDTNLESPNDIAPLLINALVCNSICIFVTL

SEQ ID NO: 8916 - protein, 347 aa, Arabidopsis thaliana
SEIQQRALVPILKGRDVIAQAQSGTGKTSMIAISVCQIVNISSRKVQVLVLSPSRELASQTEKTIQAIGAHTNIQAHACIGGKSIGEDIKKLERGVHAVSGTPGRVYDMIKRGSLQTKAVKLLVLDESDEMLSKGLKDQIYDVYRALPHDIQVCLISATLPQEILEMTEKFMTDPVRILVKPDELTLEGIKQYYVDVDKEEWKFDTLCDLYGRLTINQAIIFCNTRQKVDWLTEKMRSSNFIVSSMHGDKRQKERDDIMNQFRSFKSRVLIASDVWARGIDVQTVSHVINYDIPNNPELYIHRIGRAGRFGREGVAINFVKSSDMKDLKDIERHYGTKIREMPADLV

SEQ ID NO: 8917 - protein, 154 aa, Pseudomonas fluorescens
MIGISFTHKTMAARKRIALVAHDHCKAFLLEWAGRQKARLAEHELVATGTTGLLLSKHLGLPVESMISGPLGGDQQLGAQIAEQRVDLLVFFWDPFEPQPHDPDIKALLRVAAVWNIPVACNECSADYLLSSPLMNQAHEHRIPDYQAYLAGRG

SEQ ID NO: 8918 - protein, 853 aa, Ralstonia metallidurans
MKIIIVGHGMVGHKFLECLADAGAKDLDVTVLCEEPRPAYDRVHLSEFFAGKSAEDLSLVPEGFFAQHNNMLLRLNAKATAIDTAAKTVTTATGETLGYDKLVLATGSYPFVPPLPGKDRKDTFVYRTIEDLEAMLECGQRATSGVVIGGGLLGLECAKALRDMGLQTHVVEFAPRLMAVQVDDGGGRMLRQKIEELGVTAHTGKNTLEIVDGTEGTHRMNFADGTHLDTDMIVFSAGIRPRDELARASGLTIGVRGGIVIDNNCLTSDPHVYAIGECALWDGKIYGLVAPGYDMARVAARHLRGEASEFAGADMSTKLKLMGVDVASIGDPHGNEPGSRSYQFTDERKQIYKKLVVSECGKFLLGGVLVGDAAEYGTLLQMMLNRIELPESPEFLILPASDGKARPALGADALPDTAQICSCNNVSKGEICGAVCDGATTIGALKSCTKAGTACGGCVPLVTQIMKAEMKKQGMAVNNHVCEHFPYSRQELYHLVRVGKFKSFDDLLAAHGSGLGCDICKPTVGSILASCWNEFVLKEEHASLQDSNDYFLANIQKDGTYSVVPRMPGGEVTPDGLIAVGQIAKKYGLYTKITGGARVDMFGARLEELPLIWEELIAAGFESGHAYGKSLRTVKSCVGSTWCRYGVDDSVGLAIDIENRYKGLRAPHKIKFGVSGCTRECAEAQGKDVGIIATERGWNLYVCGNGGMKPRHAELLAGDLDRETLIRYVDRFLMFYVRTADRLQRTSTWRDNLEGGLDYLKSVIIDDKLGIGAELEAEMQHVVDTYEDEWKRAVTDPETRKRFRHFVNSDLRDDNLMFLEERGQVRPATQEERNLQRSRLSHIPVVAVPAKAA

SEQ ID NO: 8919 - protein, 585 aa, Ustilago maydis
MSNESNQIKIGAYLLERLVQLGSQSVQGVPGDFNMGFLDLIEEHPKLKWIGNSNELNAAYAADGYARVKRTIAAVVTTFGVGELSALNGIAGSFSERLPVIHVVGVPSTGAQGSHSLLHHTLGDGRFSAFENMSKEISADSAILKSKQGAGESIDRILITAMKSARPVYLALPTDLVHATIPAEALKTPLDYSIDDNDAKAEEYVLQVAQKHIADAKSAVILVDACAARHGCIQETHELIEKSGLPVFATPMGKTIVDEDHAQYGGIYVGSLTSEKVKNVVEQADVLITVGSLKSDFNSGNFSYRTPKSSTIELHSDYTTIGYSHYPGIGMKKLLPKLSALLETNGDARREETKKIVPKFENALPHDSSSTITQEWLWPRMGQFFQEQDQVIVETGTSSFGMLEAKLPAKTRWVSQVLWGSIGWSVGATLGVALAARENALGRTHLFVGDGSLQLTVQEIGTMIKHGLCPYLFILNNDGYEIERQIHGPQRSYNDIPPYDHSLLLDFFGNEKFHSDAKSHENDPHQSKKQYYRVQTKQQLDELLKDQSFANPDRIRLIEVVMQRGDAPEALKRQAEATGQANKYE

SEQ ID NO: 8920 - protein, 413 aa, Ralstonia metallidurans
MTPPVSSHAKPRLVVVGNGMAGMRTVEELLKLAPDLYDITVFGAEPHGNYNRILLSPVLAGEKTVDDIMLNTRAWYGQHGIELLAGDPVVAIDRPRRLVRSASGKEVRYDRLLLATGSKPFIIPVPGHTLDGVIAFRDIQDVETMLHAARNHRHAVVIGGGLLGLEAANGLMRQGMDVTVVHLADSLMERQLDKPAAELLKAALERKGLRFLLSAQTAAVLGSERVTGVLFKDGTQIPADLVVMTAGVRPNIELAASAGLRCERAIVVDDTLQTFDPRIYAVGECVQHRQATFGLVAPIWDQARVCAAHLAGAGHRRYVQQATATKLKVTGVDLYSAGDFIGGDNSEDLVLRDPRRGVYKRLVLQGGRLVGAVLYGDVQDGPWYFDLIQTGQPVAALRQRLLFGKAQCEALAA

SEQ ID NO: 8921 - protein, 88 aa, Arabidopsis thaliana
  misc_feature (34)..(34): Xaa can be any naturally occurring amino acid
  misc_feature (74)..(74): Xaa can be any naturally occurring amino acid
RPESPCWGFTPRVFFPVMMLPVMEFAEIDCAPRXGPTFGAMIISGPKAGPLALKALGLPNAIDRTLLGNLNPEXLVLTPTNSAETLDA

SEQ ID NO: 8922 - protein, 336 aa, Bacteroides fragilis
MKIGILTSGGDCPGINATIRGVCKTAINYYGMEVVGIHSGFQGLLTKEVESFTEKSLSGLLNLGGTMLGTSREKPFRKQGIISDVDKPALIQRNIAELGLDCVVCIGGNGTQKTAAKFAAMGINIVSVPKTIDNDIWGTDISFGFDSAVSIATDAIDRLHSTASSHKRVMVIEVMGHKAGWIALYSGMAGGGDVILVPEIPYNIKNIGDTILNRLKKGKPYSIVVVAEGIQTDGRKRAAEYIAQEIEYETGIETRETVLGYIQRGGSPTPFDRNLSTRMGGHATELIANGQFGRMIALKGDEISSVALEEVAGKLKLVTEEHDLVVQGRRMGICFG

SEQ ID NO: 8923 - protein, 915 aa, Ralstonia metallidurans
MNLSDIAVVATTPTKTISTTCPYCGVGCGVRATVRADGLVDIAGDADHASNAGRLCVKGSALGETLDLNGRLLHPQVRDADGSLRRVDWDEALDKVARGFTEIIARHGPDAVALYVSGQLLTEDYYVANKLMKGFIGTANIDTNSRLCMSSAVAGHKRAFGEDLVPCSYEDLELADLVILVGSNTAWCHPILFQRLTRAKEARPEMKIVAIDPRRTATCELADLHLPLRAGTDVRLFNGLLSYLARHGHGDDVFVADHTAGLNDALAVADADGADIAAVARACKLAPQDVQAFYELFAATTKVVTAFSMGVNQSSAGTDKVNSIINCHLLTGRIGRPGMGPFSLTGQPNAMGGREVGGLANMLAAHMELGDPRHRDIVQDFWHSPAMADKPGLKAVDLFQAIEQGKVKAVWVIATNPVVSLPDADQARRALARCELVVTSDIVTRTDTNDAAHILLPALGWGEKDGTVTNSERRISRQRAFLPAPGEARADWDILCDVARRMGFAGFDYAGQHEIFDEHARLSAWRNGDDSGDDAAHAPRMFDIGGLAGMDQAAYDAMLPVQWPLPVMASSGKQRLFENARFAFADGRARFVATAARAPVHATDDEFPLILNTGRVRDQWHTMTRTGKAARLSDHLPEPFVDMHPQDALLCGVGEGKLARVTSRWGMMIGRVRFGGGIPRGSVFVPIHWNDQFSSDARVGAVVNPAVDPVSGEPEFKHTPVRVEEFRVSWHGFVLSRKVLPADALTWWTRIQGKHFHRHEFAGRDVITDRAAWARERLGAQAPDADWLEFEDRAAGVYHAGYIVDDRLEACVYLSTRPDLPSRAWLSQLFGQARLEDSDRIGLLLGQPLEKTADAGPTVCSCFGVGRNTICDAVRQHDLKTPAEITACVKAGGNCGSCVPELRKLLVEIRVVEAA

SEQ ID NO: 8924 - protein, 219 aa, Oryza sativa
MGRRPARCYRQIKNKPYPKSRYCRGVPDPKIRIYDVGMKKKGVDEFSHCVHLVSWEKENVTSEALEAARIACNKYMTKSAGKDAFHLRVRVHPFHVLRINKMLSCAGADRLQTGMRGAFGKPQGTCARVDIGQVLLSVRCKPNNAVHASEALRRAKFKFPGRQKIIESRKWGFTKFSRDEYVRLKSEGRIMPDGVNAKLLGCHGRLSARAPGKAFLSAA

SEQ ID NO: 8925 - protein, 543 aa, Thiomicrospira crunogena
MGVETSSAWQALQLHSDSGMGSIHLSKLFQDTNRQDDYSLELSDVYVDFSKNRITQETVQLLIELAEQQKLPKEIHRLMTGEHVNDTEDRPALHTALRALGKDVSGGAETVQPEIEQVLQKMELMTKKIRSGHWRGYSGKPITDVVNIGVGGSDLGPLMITHSLQTISSPINLHFISSIDGTQTSNLLRGLKQETTLFILASKSFTTIDTLSNAETAKDWLKECISDERVIFSQHFIGVSTKPDKMQEWGIPPENQLMFWDWVGGRYSLWSAIGFPIALKIGMDGFRELLQGAHEMDQHFATADLKKNIPVILALIDIWNINFLNIHDKAILPYDARLRYLPAYLEQLVMESNGKSVARSGESVPYKTCPVLWGEVGPNAQHAFYQLLHQGTQAVMCDFIAPVERDDFDANSHTERDESLRHQHELALANCFAQSRVLMLGDNAIPSDLKASFDSPFKHYPGNQPSNTILIKTISAKTLGMLVAMYEHKTYVESVIWEINPFDQWGVELGKLIAKETYNAIKDKPLADSFDSSTKGLIDRVVK

SEQ ID NO: 8926 - protein, 151 aa, Triticum aestivum
  misc_feature (81)..(81): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLXSAPKWVPCLEFKQRVWVHLPLSNKRNPPGVTNDWPGYWDNVGNCLCSGLQPDANTRSNEVGKKVKERNYP

SEQ ID NO: 8927 - protein, 428 aa, Medicago truncatula
MVVISEEIDPYGAEAEGTEEVTETETESVDYEELKKRMWKDKILLQKLKEKQENNTEPEQQAKQEASRRKKMSRAQDSVLKYMAKIMDVCKAKGFVYGIIPEKGKPVSGSSDSLREWWKDQIRFDQSAPLAVAKYLPLLREDEHFNTIMADPNSYIHLLQDLQDSTLGSLLSALMQHCVPPQRRFPLERGISPPWWPTGSENWWGEQGLLAQEQGPPPYKKPHDLKKAWKVSVLAGVIKHMSPDLEKLRKLVTQSKTLQDKMTARDSATWSKVMNQEEALLGVTDKCHKLTISEEGESSGGSSSSSSNNRSEKRKFVFDVGGDDVEGPQSKLPMAMSLTHRVPKLLDCDARIENVDDWLKMGEIEGGKFGWDVEHWLNDVDDHEFEAALEMVKGNNNMDFTQNQEHNLHGQEEEKSIWDFRYQYPSQD

SEQ ID NO: 8928 - protein, 499 aa, Unknown
  Candidatus Desulfococcus oleovorans Hxd3
MTDKILINAVDTEECRIARVKDNRLCEFHLETTSRVTTKSNIYKGLVARVEPSLQAVFVDYGEERHGFLQKHDIHTDYFQDSKVDGSIRDLIKPGQEMLVQVVKDPIMHKGAALTTFLSIPGRFCVLMPGSVTKGVSKQIEDEEERKRLKEIVSGLRVPENFGVILRTAAKGAAKTVIAKDLSYLMRLWKTIKKEGMNQKAPAAIHKERDFAVRAIRDYLTADIQEILIDEPAVHQEVKDFVALVSPKHAKIVRLYQGAKPIFTKHELESQIESIFENRVQLPSGGSIVLTQTEALVSIDVNSGKSRQKHSIEETALQTNLEAAEEIARQLRLRDMGGLIVIDFIDMKPRKNNAAVERALKAHVKEDKARTDVGKISKFGLLEMSRQRLRQSIETSSMVTCGHCGGRGYVMATEKLGINVLRRLRLESLKHRGVAVTATVPAVVADYLLNKKRTELLELEARRDLAITITGDPAMHLGESDIRFEGKPNGSADGETDLS

SEQ ID NO: 8929 - protein, 878 aa, Ustilago maydis
MHFPEPNPTASLLLSHRPPAGKVALVLGTGKLAASRCFACLEAGIQPVVISVAASPELHVGSSSLFQPCAELEHRIASGQVVHHIVDVDCFSTKQSVELTWNGILDTFDGEINAIFAVCVTDTLHSGDETQNAPTKSNSRNVDGDDDDDSVVAEMALTSYARAEVIAQLCRKRRIPINVADKPNLCDFSFPANYRFPCSSAILEASSAQSNRTCSALPSASSSSLQIAVTTNGRGCRLAGRIRREIVSALPHNVGDAVEKVGLMRDLAKRQSEAPVSAAKRKKRSDAPTAKTGIAEVEEEDLSFDSTPLNSPVPQLIPKNPIDSIGTSVRITQLQAKHDQGLQQAEERTKRRMRWVAQISEYWPIEYLGNLGEQQMSEALRAHGEEQSHQSAASVNTTLVNTTSSIAVGQEGQDASRGRSTLVRSNQHSETAAGIGATAPSCAAHRARSQHSLDIRPPQPTSTRRGHIYLLGSGPGHPGLLTTLAYKLLTSPSTDLILSDKLVPASILKLIPKSTPLEIAKKFPGNAEGAQSELIAKALRAALEEGKTVVRLKQGDPFVYGRGGEEVLAFRNAGIECTVVPGISSSIAAPAMLGIPVTQRGAADSLVLCTGVGKGGKKVKLPGYDRSRTLIILMGVARLGAVVATLTAGAPQSASSTTVADEESIGDREGAVFPPYTPIAIIERASSSDQRMVASTLDGIVEALENSGEQRPPGMMVIGWSVLSLEGKGDVSIQDDALSINDPEELAKKDRGRVQSWLKGRRWIVREGLDHSYRSALHAFHATALQFPDSGSVADVPLSHHAHAKGPGEPTTQPTDVAADTLSQRGESGWAPPRYPTGVPEGGWVPGEAPNRPATDQLAYEQNKTYVEIQARLQHLST

SEQ ID NO: 8930 - protein, 489 aa, Zea mays
MAANGMKVALHRQVSGGSMKQNAELRRQASLESPRTGRATSRFLFGRQSSMDPNRRRGRSQSPVRAPEDLGVPDNLDATMQLLFFACQGDALGIEGLLRSGVDVNSINLDGRTALHIAACEGHRDVVRVLISWKANIDARDRWGSTAVADAKFYGHSRVYDLLKFHGAKVPRTKRTPMMVSAPAEIPEYELNPGEVQFRRGCDVTPVQFSFFLCIHKHLFKNASEIWGNSFRHELTVLEKVRHPNVVQFVGAVTQSIPMMIVSELHEEKDLSVCIQKKGKLKPQKVLRYGLDIARGMTYLHQCKPDPIIHCDLKPKHIFLDSGGQLKIAGFGVTRMSKVGTDKVRLIYHGALVDSFSYHTAPELYRNDAFDSSVDSYSFGFILYEMVEGSVRAPEDSGHSIRFEGLRPSLKGRLKGYPPDFKALVEECWHPQAMARPTFSEIIIRLDKIYAHFDKHGSWKDSLKLWSVSRRLKRIVKRRSVRSRIHNEP

SEQ ID NO: 8931 - protein, 636 aa, Debaryomyces hansenii
MAPVITRLQSYTSIEEYDEQIPLGEYLFLRVCQINPRLKSVFGIPGDFNLNLLEHLYADSLVNGKGVKFVGLCNELNASYTADGYSKIIQGLSVLITTFGVGELSALNGIAGAFAEYAPVLHIVGTTSTKRAAYARTCGVQGIQNFHHLVQNKNPLIAPDHDVYKPLVEPFSVIQESLTMDGFDNEENLKKIDRVLIKICQENRPGYLFVPCDIPDITVSRARLAEEISIQELAEDDAESKQLMENIADRILNKLYQSQKPSVIGDALVSRFHQDEVFTKFISKLPSNFVKLFTANMARNIDETLPNFVGTYFGKVSPTKELQNNLEQESDLLIDFGYYNAETNTAGYTRDYSNIKDYIEIHPDYVLMDNEYVAVKDFATDKRRFSMGDLIQSLNDKIDSTRFIHNNKLVNNITYKFTPYKWHTDDTTVNQCVVPQSKLIDFFNNYLQPNDILMVETCTFLFAVPDLKFPPGVTFLSQSFYGSIGYAIPATLGVSLAEKDLGSNRRIILVQGDGSAQMTIQELSTFLRHDLVNPKIFLINNEGYTVERIIKGPTRSYNDIQGCWKWTELLKIFGDEHGARHVTATIKNAAELDNFRSLLNNNKIEFIELIMGKLDAPERFSYISGHKQPIPSVPLH

SEQ ID NO: 8932 - protein, 160 aa, Chlamydomonas reinhardtii
  misc_feature (20)..(20): Xaa can be any naturally occurring amino acid
MATNGNGASGAELATFALGXFWHPEASFANVPGVVKTRVGYTGGSRPNPTYESVCAGDGHTEAMRVWFDPAIISYEDLLKQFFREHDPTQKSKCQYKSAVWYHSEAHGTALAAVMKELEGKYRVRLATTVDPAGDWWDAEEYHQKYIEKSMMRRGSAGWW

SEQ ID NO: 8933 - protein, 223 aa, Prochlorococcus marinus
MKTTFRPLRRWWIAIFLCVALLGLPLQVLASVEEAVFAGGCFWCLEHDLEGLTGVISSESGYTGGDLPRPTYRQVSSKTTGHQEAVRVRFDAAQISYAELLRSYWRNVDPLDGDGQFCDQGDSYRPVIFTRDDQQASEARESADAAALELAQPMSNLRVEIKPLSEFWLAEDYHQNYAELNSIKYNFYRYSCGRDRRLDQLWGDRARTGVPWQRPDQANLRKK

SEQ ID NO: 8934 - protein, 347 aa, Triticum aestivum
  misc_feature (180)..(180): Xaa can be any naturally occurring amino acid
MSHRMMMNPVKVEGDGRAGGGGAPRPMDGLGDAGPTPFLAKTYDMVDDPATDAVVSWSATNNSFVVWDPHLFATVLLPRYFKHGNFSSFVRQLNTYGFRKVDPDRWEFANEGLGRGQRHLLRNIKRRKPTHGSQNHQSLGSYLEGGNFGHDVEIDHLKRDKHLLVAEMVKLRQGQQNHKXQICQPMEKGLPGTEQKPQQMMSFLARVMQIPMFIRQLISQSEMRKELEDAISNKRRRRIDQGPEAVDGMGTGSTLEQGSQVMFEKQEPVDSLVNGVISDLESSSVDTKGAEVQQSVASSRSEQLRGRPSGELNDDFWEDLLHEGGLGEEASNLVVPDDMNLLAQKMD

SEQ ID NO: 8935 - protein, 334 aa, Deinococcus radiodurans
MTQPDMAYPNPAGIKRVAVLTSGGDAPGMNAAIRAVVRTGAQQGIEVVGVRRGFSGLHRGEVQLLGPRDVANTIQRGGTILLTARSHTWRSPEGRAKGAAVLREWGVDGLVVIGGDGSFHGGYFLQEEHGIPVIGVPGTIDNDLYGTDHTIGYFTAVETALEAVDKLRDTGASHERIFVIEVMGRHAGHIALDVAVAGGAEEVFIPEDKKPIGDVVNIVKDSIAKGKRGSIIIVAEGYDGGAEAVAQAIHAGTGLETRVSILGHIQRGGTPVSSDRILASRLGEAAVYALMDGKKGVMVGRIGGGIAYTPLHETWEKRKDVSRDLYRCAKMLSI

SEQ ID NO: 8936 - protein, 96 aa, Zea mays
DGKCEKMPSTKMLNVRIQSLPCFEQEGMVWIWPRDDPPKATIPSLLPPSGFTVHAEIVMELPVEQGLLLVFSFLDLAHAPFTHTSTFAKGWSVPRS

SEQ ID NO: 8937 - protein, 516 aa, Listeria innocua
MTKFSEFGLDEKIVKSVNRMGFEEATPIQEKTIPLGLAGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGSGGGGNRDRRGGGEQRSGGNKGNYSQKSK

SEQ ID NO: 8938 - protein, 552 aa, Pyrobaculum aerophilum
MPLHFDVALLHAPSVYDFRNLRRVHYGPISDVIPSRPVFDMYPVGFIYIVSYLEKRGVKTGIFNVAARMLNEPRLDVSKLLKGIKATLYAVDIHWLVHAHGAVEVAKLVKEIHGAPVAVGGFSATYYWREILEKYPFIDFVVLGDTTEPVIYQLLHAVERGDRGKLYEIPNLAFRDGDKLVNTGIRYIPQELDDLKPDYTAVARAMIRSGIRNSLPWSTFFKHPIAAVISYKGCPLNCLACGGSNYTYSAVFGRRGLGRKSPETLVEEFREITERLKIPVFFVGDLQYLGRRYLEEFAELLRRKKPSVELIFEFFTPPPREVLSLYRRAGDMVYLQISPESHDEDIRKHYGRPYDNSSLLEFIKNAAELRFERVDLYFMVGLPMQTPENVKGLGDFFLELAKRGGGALNAFVAPLAPFVDPGSPAFHNPSKYGYVILARSFEEHRRLLLAERWYMMLNYETTTMTRSQIAEATYNAVESLARAKYIAGIIDDEYLGAVLETVKNARSGAPPVGLNSKETVREEELYPKKFWISYLTPRSVAEIIRYSLGRLA

SEQ ID NO: 8939 - protein, 584 aa, Astragalus sinicus
MCGILAVLGCADASRAKRVRVLELSRRLKHRGPDWSGLHQHGDCYLAHQRLAIVDPASGDQPLFNEDKSVIVTVNGEIYNHEDLRKQLPNHTFRTGSDCDVIAHLYEEYGEDFVDMLDGIFSFVLLDTRDNSYIVARDAIGVTSLYIGWGLDGSVWISSEMKGLNDDCEHFECFPPGHLYSSKNGGFRRWYNPLWYSEAIPSAPYDPIVLRQAFEKAVIKRLMTDVPFGVLLSGGLDSSLVASITSRYLATTKAAEQWGSKLHSFCVGLEGSPDLKAGKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALYQYDCLRANKSTFAWGLEARVPFLDKEFINVAMNIDPANKMINLDEGRIEKYILRKAFDDEEHPYLPKHILFRQKEQFSDGVGYSWIDGLKAHAAKHVTDKMMRNAANIYPHNTPSTKEGYYYRMIFERFFPQNSARLTVPGGPTVACSTAKAVEWDAAWSKNLDPSGRAALGVHASAYENQNNSVNKSIEFEKIIPLEASSVGVAIQT

SEQ ID NO: 8940 - protein, 200 aa, Unknown
  Synechococcus sp. RS9916
MRTGEIHRATGETDVRVRLDLDGTGQCHAVTGVPFLDHMLHQISSHGLIDLHIDATGDTHIDDHHTNEDVGIAVGQALSQALGDRRGIHRFGHFVAPLDEALVQVALDCSGRPHLSFGLQIPSQKIGTYDTELVKEFFVAVANNSGLTLHIRQLDGVNSHHIVEACFKAFARALRMATEIDPRRAGTVPSSKGVLEQAGS

SEQ ID NO: 8941 - protein, 505 aa, Unknown
  Synechococcus sp. RS9916
MVVARSTVTVASAPTRFNRADWASAFRNVEQELSQVPVRVASGTVPVELEGCLYRNGPGRLERGGQSVHHPFDGDGMITAVQFAAGEARCSNRFVRTEGWEAEEQAGRFLYRGVFGTQKPGGAMANAFDLRLKNIANTHVVRLGDQLLALWEAAEPHALDPASLETRGLSRLDGVLSKGEAFSAHPRFDPGHHGSPRMVTFGVKTGPRSTIRLMEFATEDDAAAGIRAGDLLCDRRDSFNGFAFLHDFAITPNWAVFLQNAVAFNPLPFVMGQKGAAQCLASKPGGQAMFWLVPRDSGAHAGEEPRLVPAPEGFVFHHVNAWEENGALVIDSIHYSDFPSIGPDVDFRAVDFDSIPEGLLKRCSIDLASGQCSTELLGERCCEFAMVNPAEQGLKARYAWMAVAEREQGNDPLQAIQKRDAQTGATRVWSAAPRGFVSEPIVVARLGGTAEDDGWVLVPVWNGAREATDLVILRADDLSEQAVLELPLAIPHGLHGSWVAGPVMV

SEQ ID NO: 8942 - protein, 224 aa, Zea mays
  misc_feature (12)..(12): Xaa can be any naturally occurring amino acid
  misc_feature (17)..(17): Xaa can be any naturally occurring amino acid
  misc_feature (180)..(180): Xaa can be any naturally occurring amino acid
  misc_feature (187)..(187): Xaa can be any naturally occurring amino acid
VRLKGGDPLVFXRGGEXMDFLQQQGIKVEIIPGITSASGIAAELGIPLTHRGVATSVRFLTGHSRNGGTDPLYVAGNAADPDTTLVVYMGLSTLPSLAPKLMKHGLPPDTPAVAVERGTTPQQRMVFALLKDLVDEVKSADLVSPTLIIIGKVVSLSPFWVESSEHDALKIESSYASEAXDDNTFSXILVIGQYILDWGPFRTCEHRFDLVYTTFQEAWILNDG

SEQ ID NO: 8943 - protein, 493 aa, Unknown
  Shewanella sp. MR-7
MSDNQPQAAKHALMWFRQDLRLTDNQALTAACDWVRQAPGAKLRAIYIATPSQWLSHDMAPIQIDFIQRHVNLLAQGLASLGIEFELIQLDSFKEVPAFLASYCEKLGVERVFAGREPEINEQKRDQACLDAGIPLVLSDEHCLLPPGTVLNLSGDMYKVFTPFSRKWREVAAKRAILPLAVPAPLGPMLPEPKPISFKERFPFTSKLTSSEQWAAGEGQAKRILTAFIQQKAQDYKQDRDFPALEGTSVISPYLALGVLSPRQCIAALLGRFPEVIVDDTSPGRTWLNELIWREFYRHLLVAFPDLSKGHNFNRQADHVQWRNNQAEFLAWCEGKTGYPIVDAAMRQLNQTGWMHNRLRMVVASFLTKHLLIDWRWGERYFRQHLIDGDLAANNGGWQWSAGCGCDAQPYFRIFNPISQSEKFDPDGSFIRKYLPELASWGIKRLHQPNMQKTPSLFEVQMLESDSAYPCAIVEHNAARARALAVLGVLKKA

SEQ ID NO: 8944 - protein, 470 aa, Glycine max
MGSMHIETPETFADGSKNFDDDGRAKRTGTWITASAHIITAVIGSGVLSLAWAIAQMGWVAGPAVLFVFSLITYFTSTLLADCYRSPDPVHGKRNYTYSEVVKANLGGRKFQLCGLAQYINLVGVTIGYTITASLSMGAVKKSNCLHKHGHQDECKVKDNAFMIAFACIQILLSQIPNFHKLSWLSIVAAVMSFAYSSIGLGLSIAKIIGGGHVRTTLTGVEVSGTEKVWKMFQAIGDIAFAYAFSNVLIEIQDTLKSSPPENKVMKRASLIGIMTTTLFYVLCGCLGYAAFGNDAPSNFLTGFGFYEPFWLIDFANVCIAVHLVGAYQVFVQPIFGFVEKWSKENWTESQFINGEHTLNIPLCGSYNVNFFRVVWRTAYVIITAVVAMLLPFFNDFLALIGALSFWPLTVYFPIEMYIKKSNMQRFSFTWTWLKILSWVCLIISIISLVGSIQGLSVSIKKYKPFQAEQ

SEQ ID NO: 8945 - protein, 698 aa, Sinorhizobium meliloti
MNLTFSELDFMKPELGAEYTGQGTHFAVFSAHAEKIELCLFSEDGREETARMPLPKREGDIWSGYIEGIGPGTLYGYRAHGPYDPHNGHRFNPNKLLLDPYAKLVAGDLIWDDALFGYTIGSPEGDLSFDERDSAPFMVKGVVQDPTFDWAGEEAIRRPWTETIIYESHVRGMTMTHPGVPDELRGTFLGMASDPIIEHLTKLGVSAIELMPVQYFLDDRYLVERNLRNYWGYQTLGFFAPHDRYLKGDRFTEFKTMVKRFHSVGIEVLMDVVYNHTAEGSERGPTLSFRGLDNFSYYRQSPDKPRHTYDTTGTGNTLNVAHPLVLRMVLDSLRYWVGVMHIDGFRFDLASTLGREYMEFDREGGFFDAIRQDPILAGVKLIAEPWDVGEGGYQLGGFPPPFREWNDRFRDDVRRFWKGDGGMVPVLAERILGSPVQFRHSDRAATSSINLVSAHDGFTLMDTVSYGEKHNEANGEENRDGHSDNHSDNMGAEGPTDNREIIEARKRRRAAMLATLMISQGVPMVLGGDELGNSQQGNNNAYCQDNEIGWLDWSGADDGFVDFCRKLLAFRKDRPVLRQERFLDGEPDENGRVEIAWYKADGSPMDEDAWHDAELRLICAYICRAGQGEAPPAGEIVLVLNAGGDCEIALPHGNGSRRWLRVLDTAADEPFGMRASADRDTIPAQSVVAFVPQEGSNG

SEQ ID NO: 8946 - protein, 526 aa, Schizosaccharomyces pombe
MARETEFNDKSPSSTDDGMSQSHFSDKLKNLFHFRRNRAATVSTSVRNDQRDNDSDDSTFDINVNQLNELDLNDSSDQLDSRPSLRRVSSAPDSHKGVEAPPPRPLINMSNIRKAQVKILKNPGNYIFGRTEYGKRTYSGNSTKISRVEVTPHSFEKIRLLGQGDVGKVYLVRQKSNHRLFAMKILNKREMIKRHKVNRVLAEQEILTKSKHPFIVTLYHSFQSRDYLYLCMEYCAGGEFFRALHSLPKHILPEKDACFYAAEVTAALEYLHLMGFIYRDLKPENILLHQSGHIMLSDFDLSKPISIVTHPTVVLPKHSTFSQEKPALDTNSYFSNFRTNSFVGTEEYIAPEVIRSCGHTVAVDWWTLGIFIYEILYGTTPFKGKNRHATFSNILYSDVSFPEYHGAPNVSSTCKSLIRRLLVKDESKRCGSVAGASDIKQHPFFRHIQWALLRSMKPPIIPKIEDGMEAVEPSDNDNEEEDFLNSQYLISANLPAVDMHSSTPVNEQSNPFDSFSSVTLHHAGDE

SEQ ID NO: 8947 - protein, 131 aa, Oryza sativa
  misc_feature (31)..(31): Xaa can be any naturally occurring amino acid
  misc_feature (77)..(77): Xaa can be any naturally occurring amino acid
INASGAGCASSGMSCAYNLSRDRSARVSAIXHLRTSSAGPGIGCQLFSAREAHKPAHWSLDKIRLSCRAWAACSIMXHAWILSATAMRLLLRRCNVKLSNARADRTSHERRTCRGKRINQPLVRLKQQTAR

SEQ ID NO: 8948 - protein, 227 aa, Agrobacterium tumefaciens
MKPYIFGDRNNIHIIDLAQTVPMLSRALQVVSDTVARGGRVLFVGTKRQASEIIADSAKRSAQYYVNSRWLGGMMTNWKTISNSIQRLRKVDEILNSEGSGYSKKERLTLEREREKLEKALGGIRDMGGVPDLMFIIDTNKEKIAIEEAKRLGIPVVAIIDSNCDPDHIDYPIPGNDDASRAISLYCDLIARAAIDGIARQQGASGRDIGASEEAPIEPALEDEAGA

SEQ ID NO: 8949 - protein, 344 aa, Desulfotalea psychrophila
MLNKFFIKDKKIMNLTQFPRRNYLQGPTPIEAAPRFSKALGGKVNVFIKRDDLLPGCAGGNKTRKLDFCIADAIEKGADTIITCGAVQSNHCRLTLSWAVKEEMDCHLILEERVPGSYKKDGSGNNFLFNLMGVKSTQVVSGGSDMMGEMEKLAKELEAQGKKPYIIPGGASNAIGATGYVACAQEIQQQLFEQNINITDIVVPSGSAGTHAGVAVGMYGINSGITVSGINVSKPKAVQEENVYKLAKETAKRVGVRGEFPRDEITCFDGYVGAGYSLPTDSMVEAVKLLARTEAILLDPVYSGKVMAGMIDLIRNDYFAPGANVLFLHTGGSPALYAYTDTFK

SEQ ID NO: 8950 - protein, 194 aa, Bacillus halodurans
MRKATIERKTGETQISLTFAVDGEGQSNLTTGVPFMTHMLDLFTKHGHFNLTIDAKGDTEVDDHHTTEDLGICLGLALKEALADKKGIRRYGSAFVPMDETLAQVVVDLSNRPHLEFRADMPSEKVGTFDTELVHEFLWKLALEARMNLHVIVHYGENTHHIIEAIFKALARALDEATTIDPRVKGVPSTKGML

SEQ ID NO: 8951 - protein, 258 aa, Pyrobaculum aerophilum
MFRLGLVQKSPGPLSEVVKMVAGSKADLILLPEYSLFDPTGLKPEEVWERTTALEDFVEGLAKIAAETGAYVAGGFLERGPRPKVFNTTVLVSPAGKAVGTYRKTHLFDAYGYKESEAVEPGGELSGIFDVRQIKIGFAVCFELRFPEVFRELALGGAQLVAVPAAWYSGPLKEEILHVLARARAVENGVFIAVAALYSQRFTGRSLVVNPFGVVEADLGVGSKYRVVTIDPSLVDEARRTVPALNLRRPSLYKRLCT

SEQ ID NO: 8952 - protein, 421 aa, Burkholderia xenovorans
MTDAAAAKAQAAHAGLEAPRTIVVIGGGQAAGWVVKTLRKEGFDGRLVMIADEVHLPYERPPLSKAVLAGEADIETVRLVKPDDFEALNVEAWQPDCATSIDREQRIVRTQSGREVQYDRLVIATGGAARKLPASLVKTSHVAYLRTLDEAVALGERLRASKRVLVVGGGWIGLEVAATARKLGVEATVVEGAPRLCARSLPPMVSGFLLDLHRANGVDVRLNATLVSLEDHPNDANRIRATFADGSTLDADFAVAGIGLTPHTALAQAAGVKVEDGIVVDHFGATDDPRIFACGDVANHPSAWLKRRVRLESWANAQNQAIAAAKALLGIFEPYADIPWFWSDQYDVNLQILGDIPGDAQLAVRGDLPGKRATLFYLEDSAIRGVIAINTPRELKLSRKWMNQGRTIDLATLTDASTALA

SEQ ID NO: 8953 - protein, 277 aa, Arabidopsis thaliana
MISSIKPVLPSLTAIVGIGIYFAIWWALNGVFNNYNKKVLNAFPYLWLTLTLSLACGSLMMLVSWVALAHTIGHVEAIVSMSKVVVSFTHTSSKAVRQPLASLSQASSWARCALAAVMELNFNMIGFMGAMISNLAFVFRNIFSKKGMKGKSVSVMNYYACLSMMSLLIVTPFANSVEGPQMWADGWQNDVSKSDQTLSSKWVVAHSVFYHLYNQVSYIPRCLNHHLPNPLKHVNALGAAIAILGTFIYSQIKNRVKKNHILLVLCLGMLEPLVITL

SEQ ID NO: 8954 - protein, 179 aa, Glycine max
  misc_feature (122)..(122): Xaa can be any naturally occurring amino acid
  misc_feature (125)..(125): Xaa can be any naturally occurring amino acid
  misc_feature (162)..(162): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELKHSFIYHKHNKSPEYYDRHYXPYXKLPIFNYTNTSHILKELQEAKTTYPNHFIHIIKFNNXVRQVQYIIFITYKPPSF

SEQ ID NO: 8955 - protein, 189 aa, Brassica napus
  misc_feature (39)..(39): Xaa can be any naturally occurring amino acid
  misc_feature (130)..(130): Xaa can be any naturally occurring amino acid
  misc_feature (137)..(137): Xaa can be any naturally occurring amino acid
  misc_feature (143)..(143): Xaa can be any naturally occurring amino acid
  misc_feature (158)..(158): Xaa can be any naturally occurring amino acid
STHAVRVRRSLAWHYSMLFSAAVDTSPAQANMDDPFTGXKAASAFPGTRKANNDITSIVSNGGRDNCMQVWPPIRKKNYDNLCYLPDLTEVQLGKEVGYLFRNKRNPCAEFEMEHCLSHREHGSTPRILXRPYWTMXKLTLFXCTDSAQEMKEVQECXTEYPNAFITIIGLYNNRQGQCINYNAYKPPS

SEQ ID NO: 8956 - protein, 240 aa, Crocosphaera watsonii
MFQPFLQHLEKELFSRFDLSSRPIDPELEFQISQRGKNPAMIESWCYQCPQFRKIRYTYINAGETAQIFNSVLYPSYEYDLPLLGVDLLAFGKKKILVVLDFQPLFRDEDYLEKYIEPIAPIRAKYNELAQDLEMKFYDANQYFSPYLLFAKTDAETVVNRLFPAYQEYLQLYWQLLEQAEPKTDSASIERITKAQKDYDQYSAERDPASGLFRSYFGSEWAEEFVHNFLFEDSVPVAVK

SEQ ID NO: 8957 - protein, 540 aa, Alteromonadales bacterium
MAQKQWYKGAVIYQVYPRSFQDSNNDGIGDLRGIINRIDYIKSLGVDAIWISPFFKSPMKDFGYDISDYRDIDPLFGNLNDFDELIEQAHDRDIKIIIDQVLSHTSDQHQWFLDSRENQSNDKADWYVWADSKEDGTAPNNWLSIFGGGAWQWEPRRGQYYLHNFLTEQPDLNFHNPDVRKAVLDNVEFWLKKGVDGFRLDAINFCYHDAQLRDNPAKPKEKRQGRGFSEDNPYAFQYHYYNNTQPENIEFMQDIRALLNKYPGTVSLGEISSEDSLATMAEYTQGGDKLHMGYSFELLTNDYSSEYIRTTVQTLEKGMTEGWPCWAFSNHDVERVASRWSQNGEVNSQQCKMLTALLASLRGSVCMYQGEELGLGEANVAFEDLQDPYGITFWPNFKGRDGCRTPMPWDNADLHHAGFSDTKPWLPVDEQHKQQSVKQQTHDHNSILNAYREFMAWRKTKTVLLEGDIEFINTHEPVLAFYRTFENEKMLCVFNLSNADASLSLPTEVLTEFSELSHHKGYITNDQLLLAPFACYYAKC

SEQ ID NO: 8958 - protein, 152 aa, Arabidopsis thaliana
VVCQNRSNSFLITFYFMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 8959 - protein, 526 aa, Zea mays
METATVVVTPAPVSITHPPQHKFMKSSPARKPAKKKLASGRGGYVLEDVPHLTDYLPELKSYRNPLQDHPAYSVVKQYFVGPDDTVAKKIVVHRSSARGTHFRRAGPRKRVYFEPDEVRAAIVTCGGLCPGLNTVVRELVCGLHDMYGVTSIYGIEGGYKGFYARNTVELTPRSVNDIHKRGGTVLGTSRGGHDTAKIVNSIQDRGINQVYIIGGDGTQKGAASVHEEVQRRGLKCAVVGVPKTIDNDIAVIDRSFGFDSAVEEARRAIDAAHVEAESAENGIGVVKLMGRNSGFIAMHATLASRDVDCCLIPESPFYLDGKGGLLEFAEKRLRDNGHMVIVVAEGAGQDLVAESTRFADTHDASGNKALLDVGLWLSQKIKDHFKKKPSFPITLKYIDPAYMIRAVPSNASDNVYCTLLAHSALHGAMAGYTGFTVGPVNGRQAYIPFYRITEKQNKVVITDQMWALVLCSTNQPCFLTHEDDVERALMMDEEEPHMPLVEGENALFANPSMCNGNGHLCNGHKA

SEQ ID NO: 8960 - protein, 555 aa, Aspergillus nidulans
MAHIFELAESLSPTANYTNGVKSSETLQFPTTETFTGFNSPSRIEGDVENLQITGQIPADIDGTFFRVQPDHRFPPIYESDIHFNGDGNVTAIRITNSTAHFKQRYVRTDRFQAEGQAGRALFGKYRNPYTDNEAVKGVIRTAANTNIFFWRGMLLATKEDGPPYAMDPVSLETIGRYDFEGQVLSPTFTAHPKFDPKTGEMVCYGYEAGGNGNDGSCDIVVYTIDANGVKTEESWYKAPFCGIIHDCGISDKWVVLPMTPLKCDPERLKKGENHWAWDPEEDQWYGVVPRRGGKPGDIRWYRSKNAFQGHTVSCYDTPDGKVVFDLTIADGNVFFFFPPVDTPAGTVAKRNKLQNKTTRWIFDPQNTPTNSWVEPAEEFDTYSGEFSRIDDRFTTRKYNHYWQAVIDGTKPYDFAKCGSPAGGLFNSLGHFTWDGAVRETFWAGPCATFQEPAFIPRAGSTEEGDGYIVALLNHLDVLRNDVCIFDARKIAQGPIAVIHLPFKLRLGLHGNFVEESEIRAWKQKRDRELGPVKAASEPLPWQQEEKANGTNGHA

SEQ ID NO: 8961 - protein, 514 aa, Yarrowia lipolytica
MSSNTGQGPGIASPAPLTNGHTSQPSNTHQDAPVRPTLENGRSYINLDNLSKEKHLRTGSSSTIQEEEPSTRARRSASTSKPPLLVNQNQIQNHQHQQSQYNPQYQPPRVATPKRTPLFDSGQSYSQRFHNRSSSFSVRSARARSLSASSQEALKHLAPPVSVPLVVCCLMWYLSSAMSNTLGKAILTKFGYPVTLSQIQFLVAVCCGATTIQLSQMSPKFRQALPPGMVGPQGLIFPPTRDMLKTTAPMGCFQLSGHILSHMATGMIPVSLVHTIKALSPLFTVAAYRLLFNVQYSPSTYLSLIPLVTGVILTCSTSFRAQFMGIIYALLAALVFVSQNMFSKKLLTSGTTAGPGGPASATHTRKLDKLNILCYCTALAFLFTSPLWFFSEGWTLLKLFFRGEALVKDDSSLFVLMIQLLLNGVVHFAQNLLAFQVLSMVSPVTYSVASLLKRIVVIVWAIIWFGQSVSGIQGFGIFLTFTGLYLYDRCGGDKKKGGQGSSVDGTEKDAQLPK

SEQ ID NO: 8962 - protein, 947 aa, Debaryomyces hansenii
MTVPVVNGSSCLSLYGKNRDLILQAINFYTNVVGLTKDSEESGSVYLRSNNSKVVIKLEESDEALSGSEVKQFTEGLVSLLGVNDWRSIESCITLMVKDLNQLVVALEENNYPVQISPNELYPDEVYTVDPLGNVVGFTVCFNPLTVNPPVKKLAPWNPEQDTMSASTSEFSKIGENGGSSKKRRNIAVMTSGGDAPGMNAVVFAVVRAAIFRGSKAFCVMEGYEGLIRGGSEYIKEMHWQDVRSYLSEGGTNIGTARCMAFKERQGRLTACKHLIESGIDALIVCGGDGSLTGADLFRKEWPSLIKELKDTNAINEEKYETYKHLNICGVVGSIDNDMATTDATVGAYSSLARICQAIDYIDATANSHSRAFVVEVMGRHCGWLALMAGIATSADYILIPEKPASSKDWQEQMCEIVQKHRAKGKRKTIVIIAEGAITLDLKPISSNDVKDILVNRLGLDTRVTVLGHVQRGGTAVAYDRIIGTLQGVEAVKAVLDCTPQTPSPLIAITENKVVRKSLVEAVEITKSVATAIEERDFEKAMSLRETEFVEHLNNFMSMNSANHNEPTLPIEKRKKIAIINIGAPAGGMNSAVYSMATYCMSRGHIPYAIYNGFTGLSRHESVRLMDWLDIEGWTSVGGSEIGTNRATPDETDIGMIAYYFEKYQFDGLILVGGFEAFVSLDQLEKARSMYPAFRIPMVLIPATISNNVPGTEYSLGSDTCLNALMEYCDVVKLSASATRGRVFIIEVQGGNSGYIATFASLVSGAQASYVPEEGIALGQLEMDISSLKEAFSIERGISKAGKLLLKSTNASKVLTTQVLANVINQEANGEFDAKTAIPGHVQQGGLPSPIDRTRGARFAIKAVQYIEDTFDDIRPYRYEMNFPTDNKKVQATAAVLGVESSHLKFRSIRKLYDFETELNKRMPKKISWNEVRDIADQLVGRTRIQK

SEQ ID NO: 8963 - protein, 194 aa, Chlorobium tepidum
MTQRIASHSRKTAETDISATVNLDGSGTSAIETGVVFLDHMLTNFSRHSGIDVQLRCSGDLEVDDHHTVEDVALVLGKAIVDALGDKKGIGRYGWAIIPMDEALAQCSIDLGGRSYCVFRAEFQRPVIQGLSTEMVEHFFVSLSRTMNANLHLAVLEGRNTHHMIEALFKSLAYAMKQAVKVESTEIKSTKGAI

SEQ ID NO: 8964 - protein, 586 aa, Astragalus sinicus
MCGILAVLGCSDDSQAKRVRILELSRRLKHRGPDWSGLHQHGDNYLAHQRLAIVDPASGDQPLFNQEKSIIVTVNGEIYNHEELRKQLPNHKFRTDCDCDVIAHLYEEYGENFVDMLDGIFSFVVLDTRDNSFLVARDAIGVTSLYIGWGLDGSVWIASELKGLNDECEHFEVFPPGHLYSSKEREFRRWYNPKWFSETVPSSPYDPLVLRHAFEKAVIKRLMSDVPFGVLLSGGLDSSLVASVTARYLEDTKAAKQWGAKLHTFCVGLKGAPDLKAGREVADYLGTVHHEFEFTIQDGIDAIEDVIYHTETFDVTTIRASTPMFLMSRKIKSLGVKMVLSGEGSDEIFGGYLYFHKAPNKKEFHEETCRKIKALYKYDCLRANKSTYAWGLEARVPFLDKDFINVAMDIDPEEKMIKRDEGRIEKWVLRKAFDDENKPYLPRHILYRQKEQFSDGVGYGWIDGIKDHAAKHVTAKMMLNASHIFPDNTPTSKEGYYYRMIFERFFPQNSARLTVPGGASIACSTEKAIEWDASWSNNLDPSGRAALGVHVSAYENQVNSSVGKGVEPEKIIPKMKVSPLGVAILG

SEQ ID NO: 8965 - protein, 236 aa, Oceanicola granulosus
MAKKTRKSSGRGQRDLTVKVKTARGRKLSSTLWLQRQLNDPYVKRAKADGYRGRAAYKILELDDKYRFLVPGARVVDLGCAPGGWCQVAVRRTNALGERSDKAVGKVLGIDLQEVEPIAGAEIHQLDFLADDADEQVKDWLAGPADVVMSDMAASASGHKQTDHLRIVALCEAAAYFAFDVLVEGGTFVAKVLAGGAEGSLQTLLKQRFTKVVNVKPPASRADSSEKFVVATGFRG

SEQ ID NO: 8966 - protein, 243 aa, Manihot esculenta
  misc_feature (5)..(5): Xaa can be any naturally occurring amino acid
LVRKXGSFGGGRFSMRRTVKSAPPSIWYGPDRPKYLGPFSEQTPSYLTGEFPGDYGWDTAGLSADPETFAKNRELEVIHCRWAMLGALGCVFPEVLSKNGVKFGEAVWFKAGAQIFSEGGLDYLGNPNLIHAQSILAIWAVQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 8967 - protein, 1422 aa, Vibrio parahaemolyticus
MIEIVIDGKYRIVEEGLTLLEAAKVCGVEIPSLCGMNKSNEKIPCDLCVVEVESGGTKRACDLKVYRGLNVVTQSEQLSEHRRKALNRIMTDHYADCEAPCKTACPAGVDIQSYLYHISQNDHQKAIEVIKRTLPMPLSIGRVCPAFCESECRRSLVDEPIAIRQLKRHAADADLAAHEAYVPEKKPAKHRKIAVVGSGPGGLTAGYYLSNEGYDVTIFESMPKAGGWLRYGIPEYRLPKDILDKEIELMCRNGMQVETNKKLGVDFTLSQLSEDYDAVCLAVGASQAVEMNYPGSDLDGCYLGVDYLKDYVTEQNYVTGKKVAVIGGGNTAIDCARTARRAGADTTLIYRRTRDEMPAEDYEIVEAEHEGVTFHFLTNPAENIADENGRVKAIRLERMALGEPDASGRRSPKPTGEFFTEAFDTVIAAVSQKPDLSFLENDDLSIPLTRWNTSESDSQTMHTGTGNIFSIGDFRRGPATAVEAVGDGRVAAKAIDLFLNGDMADMPKPAFNSRKEKKLAQVDPLHFENIQKVARSIMPELTPAQREQSFAEVELGFDNEEAMKEAARCLECGCQANTDCALRDYSTEYHAEQHFDVSVDVSSASVIGHQDWLDLRAKDLRHKYEVDRSSEFIEFDANRCISCGQCIQACREQAVHGVLSFVSDKNGRPALRPDDRPRFRSDEKGVGCSGLTLMGDSKCVQCGVCVQACPTGAMVDSRDRSQGRTEQLKAVDTICTYCGVGCKLTMFVDERQNKIRYVKGADSPVNQGMLCVKGRFGFDFISSEERLTTPLIRKDGWLQPATWDEAIQLVASKLSTIKQDFGSNALAGFSSAKTTNEDNYAFQKFIRRELGTNNVDHCARLCHASSVTGLEASLGSGAMTNDIPSIKHSDVIFIIGSDTTSAHPIIASHIKQAIRHHGARLIVADPKRVDMAEHAELYLAHRPGTDVMLLNGVMQQIIKNGWYDQEYIEERVDGFDTLLQEVMSPAYNLDKVELVTGVKADDIFAMARMIGTAKRTAVYYSMGITQHTTGHDNVRSIANLQLLCGNIGIEGGGINPLRGQSNVQGACDMGALPNCYPGYQKVYNPIVRQKFAIEWDAPNLPSEQGLTLTEIIDAACKREVRGMYIMGENPVLSDPNQAHVIEGLEALDFLVVQDIFLTETAQYADVVLPSCSFAEKSGHFTNTERRVQRVNAAVKAPGEAKEDWWIIQAIANAMGSDWHYQCVSEITSEIARVTPQYAGLRWDAITPNGVQWPSNKNNPNGTRIMHQTQFTRGKGQMVGVPFRYAAELPDEEYPLVLTTGRVLEQFHTGTMTRKTKGLDNLAGPRAMISVEDAEAIGIHNGQRLKVSTRRGNIEIDAFVTKRMQKGVVFIPFHFVESPVNRLTTTATDPHAKIPEFKVAAVKIEISETAAQPEPVEEAVHHV

SEQ ID NO: 8968 - protein, 479 aa, Thiobacillus denitrificans
MNYLPIFLDLRDRHCLVVGGSETAARKAELLLRAGAHVAVAAPALHAGFEQLPDRQRLTRVADTFSPALLDGKDAVIVVEDDAAAAQIVADAARARHLPVNVADKPALCSFILPSIIDRSPIMVAVSSGGESPVLARLLRARLETLIPAAYGRLSALASRYKARVREAIQPGQRRAFWEKVFLSSVAEMVFSGRDSEAEAQLEAMIKDSAAHEPARGEVYLVGAGPGNPDLLTFRALRLMQQADVVVYDRLVSQPILDMCRRDAERIYVGKERDDHAVPQEEINMMLVRLAKEGKRTLRLKGGDPFIFGRGGEEIETLVEHGVAFQVVPGITAAAGVASYAGIPLTHRDYAQSVAFVTGHLKENTFNMNWEGIARRDQTIVIYMGLKGLPMLCEALIKHGLTADTPAAIVQHGTLPTQRVITGTLATLPTLAVEAGLKAPTLIIVGNVVKLREKLAWYRPQAAGEAAAATPLEAPDHLA

SEQ ID NO: 8969 - protein, 323 aa, Fulvimarina pelagi
MTERHTEVLILGSGPAGYTAAIYAARAMLKPVIISGLQEGGQLTITSDVENYPGYADPVQGPWMMEQMKAQAVNVGSEIVNDLIVEADLDSRPFRLTADSGTVYTCDALIIATGAQAKWLGLESEAKFQGYGVSACATCDGFFYRGKDVVVVGGGNTAVEEALYLSNIAKTVTLVHRRDELRAERILQERLFARENVKLRWNGEIDEILGQDKPMPSVTGVRIRDTRTDETEELAADGVFIAIGHAPAVELFEGKLKQKASGYLWVEPGTVRTSIEGVYAAGDVADDVWRQAVTAAGMGCMAALDAEKWLQTRAIEEQRAAAE

SEQ ID NO: 8970 - protein, 434 aa, Gluconobacter oxydans
MSEHASQSTLNRFFHAPLKEVDAEVATILNEELTRQQDGIELIASENMASFAVMEAQGSVLTNKYAEGLPGKRYYGGCVDVDRVENLAIDRLKKIFGAEFANVQPHSGANANQAAFMALAKPGDTVLGLSLAAGGHLTHGAAPNYSGKWFNSVQYGVRAEDGLIDYDQMEALAREHKPKIIVAGSSAYPRVIDFARFRKIADEVGAYLMVDMAHFAGLVAAGLYPNPVPMADITTSTTHKTLRGPRGGIILTNNPDLAKKVNSAVFPGLQGGPLMHVIAGKAVAFGEALSDEFKAYQKRVLANARALADELQNRGFDIVTGGTDSHLILVDLRPKKVTGKLAEAILERAGITANKNAIPFDPEKPFVTSGIRLGSPAATARGFGEAEFREVGRMIDEVLTAALEEDNAEAVTARVHEEVKALCRRFPIYDRASA

SEQ ID NO: 8971 - protein, 372 aa, Candida glabrata
MHEHSVEKTQILQKYLELPQNGKVIAEYVWVDGTGNLRSKARTLNKVITSIEQLPEWNFDGSSTNQAPGYDSDIYLKPVAFYPDPFRRGDNITVLAECFNSDGTPNKFNHRHEANKLFQAHKDEEIWFGIEQEYTLFDMYDNVYAWPKGGYPAPQGPYYCGVGAGKVYARDVIEAHYRACLYAGINISGINAEVMPSQWEFQVGPCEGISMGDQLWMARYFLHRVAEEFGVKISFHPKPLKGDWNGAGCHTNVSTKDMRVPGGMKYIEQAIEKLSKRHNEHIKLYGADNEQRLTGRHETASMTSFSSGVANRGASIRIPRPVAKEGFGYFEDRRPASNIDPYLVTGIMCETVCGAIENANMSKEYERETNEQ

SEQ ID NO: 8972 - protein, 508 aa, Bacillus cereus
MILDADIKTQLSQYLQLMENDILLKVSAGDDDVSKDMLALVDELATMSSKITVEKVELERTPSFSVNRPGEDTGVVFAGIPLGHEFTSLVLALLQVSGRAPKVEQKLIDQIKNIQGEYHFESYISLSCHNCPDVVQALNVMSVLNSGITHTMIDGAAFKEEVESKDIMAVPTVFLNGESFGSGRMTLEEILAKMGNGPDASELSDKDPYDVLVVGGGPAGASAAIYAARKGIRTGIVAERFGGQVMDTMGIENFISVKRTEGPKLVASLEEHVKEYDIDVMNLQRAKRLEKKELIEVELENGAILKSKSVIVSTGARWRNVGVPGEAEFKNKGVAYCPHCDGPLFTGKDVAVIGGGNSGIEAAIDLAGIVKHVTVLEFMPELKADAVLQERLNSLPNVTVLKNVQTKEITGTDKVNGISYIDRETEEVHHIELQGVFVQIGLVPNTDWLGETVERVRGEIVTDKHGATNVPGVFAAGDCTNNPYKQIIISMGSGANAALGAFDYLIRN

SEQ ID NO: 8973 - protein, 204 aa, Mangifera indica
AATTTQDQSMTWRSNSGLSDGYTYNTNLVGGYYDAGDNVKFNFPMAFTTTLLSWSIIEFGDLMPPNELRNALVAIRWATDYLLMTVSQPNRIFVQVGDPNIDHNCWERPEDMDTARTVYAVDAPNPASDVAGETAAALAASSMAFRWSDPAYAETLLRAAVTVFQFADTYRGAYSDNPHIKEGACPFYCDLMDIKMNCCGEQHG

SEQ ID NO: 8974 - protein, 628 aa, Neisseria polysaccharea
SPNSQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLYLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSQAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 8975 - protein, 356 aa, Securigera parviflora
MSLLSDLINLNLSETTDKIIAEYIWIGGSGLDLRSKARTLPGPVSDPSELPKWNYDGSSTGRAPGEDSEVILYPQAIFKDPFRRGSNILVICDAYTPAGEPIPTNKRHAAAKVFSHPDVVAEVPWYGIEQEYTLLQKEVNWPLGWPLGGFPGPQGPYYCGTGADKALGRDIVDAHYKACLYAGVSISGINGEVMPGQWEFQVGPSVGISAGDEVWVARYVLERITEIAGVVLSFDPKPIKGDWNGAGAHTNYSTKTMREDGGYEIIKKAIEKLGLRHKEHIAAYGEGNERRLTGRHETADINTFLWGVANRGASIRVGRDTEKAGKGYFEDRRPASNMDPYVVTSMIADTTILWKP

SEQ ID NO: 8976 - protein, 275 aa, Prochlorococcus marinus
MTDFLVAALQITSTSNVETNFAEAEEQIELASRRGAELIGLPENFAFLGEDNEKLRLASELAIKCTNFLKTMSQRYQVFLLGGGYPVPAGDNNHTFNRSALFGKDGQVLAKYDKIHLFDVDLPDGNLYKESSTILSGKEHPPVVDVPGLCKIGLSICYDVRFPELYRNLSLNGAELIMIPAAFTAFTGKDHWQILLQARAIENTAYVVAPAQTGIHYGRRQSHGHAMVIDPWGTVLSDAGKTQGAAIAPADKERVKKIREQMPSLKHRKTKLFAE

SEQ ID NO: 8977 - protein, 328 aa, Pyrococcus horikoshii
MVNMHPKIFALLAKFPRVELIPWETPIQYLPNISREIGADVYIKRDDLTGLGIGGNKIRKLEYLLGDALSKGADVVITVGAVHSNHAFVTGLAAKKLGLDAILVLRGKEELKGNYLLDKIMGIETRVYDAKDSFELMKYAEEIAEELKREGRKPYVIPPGGASPIGTLGYVRAVGEIATQSEVKFDSIVVAAGSGGTLAGLSLGLSILNEDIRPVGIAVGRFGEVMTSKLDNLIKEAAELLGVKVEVRPELYDYSFGEYGKITGEVAQIIRKVGTREGIILDPVYTGKAFYGLVDLARKGELGEKILFIHTGGISGTFHYGDKLLSLL

SEQ ID NO: 8978 - protein, 174 aa, Mangifera indica
GGYYDAGDHVKFGLPMAFTVTMLSWSVIEFRDQIAEAGELEHALEAIKWGTDYFVKAHTSPNVLWAEVGDGDTDHYCWQRPEDMTTSRHAYKIDENNPGSDLAGETAAAMAAASIVFKKTNPHYSRLLLHHAQQLFEFGDKYRGRYDASVGVVKSYYASVSGYMDELLWGASWL

SEQ ID NO: 8979 - protein, 184 aa, Saccharomyces pastorianus
MSSLISKTIKYDPKKDKLITLACGCFWGTEHMFRKYLNDRIVDCKVGYANGAESKKDSAHGVSYKMVCGGDTDFAEVLQVSYNPKIVTLKELTDFFFRIHDPTTSNSQGPDQGTQYRSGLFAHSDADLKELTQIKAEWQPKWGNKIATLVEPIKNFYDAEEYHQLYLDKNPQGYACPTHYLRDI

SEQ ID NO: 8980 - protein, 987 aa, Ashbya gossypii
MSVETAYGVAFRSLATTDERLYKATVQFYKRLSFATVKLYDKFKNHGDEMLLSGTSQSSRHETWLMSFKLSEVDSSGCRVPQQEAERKLQSDGAMIKVRLVNEVAAADCGALRVSYYSGSFAEAAAAFPDREEVSEHEFRIRDPLGNEIALTDTPHLHDAVLGEQAVGADFFLSGSGETHRLAQGRETAAALMRSLRETPGAPDSKPKKKLAVMTSGGDSPGMNAAVRAVVRAGIYYGCDVFAVYEGYEGLLKGGEYLKHMQWSDVRGWLSEGGTLIGTARCMEFRERKGRKQAAANLIEQGIDALVVCGGDGSLTGADLFRSEWPSLVEELVSDGRFTAQQVHPYRNLTIVGLVGSIDNDMSGTDSTIGAYSALERICEMVDYIDATAKSHSRAFVVEVMGRHCGWLALMAGIATAADYIFIPERAAPQNKWQDEMKEVCRRHKAKGRRNITVIVAEGALDTELNPITAEQVKTALVELGLDTRITTLGHVQRGGTAVAHDRWLATMQGVDAVKAVLEMTPDTPSPLIGILEEKIIRIPLMESVKLTKQVAAAIQEKDFDKAISLRDTEFIELYESFISTTIKDSTAVPESGPLRVAIVHVGAPSAALNAATRAASLYCLANGHKPFAIINGFSGLIQTGEVRELSWIDVEDWHNLGGSEIGTNRCAAADDMGAVAYHFQKNEFDGLIIIGGFEGFKSLQQLYSARSQYPVFNIPMVMIPSTVSNNVPGTEYSLGTDTCLNALVNYTDAIKQSASATRRRVFVVEVQGGHSGYVASFTGLVTGAVSVYTPEKKIDLHSIQEDLALLKENFRHDQGENRNGKLLIRNEQASSIYTTELIADIIAEQSNGRFGVRTAVPGHVQQGGVPSSKDRVAACRFAVKSVKFLESWNEKAKQAASHDDRQLGFRYVKGVKTPMLPNNDASAAVICVNGSTVSFKPVNDLWQNETDVELRKGHDIHWSEFTKVGDILSGRCNLRKEVDAMRAASA

SEQ ID NO: 8981 - protein, 789 aa, Hordeum vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSSLWDPINVYGAPIEGDMITTGTPLVTPPLIDMISNDPILGGVKLIAEAWDAGGLYQVGQFPHWNVWSEWNGKYRDIVRQFIKGTDGFAGGFAECLCGSPQLYQAGGRKPWHSINFVCAHDGFTLADLVTYNTKYNLPNGEDIRDGENHNLSWNCGEEGEFARSSVKRLRKRQMRNFFVCLMVSQGVPMFYMGDEYGHTKGGNNNTYCHDSYVNYFRWDKKEEHSDLHRFCCLMTKFRKECEGLGLEDFPTAEQLQWHGHQPGKPDWSEKSRFVAFSMKDETKGEIYVAFNTSHLAAVVELPERIGHRWEPVVDTGKPAPYDFLTDDLPDRALTVQQFSHFLNSNLYPMLSYTSVILVSRPDV

SEQ ID NO: 8982 - protein, 527 aa, Alteromonadales bacterium
MLDNNIKNQLKSHFESLTQPVELLIALDDSKKSTEVEDLANDLASLSDKFTLVNNPDTSARRPSVVVHSPVKNTHITFAGVPMGHEFTSLVLALLHTGGHASKAKSEDIEQIQSLDQELNFEIYISLSCQTCPQVVQALNTMAATNSKIKATMIDGALFQEEVEERNILAVPAVYLNGEPFSQGALSLTDILNKVDSKGAARQAAALSEKDEFDVLVVGGGPAGASAAIYSARKGLNTGVVAERFGGQVADTLAIENFISVKATEGPKLVAQLEEHVKEYDVDVMHNQRAAGLERVNNKYEITLENGATLKAKSLVLATGARWREMNVPGEQEYRGHGVAYCPHCDGPLFKGKPVAVIGGGNSGIEAAIDLANIVEHVTVLEFADTLRADEVLIRKANSLNNITIIKNAQTTEVLGDGKKVTGLTYTDRVTGDSKALNLAGIFVQIGLIPNTEWLKISDLALSKFGEILIDAKGATSLPGVYGAGDATNTPFKQIIIAMGSGATASLGAFDYLIRNSEESDKDKTAA

SEQ ID NO: 8983 - protein, 362 aa, Haemophilus influenzae
MQPTLFIDRDGTLIDEPKTDFQIDSLEKLKLEPKVIPALLRLKAKYRFVIVSNQDGLGTDAFPQTNFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQIWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATIHLNVTGNNDHHKIESLFKAFGRTLRQAIRIEGNEMPSSKGVL

SEQ ID NO: 8984 - protein, 186 aa, Mycoplasma mobile
MKHKSNDPRFTEILFTSEEIQIKVKELANWVNETYKNSKDLIFIGLLKGCLPFLIDLAKNVTVEHIWDFMTLSTYSGSTESSGNVKVVMDLKQNIFDKDVLIIEDIVDSGITLEKVVGMLKMKQPKSLKILTLLDKRVNRKNKLEVDKAGFIVPNKFLAGYGLDVKEKLRNIDFIGVFNQEYLDKL

SEQ ID NO: 8985 - protein, 491 aa, Clostridium acetobutylicum
MTSKKEQKNELKRTLTARHMNMIAIGGSVGTGLFFASGSAISTAGPGGALLAYIITGILVYVLMMSLGEMSTLLPISGSFETYATRFVDPALGFTLGWNYWFSWSICVASELVAGSLIVKFWFPHTNTTIWSIGFLLVIFILNILSAKAYGESEYWFSSIKVVTIIIFIIVGVLMIFGIMGNDSPGFKNWVISGNGSRAPFVGGIAAIINVFLVAGFSFSGTEIVGLAAGETENPEENVPKAIKSVFWRILLFYICAIIIIGFLVPFNDKNLLKSGVNNIAYSPFTMVFAKCGIAFAASAMNAVILTSVLSCGNSGLYVSSRMLYSLAKEGKAPKFLAKVNKQGVPMNALYATTLVASSAFLSSLIGEGKIYYVLYNASGITALFAWLGIGICHYRFRKAYVAQGRDLKDLKFKAKFYPYGPIMAIVLCVVIIFGANIWIFQAPKFSWFDFISNYICIPIFIALYIAYKYIKKTKLVPLEECDFEYNGKDK

SEQ ID NO: 8986 - protein, 951 aa, Pseudomonas fluorescens
MTVNLSTANEFIARHIGPRQGDEQAMLNSLGFDSLEALSASVIPESIKGTSVLELGHGLSEAQALASIKAIAARNQLFKTYIGQGYYNCHTPSPILRNLLENPAWYTAYTPYQPEISQGRLEALLNFQTLISDLSGLPIANASLLDEGTAAAEAMTFCKRLSKNKGSHAFFASQHCHPQTLDVLRTRAEPLGINVVVGDERKLTDVSPFFGALLQYPASNGDLFDYRELTERFHAANALVAVAADLLALTLLTPPGEFGADVAIGSAQRFGVPLGFGGPHAAYFATRDAFKRDMPGRLVGVSVDRFGKPALRLAMQTREQHIRREKATSNICTAQVLLANIASMYAVYHGPKGLTQIAQRIHQLTAILAKGLVQLGLTVEQESFFDTLSLHTAGRTAALHDKARAQGINLRVIDAERLGLSLDETTTQADVETLWSLLADGKPAPDFAALAAAVTSGIPAALARQSAILSHPVFNRYHSETELMRYLRKLADKDLALDRTMIPLGSCTMKLNAASEMIPITWAEFGALHPFAPAEQSAGYQQLTTELEAMLCAATGYDAVSLQPNAGSQGEYAGLLAIRAYHQSRGDERRDICLIPSSAHGTNPATANMAGMRVVVTACDARGNVDIEDLRAKAIEHREHLAALMITYPSTHGVFEEGIREICGIIHDNGGQVYIDGANMNAMVGLCAPGKFGGDVSHLNLHKTFCIPHGGGGPGVGPIGVKSHLAPFLPGHAALENKKGAVCAAPFGSASILPITWMYISMMGGAGLKRASQLAILNANYISRRLEEHYPVLYTGSNGLVAHECILDLRPLKDSSGISVDDVAKRLIDFGFHAPTMSFPVAGTLMIEPTESESKEELDRFCDAMIRIREEIRAVENGALDKDDNPLKNAPHTAAELVGEWSHPYSREQAVYPVASLVEGKYWPPVGRVDNVFGDRNLVCACPSIESYQDA

SEQ ID NO: 8987 - protein, 720 aa, Clostridium acetobutylicum
MVISNAFVTQFNKIEFQIDDFTNFLLSKITVRNTDGEIKINEYRLYKNNVCLLIDNIDIKKNYYVSYDKVTLKCSYYKLFSTTEFNNKYAYNGKLGITYTREKTTFRIWSPGASSIELLLYNHDITSNEPATSIKMKEDNGLWFLILKGDFKNFYYNYKVTIYNYTKEVVDPYAKAVGINGLRGAILDSYSTNPPNWKKDFVPQSIEHFTDAIIYEISINDISLNPNSGILHKGKYLGLCEENSKTINNIPTGIKYLKSLGITHVQIMPIFDFSYKSIDETNPINYNWGYDPQNYNVPEGAYSTDPYNPRSRIYELKTLIKTLHENGICVNMDVVFNHLWNEKENNFEKIFPEYYLRRNDDNSFSNGTGCGNDTASEHYMFQKFILDSIKYWVKEYHIDGFRFDLMGIHDIETMNKLRDELNKINSNIMLYGEGWDLTTNIEKTRKAIILNSSKTPEIGYFNDVIRDALKGSVFIPKDTGFISGKFNLEKTILYTTLGCCLDVKDYKKIFSSPSQSINYVSCHDNNTLYDKLCTSNPHDNDDIRKEKIKLAIGILLTSQGIPFLHCGVEFARTKFGITNSYNSAKEINWIDWDLRDKNKDLVNYVISLIAFRKNHSAFRFVYPNDLKNHLEITQNMPKNSIGYILKNHANNDAFKDIMVIYNANTHDIQIPLDSTWNVCIDKYNAGSEKIRTASKFYIAEALSINVLFKNSENSFLHLLL

SEQ ID NO: 8988 - protein, 450 aa, Clostridium acetobutylicum
MSECFKLELKNTKPYLQDEELKNLKPAVAAAHEAIHNGTGAGNDFLGWVDLPVNYDKDEFERIKKSAEKIRNSVDAFIVIGIGGSYLGARAAIEMFSHSFSSSISKEERKNPEIFFCGNNISSTYLADLLEAIEGKDIAVNVISKSGTTTEPAIAFRIFKELLEKKYGKEEAKNRIFATTDAKKGALKTLSDNEGYETFVVPDDVGGRYSVLTAVGLLPIAVAGIDIDEMMKGAAKAREVYSEPDLEKNEAYQYAAARNALYSKGKSIEMVVNFEPSLHYFGEWWKQLFGESEGKDGKGLFPAAGDFSTDLHSMGQYIQEGRRQLIETFINVVNPKKEVTIQKDAENLDGLNFVAGKTMDFVNKQAFMGTVLAHHDGGVPVMVVNVPELTAYYFGYMVYFFEKACGISGYLLGVNPFNQPGVEAYKKNMFALLGKPGYEDLAKELNNKLK

SEQ ID NO: 8989 - protein, 838 aa, Glycine max
NLILKNNQLIGPIPSTLSQIPDLKILDLAQNNLSGEIPRLIYWNEVLQYLGLRGNNLVGSLSPDMCQLTGLWYFDVRNNSLTGSIPENIGNCTAFQVLDLSYNQLTGEIPFNIGFLQVATLSLQGNKLSGHIPPVIGLMQALAVLDLSCNLLSGSIPPILGNLTYTEKLYLHGNKLTGFIPPELGNMSKLHYLELNDNHLSGHIPPELGKLTDLFDLNVANNNLEGPIPSNLSSCKNLNSLNVHGNKLNGSIPPSLQSLESMTSLNLSSNNLQGAIPIELSRIGNLDTLDISNNNLVGSIPSSLGDLEHLLKLNLSRNNLTGIIPAEFGNLRSVMEIDLSNNQLSGLIPDELSQLQNMISLRLENNKLTGDVASLSNCISLSLLNVSYNKLFGVIPTSNNFTRFPPDSFIGNPGLCGNWLNLPCHGARPSERVTLSKAAILGITLGALVILLMVLLAACRPHSPSPFPDGSFDKPVNFSPPKLVILHMNMALHVYEDIMRMTENLSEKYIIGYGASSTVYKCVLKNCKPVAIKRIYSHYPQCIKEFETELETVGSIKHRNLVSLQGYSLSPYGHLLFYDYMENGSLWDLLHGPTKKKKLDWELRLKIALGAAQGLAYLHHDCCPRIIHRDVKSSNILLDADFEPHLTDFGIAKSLCPSKSHTSTYIMGTIGYIDPEYARTSRLTEKSDVYSYGIVLLELLTGRKAVDNESNLHHLILSKAATNAVMETVDPDITATCKDLGAVKKVYQLALLCTKRQPADRPTMHEVTRVLGSLVLSNTPPKQLAALPPASNPSAKVPCYVDEYANLKTPHLVNCPSMSTSDAQLFLKFGEVISQNSE

SEQ ID NO: 8990 - protein, 523 aa, Beta vulgaris
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAGSYGRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGVKGGALAIFAVLGIPLAITFSIPFALASIFSASSGSGQGLSLGVLNLAIVVPQMFVSVTSGPWDALFGGGNLPAFVVGAVAATASAILSFTLLPPPPPEAKIGGSMGGH

SEQ ID NO: 8991 - protein, 321 aa, Unknown
  Burkholderia sp. 383
MTSRQHPLHSGFGAASTANDVLVDLDLDGKTAIVTGGHSGLGLETTRALAQAGATVIVGARNADAAREATRGIAGVEIAALDLADLASVAAFAARFVEARRDVDIVINSAGVMACPETRVGDGLEAQMAVNHLGHYALVNGLWPVLAQGDGARVVAVSSLGHRLSPIRWDDAQFAHGYDKWLAYGQSKTANALFAVQLDALGAPYGVRAYSLHPGKIATPLQRHLTREEMMAQGWVDEHGLPIDPTFKTPAQGAATQVWAATSPRLAGIGGVYCEDCDIAVVTQGNEESGVRPHAIDPEEAARLWAWSAALTGIDAFAVRR

SEQ ID NO: 8992 - protein, 150 aa, Zea mays
SSSFGAHQTRPSGGGPRSVRAYAKGDEEGDKQSLFGSITEALDFSQVRSEKDAELLYEARESTKGGRAWSRPRYGALRRKIGGTYQDFFKSYVEVDGQYVEEGWVDKTCKICKKDTRGEPRQVDKLGRYAHVACLENPKPANFFAKIFAR

SEQ ID NO: 8993 - protein, 305 aa, Novosphingobium aromaticivorans
MRAESILATIGNTPHIRLSRLFPDHEVWVKCERANPGGSIKDRIGLAMIEAAEADGSLKPGGTIVEPTSGNTGIGLAMAAAVKGYKLILVMPESMSLERRRLMLAYGATFDLTPREKGMKGAIERAKEIVDQTDGAWMPQQFDNPANVSVHVRTTAQEILKDFGSEPIDVLITGVGTGGHLTGCAEELKKHWPSLKAYAVEPTLSPVISGGQPGPHPIQGIGAGFIPGNLHTQSIDGAIQVDPADAKEMARLCASKEGMLVGISSGATLAAIAQKLPSLPAGSRVLGFNYDTGERYLSVPDFLPE

SEQ ID NO: 8994 - protein, 519 aa, Zea mays
  misc_feature (472)..(472): Xaa can be any naturally occurring amino acid
  misc_feature (499)..(499): Xaa can be any naturally occurring amino acid
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMXCQGWKERLHNKQRGRPRSRPAGRRILXIRSGIVVVLKNATIKDGTVI

SEQ ID NO: 8995 - protein, 99 aa, Prochlorococcus marinus
MASYKVTLISESEGLNKTIEVPDDQYILDAAEEQGIDLPYSCRAGACSTCAGKLTGGSVDQSDQSFLDDDQLEAGFVLTCVAYPTSDCTIKTHAEEELY

SEQ ID NO: 8996 - protein, 557 aa, Escherichia coli
MRKPVYYMEILLTILILTLVVSLTSVLTRLSPVQIPLPLIQIAAGAVLAQPIFGLHVEFNPELFLLLFIPPLLFAESSKIQPKELIKHSREIISLALVLVLITIFGVGYVIHLLLPNVPLIAAFALAAVLSPTDAVALLGIVGKGRISKNIQEVLEGEALMNDASGLVALKFAVAVTMGTMEFSVHGATIAFFVVALGGIAVGIAVTWLYGKGLLLISRYAHDEPSIQIVLMLLLPFIVYLVAEHFGLSGILAAVAAGLTTSRIGVVHHAPIRLRIKAKSSWSMLEYVFNGMVFLILGLQLPGIISESLIRAENDPLVDTGSLLLDVIWIYLALMVVRLGWLWLMRLYSRKRPGKHPMLFAGYKTRHMLLATFAGVRGAITLAGVLSIPLLLPDGTPFPGRYLLVFLATGVILFSLVCGIIILPLLLGKNVGIFSDNRQKEEEAADLFMAKMAILSVQKTEQRLLRARTENLDNELIMETGARVIGYMRHSEEDMSPNDNSLHMQRAKLERTFNLAALNAKRAAIYQMRARQEVSDETLAKIVSELDVLETLIMDSR

SEQ ID NO: 8997 - protein, 336 aa, Haemophilus ducreyi
MTTDDTRPIAVLGAGSYGTALAIALARNGQRTHLWGHNPDKMVKMAEQRMNTESLPAIPFPNALIIEKVLAHTLQQAQDILIVVPSHAFADILHQIKPLLTTQHRIMWATKGLEHNTGRLLQTVATEIIGEQHPFAVLSGPTFAKELALGLPTAITLASHDAKFADEMQQRIHCSKAFRVYLNTDMIGVQLGGAIKNVIAIGAGISDGMGFGANARTALITRGLAEISRLGESLGANPKTFMGMAGLGDLVLTCTDNQSRNRRFGLALGQGKSAEQAIAEIGQVVEGFYNTKETYLLAQRQNIEMPIVEQIYQMLFCNKNANDVVTSLLERQRKKE

SEQ ID NO: 8998 - protein, 444 aa, Unknown
  delta proteobacterium MLMS-1
MEKVTEFMKVVTDKNPGESEFHQAVLEVVETLMPFIEDNPKYQETKILERMVEPERVIIFRVPWVDDKGEVQINRGYRIQMNSAIGPYKGGLRFHPSVNLSILKFLAFEQVFKNSLTTLPMGGGKGGSDFDPKGKSDNEVMRFCQSFMTELYRHIGAETDVPAGDIGVGGREIGFMFGQYRKITNEFTGVLTGKSRNWGGSLIRPEATGYGAVFFAEEMFKVRGDSLAGKTCIVSGSGNVAQYTIEKVNQLGGKCVTLSDSAGFIHDPEGIDDEKLAYVMELKNVKRGRISEYAEKYGCKYYPGERPWKIPGDVAFPSATQNEIDAQDAETLVAGGCTCVSEGANMPSTSEAVRIFLKAKIMYGPGKAANAGGVATSGLEMSQNSLKLSWPREEVEERLRQIMEGIHEACYKYGKEGDFVNYVKGANIAGFVKVADAMIEQGVI

SEQ ID NO: 8999 - protein, 1048 aa, Unknown
  Photobacterium sp. SKA34
MNIETAKDSYINNLYSEKDHVPAVLENHTINGINKELPRPYLFPFVSRTEAIINKPEKAENFLSLNGLWHFNCSYNPSSRPKDFYRIDFDCNHWATIKVPGNWEAQGWDNAIYVDERFPFDTSWPEVPRDYNPVGSYRREFVLNEAWDNREIFLHIGGVRTAAFIWVNGERVGYTQNAKNPAEFNITKHVLSGKNIIAVEVYRWSNASYLEKQDMLDMSGFERDVFIYSTAKARIYDAQFSNELSDDWQSASFDVDLTLTNSGKEEKYLISTELLDDSTGFSSVFVANTALYVDDRGSINFQGTLDSPRLWTSETPNLYTLLLTLSNSDGEVLETCSHKVGFRRVEIVDGMLLVNGVAIKIKGVNRHELHPTLGHVPTEEYMIQDIKLMKQHNINAVRTSHFPCHSRWYQLCDEYGLYVIDEANIESHPLALKPETQIGDTESWIPAHLDRVKAMVERDKNHPSIIIWSMGNEAGTGCVFETLYQWIKEKDSSRPIQYEPAGEAPYTDIVCPMYPTLERLEEFALKGDTRPMIMIEYAHAMGNSLGILGNYWEIIDKNTNLQGGFIWEWMDHALELTNDRGQKFWGYGKDYHPTMPTDGNFMNDGLVSPNREPHPHMEEVKKVYSPIRFIADDLTEGSFRVENRYDFIDLDHIQLFYEVLSNGVSIDCGSLDSIVIKANSHQIVNVPLKTIHYCDDAEHIITISARLKDATGLLEAGHELGLEQFNLSPSLINTLRTITNEQKLTLDKTTQDIQILGSDFSLVFDCKTGDITNYSHRGTKLFISGFTPNFWRGVTDNDLGANLHESSAVWKDAGRSKILSSIESYFVDEHSIIVQAKYELPAVHSYISITYHITSSGEFKVDINFEPTDLTLPIMLRFGAQIEMPQMFNFMQWYGRGPGETYSDRKGAKIGIYGGTTWDQFHAYPRPQESGNKTDVRWMKLTNIDGQGIEVEAHDTLLNTSAWPFKSTELDFIADTSSKSASGLTPISQKHGVDVQPSNITTLNIDLAQMGTGGQNSWGSLPPLKYQLPIQKLNYSFIVRPINTNKNK

SEQ ID NO: 9000 - protein, 2062 aa, Streptococcus suis
FLSGAGQLVQAEEVVLPASTSSTTLSEQDGGAVEATTTAIEATDSMVAEATAVTETADATAPEEAPIEEGSIRLHFENVDETAPESQGLWTWGGVAEPSDSNQWPTDTANFSSSQVDDYGHYVDIKKSETPGTIGYLVLKNGEKITESDQKVELLVPEQNEAWISSDYSVSSYEPLKDENVLRINYTREDNNYEGWGVWTWGDTTEASDGWPTGAVDFKLGKYGAYVDIPLSNGLDSKLGFLLINQNNPDLAGNKTIDLAFADRKRHSQIFLRNGDDKVYTNPYFIEEKVELDTSKATPGTKNVTVEASVKAPFNYNESGLVSVTVTNPENAEIVKMEVDTSAIGGGLVPISTELNRVTIKATSSTAPGTYSLPVKVYDKDNGYYETKLDVTITERVKADGEKDWDEQVIYFMMTDRFYNGDTSNDKLVEGTVTNPRGLYQGGDFKGVTAKLDYLKELGVDSIWLTPIVENIPQNVGSVKDGEYYAYHGYWASNFEKLNPHLGSLADFHELIDAAAEKGINIVVDVVLNHAGYGTEETFAGMVRTKEEDKQADDQLGSLSGLPDFKTEEAAVRNQLVAWQASWLERSTTAKGNSIYAFRVDTVKHVDDTTWQHFKNELVDRDPDFHLIGETWGANYKDTKGDLGIGTMDSLLDFGFKDIAKYLVNGQLKAAGKELEERSKVLTSAASLGQFLGSHDEDGFLYSLGGAEKEGNLDKLKLAASLLITAKGQPVIYYGEEVGQSGQNNWPVYDNRYDFDWSKVETSDITDHYQKLLAFRNANSTLLSRGDTSTLAGNDSQGWLISKRSYQDQAAYLVFSTNTESKEMALEVSSKDVVVTDAYTGKSYQAIEKGGKWVVQVELPTIGQGGTMLLQTEAGDIVNASVQGATEEPIEAGYFRVHFKTLPSDNLSSLGLWTWDDVEKPSSDVGAWPTGATNFSTAKQDDYGYYLDIKMKDETASKISLLINNTSGDNITGDKTIERISTKMNEAWFDENYQLSLYQPLKEGCIRINYFRTDGNYDQKGLWIWGDVTDLTLGDWPNGIDFENQGKYGAYIDVKLTDLPSSIGFLLLDESKSGDDVKIQQKDYSFKDLKNQTQIFLKDDDATIYTNPYFVNNVRVTGVSHVSLTALEAAFTTLEGADKDSILEKLSVTDKNGQTVAVTDLVLDLTSNKVRVLGDFNQENAGYTLKYGNDSFTTTMSWQLKDELYAYDGELGARVRQAGSVVDMTLWSPSADSVAVVLYDKDDQSKVVGKLAMTKGDKGQWDLELNSQSGLGIADYRGYYYHYEITRGGQSVLVLDPYAKSLAEWNSDLADTDPSYRIAKAAIVDPAEVGPSDLNYATIPNFNQREDAIIYEAHVRDFTSDPAISDELTAQFGTFAAFAERLSYLKDLGVTHIQLLPVMSYYFVNELKNAERMSEYASSNSNYNWGYDPQSYFAFTGMYSTDPTDPMKRIEEFKNLVNEIHKQGMGVILDVVYNHTSKTFLFEDLEPNYYHFMEADGTAKSSFGGGGLGTTHYMSRRVLVDSIKYLVDEFKVDGFRFDMMGDHDAEAIELAFTEAQKLNPNIIMLGEGWRTFTGDANQPVQPADQDWMSSTDTVAVFSDEIRNTLKSGYPNEGQPAFITGGAKSVESVFNNIKAQPGNFLADDPGDVIQYIAAHDNLTLFDIIAQSIKKDPSIAENYTEIHQRQRLGNLLVLTAQGTPFIHSGQEYGRTKQFRHPDYKEPVSEDKVPNKAHLLTNADGTPFDYPYYIHDSYDSSDAVNKFDWTKATDEALYPENTRTQAFTKGLIALRKSTDAFRLGTKEEVEQKVSLISIPGQNGIAKNDVVIAYQTIASNGDRYAVFVNADSKERSFVLSDIYKELLKGHVLVDGKRAGIAALTDLVGVTLTDDAVVLAPLTATVIRLPYITTAVPDTAPTAEEKPSLDFTTKERTEEKILPIVEEIRYDASLSTDQSYVLQEGKTGKKVLVYQDVLIDGKVVATNLLSETVVDSETRIVVKGSMEAKKEAEKPSLSTTAQASGQATSGASKASLPITGDRQSDLALLGLGLAGLGLTVAAQGRTKKSEE

SEQ ID NO: 9001 - protein, 351 aa, Glycine max
PRVRLGLSEALLAPAIPSVSARAGGIFLPLVKALCVACGSNAGDGTEHRLGASPVLTCFQTSVITSAMFLTAMAANPLCATLTLNSINQTIGWLDWAKAAIVPGLASLVLVPLILYVIYPPTLKSSPDAPKLAKEKLEKMGPMTTNEKIMTATLFLTVGLWVFGGLLNVDAVSAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAIVLSFLSNLMGGLTHYGIGSAPVFFGANYVPLAKWWGYGFLISIVNIIIWLGLGGVWWKFIGLW

SEQ ID NO: 9002 - protein, 346 aa, Unknown
  Nierembergia sp. NB17
MEVASRVQAIASLIKCMDTIPSEYIRSENEQPATTTLHGVELQVPVIDLAPRVVGDEQHDHDDVEVVKQIADASKEWGIFQVINHGIPNDVIADLQKVGKEFFENVPQEEKELIAKTPGSNEIEGYGTSLQKEVEGKKGWVDHLFHKIWPPSSINYRYWPKNPPSYREANEVYGKKLREVVDKIFKSLSLGLGLEAHEMKEAAGGDDIVYLLKINYYPPCPRPDLALGVVAHTDMSYITILVPNEVQGLQVFKDGHWYDVKYIPNALIVHIGDQVEILSNGKYKSVYHRTTVTKDKTRMSWPVFLEPPSEQEVGPIPKLVNEANPPKFKTKKYKDYVYCKLNKLPQ

SEQ ID NO: 9003 - protein, 476 aa, Arabidopsis thaliana
MASWIFKLLLLLQCVLVLIQHADSSSIIRYLPGFEGPLPFELETGYIGVGQKEEDQLFYYFIKSENNPEEDPLLVWLTGGPGCSSFSGLVYENGPLAFKVETYNGSVPTLVSTTYSWTKVANIIYLDQPVGTGFSYSRNPFADIPSDTGSVKRVNEFVRKWLAKHPEYFSNPFYVTGNSYSGKVIPAIVQEISNGKFLSLQPLYMQALYFDSSFLIIYFTTGNYICCKPQINLQGYVIGNPVAYYDHDKDFRIPFAHGVALISDELFESLKASCGGSYSVVDPLNTECLKLIEDYDKCVSGIYEELILKSKCEHTSPDCYTYRYLLSEYWADNETVRRALKVVKGSKGTWERCDYRVLSNQDIKSSIPFHINNSIRGYRSLVISGDHDMTIPFLGTQAWIRSLNYSITEKWRPWMILDQVAGYTKTYANKMTLATVKVCSFIHIYMSNKNAKLVYTSLLIGLWVWFIIGRWAHIGI

SEQ ID NO: 9004 - protein, 212 aa, Escherichia coli [sequence omitted]

SEQ ID NO: 9005 - protein, 367 aa, Unknown
  Nierembergia sp. NB17
MAPSTLTALAEEKTLQTSFIRDEDERPKVAYNQFSNEIPIISLKGIDDDQSGKRGEICDKIVKACEDWGIFQVVDHGVDVELINKMTTLAKEFFALPPEEKLRFDMSGGKKGGFIVSSHLQGEAVQDWREIVTYFSYPIRARDYSRWPNKPEGWIAVTEKYSDTLMALACKLLEVLSEAMGLEKEALTKACVDMDQKVVVNYYPKCPQPDLTLGLKRHTDPGTITLLLQDQVGGLQATKDNGKTWITVQPVEGAFVVNLGDHGHFLSNGRFKNADHQAVVNSNSSRLSIATFQNPAPEAIVYPLKIREGEKSIMEEPITFAEMYRKKMSKDLELARLKKLAKEQQLQAEVAAEKTKLESKPIEEIFA

SEQ ID NO: 9006 - protein, 349 aa, Ralstonia eutropha
MFLRNCWYMVGWSTDFTADAIVPFTVMDEPLAIYRKTDGSLAALEDRCCHRLAPLSVGRKEGDELRCMYHGLKFAADGRCTEVPGQDRISPRVCVRAYPIVEKHGAAWVWMGEAEKADEALVPPIIGPDNAEWAMQCSTFDMDVNAELISDNLLDLSHAPFVHEATFGASDPVALKMMKESETKRGVTQLERGVLADRWQLGRQSNPYFGARPCDDHVVSLFLVPGVFILTITSYEPGVLERSEGGDVTETPIFKRCTCQMITPISKNKSRFFFNFGPWAAAADLKQHCFGIADAAFQEDKRIIEAQQDMIHRSPGRKFVLLPMDQPVVRYNEIYARLLAVEKPVAEPA

SEQ ID NO: 9007 - protein, 243 aa, Rhodopirellula baltica
MPVPSLFASSSRLLAPLAAVGLLTVLTSCVQAAPPVSANSDDPNANPNFNGLPFDSEIVEVKTRPGEEVATLAGGCFWCTEAVFERMEGVNDVVSGYIGGKIKNPNYKQVCGKMTGHAEAVQIYYDPSKTNFEELLKVFFKTHDPTTLNRQGADGGPQYRSSIFVHNDEQREIAKKTMEKLGEEYRDPIVTLIEPATKFYVAEEYHQDYYRRNPNAGYCQAVVAAKVRKFNRNFGDKIKGSGK

SEQ ID NO: 9008 - protein, 613 aa, Brassica oleracea
MEPCDCFETNANQDDLLVKYQYISDALIALAYFSIPLELIYFVNKSAFFPYKWVLMQFGAFIILCGATHFINLWMFFNHSKVVAIVMTLAKVSCAAVSCATALMLVHIIPDLLSVKNRELFLKKKADELDREMGLILTQEETGRHVRMLTHEIRSTLDRHTILRTTLVELGKTLCLEECALWMPSQSGLYLQLSHTLSHKIQVGSSVPINLPIINQLFNSAQAMHIPHTCPLAKIGPPVGRYAPPEVVSVRVPLLHLSNFQGSDWSDLSGKGYAIMVLILPTDGARKWRDHELELVEVVADQVAVALSHAAILEESMHARDQLMEQNFALDKARQEAEMAVHARNDFLAVMNHEMRTPMHAIISLSSLLLETELSPEQRVMIETILKSSNLVATLISDVLDLSRLEDGSLLLENEPFSLQAIFEEVISLIKPIASVKKLSTNLILSADLPAYAIGDEKRLMQTILNIMGNAVKFTKEGHVSIIASIMKPESLRELPSPDFYPVPSDNHFYLCVQVKDTGCGIHTQDIPFLFTKFVQPRTGAQRNHSGAGLGLALCKRFVGLMGGCIWIESEGIEKGCTASFIIRLGICNGPGSSSGSMALRLAAKSQTRPWNW

SEQ ID NO: 9009 - protein, 241 aa, Candida glabrata
MSEDFNSAKFLNKQLKARGLQKLRFYCQVCNKQCRDQNGFKSHVKSPSHLKNISTVTQDDILEFTKLFEENFLNTLKTNHGEKKIAVNKLYNEIIKDRDHIHMNATSFKSLTGFIKYLSKEGKIKVYDDNIGDMPEDQVDLTQLNISFIDNSDTNLRRKEKLQEIEAEELTESKLEEYLRTKRQLREQEEEESDVQDTDLGSNTDIQRDNLTNLKIQLKKTKIKQNKVKKPLNKNKNNVFG

SEQ ID NO: 9010 - protein, 1047 aa, Ustilago maydis
MLARASRGSFVRASNSVAASTSHWLGNARRGNAPATCQVGSCPRLLSSSSSTALPRQLPRRSIQHDEHQDDTFRTTPTPYTSNNVSDELSGTDPSIPWFLQTETIDLPRSSDAQSEMPLATQSEASAPANTFSYIPLAPKVTEPNAIAELKSHLLTGPSANLIARPSEQDDQLTPITLIHPASLSKDLSSDAYGINDWIVVVQVKSSAAGSVRRVALDLGQFLKHQRPPAMENGLDLDDFLGPGPSTPRYTKPSVPKSSTPAATPRPKGMSRIEHELGKSLPDWAVHRIALQRKFPDGWRPPKILSREAQEGIRLLHSSDPEQFDVVELSNRFRVSTESIRRILRSGKWAVSGQVRSRQDRRAAERASERESSELAEIRRLQEEHSELVQDGESPTIEQDDLLDNLLEEEDTTPGIQPVRYEGLVMSASDASALGVTSKSKTGGNKGDGNWCLVDADWCMVHVMTEQARFNYDIEGIWRELEVGTTIQRKPWEQEGAFGSASSVAATKPSRPRTKRDVFGEKLDNRKRDKNAAAKFGSSSRGFSSCAKASVQVGARSWSDTVVPESLGQLLSRVQRTFESGSTDPVGVDVKGWLRSTRKQKSITFLELSDGSLSGSRSLQAVVRSSKDSPTSDMDRLAGLTVGTALRLTGHLRPGRGTKIGQEIELDASSVQVLSNCDLTYPLAAVQMQHNSTAIEQGGYSATLAERRNPHLLGRLPRYAAVARTRSRLEHAMGEFLASHDFVKVACPVLTSSDCEGAGEVFQVVADSDARSKHDPAAFWSGSHAYLSVSSQLHLEAAGLGLGRVWTCNPAFRAEGSATNRHLAEFWMLEAEMYFTDLAGILHVTEQMIKAGITAALAGTQDMELLADEAHLSMLASVATAQAWKRITYHEAHQLLSHAPAGTFECAPHVDSGLASEHERYLAAHFGPVFVTHYPLSQKAFYMKRYSSCPTLVECFDLLIPSLGELVGGSVREHRRSSLTENLAELACGVAMSDKLAWYLDDLKKFGGALDHAGFGMGIERLLAWVTNTTSVKDVVPFPRVKGRMRF

SEQ ID NO: 9011 - protein, 356 aa, Securigera parviflora
MSLLTDLVNLNLSESTEKIIAEYIWVGGSGLDIRSKARTLPGPVSDPAKLPKWNYDGSSTDQAPGEDSEVILYPQAIFRDPFRRGSNILVICDVYTPAGEPLPSSYRYNAAKIFSHPEVAAEEPWYGIEQEYTLLQKDINWPLGWPVGGFPGQQGPYYCGIGADKAYGRDIVDAHYKACLYAGINISGINGEVMPGQWEFQVGPSVGISAGDEIWAARYILERITEIAGAVVSFDPKPIPGDWNGAGAHTNYSTKSMREDGGFEIIKKAIEKLGLKHKEHIAAYGKGNERRLTGKHETADINTFSWGVANRGASVRVGRETEKEGKGYFEDRRPASNMDPYIVTSMIAETTILWKP

SEQ ID NO: 9012 - protein, 169 aa, Zea mays
  misc_feature (144)..(144): Xaa can be any naturally occurring amino acid
NFEMAAATSSSPKSVHDFTVKDAKGNEVDLSIYKGKVLLIVNVASQCGLTNSNYTELAQLYQKYKDHGFEILAFPCNQFGNQEPGSNEEIVQFACTRFKAEYPIFDKVDVNGDKAAPIYKFLKSSKGGLFGSGIKWNFSKFLVXKDGNVVDRYAPTTSPLSIEKDLKKL

SEQ ID NO: 9013 - protein, 229 aa, Mycobacterium avium
MRIIVTGGNSGVGKATAHAMAAAGHEVVIACRSLTKAHQAAASMPGDVTVRELDLADLTSVRKFADTVDYVDVLVNNAGVLGLPLTRTADGFEAHMGINHLGHFALTCLLGDRIRDRVVLVASTNYNTARMHFDDLNYHHRRYNPWSAYGESKLANLLFVRELVARGKTAYASDPGMTDTGITRNGSGVLQWAGRVLSPHIAQSPADGARSEELSRPVDWGVSGDLRFG

SEQ ID NO: 9014 - protein, 567 aa, Coccidioides immitis
MGFSEKEISQEDSTSVQLPPFASKDEEVALEVEVAQDQPGFWTRMGCTPESFKKRTLADKHNQLNQTLKSRHLHMIAIGGSIGAGFFVGSGSALAKGGPASVVIDFAIIGVMIFNVVFALGELAVMYPVSGGFYIYSSRFIDPSWGFAMGWNYVLQWLIVLPLELTVASLTINFWKVDLSVAVWITVFLAAIIIVNIFGVLGFGEEEFWSSALKLSAVVIFMVIAVVLVCGGGPKDGIYSEYWGARLWYDPGAFRNGFRGFCSVFVTAAFAFFGTELVGLAAAESKNPLKSLPSAIKQVFWRIILFYILGLFFIGLLVRSDDDRLLGANPLIDTNASPFVIAAHDAGLVGFDSFMNVIILVSVFSIGNSAVFAGSRTLTAIAEQGYAPRIFSYVDRAGTLIAFGGLAYVNVTASGVEIFDWLLALSGLTALFTWGSICLAHIRFRAAWAHHGRTLDEIPFKAALGVWGSWVGLCLVCLVLIAQFYIAICPVSGGINDAKGFFKSYLALPVVLFCWACGYAWKRKGWLKLDEIDIDSGRREIDWEVYNQVLEKRKNSSFMKRLYYRLF

SEQ ID NO: 9015 - protein, 451 aa, Clostridium acetobutylicum
MPWFKKAIFYHIYPLGLCGAPLSNDFTSKPIPRLKEIENWIPYLKSLGITALYLGPVFESTSHGYDTADYYTVDRRLGTNDTLKKLINKLHKNGIKVVLDGVFNHVGRNFPQFMDLIINKQTSSFATWFSGVDFNSKSPYNDDFSYDTWNGCYDLVKLNFNNNEVKSFILNAINFWISEFKIDGIRLDAADCIDINFLREISNFSKSISDDFFLLGEIIFGDYTRFASKNILDSVTNYECYKGLYSSHNSLNYFEIAYSLNRQFGDGGIYKNIPLYNFVDNHDVNRIASTLIDAANIYPIYTILFTIPGIPSIYYGSDFGITGVKQNNSDKYLRPRLKINELKNSKENKPLNNFIKKLCHIRINSEALTEGLYKQLFISNKLFAFLRYTDSEKIIVALNCSKECSQIEFSNDMNATSLFDLIEKKSLKLEPNGTISITLQENQARIFKVSF

SEQ ID NO: 9016 - protein, 305 aa, Unknown
  Acidovorax sp. JS42
MRVDNILHTIGNTPHVRINRLFGAGANVWVKSERANPGGSIKDRIALAMVEAAERSGALQPGGTIIEPTSGNTGIGLALVAAVKGYQLVLVMPDSMSIERRRLMLAYGARFDLTPKEKGMKGAIARAQELVAATPGSWMPQQFENPANVEVHMRTTAQEIAADFPDGLDALVTGVGTGGHITGVARVLKAQFPQLKVFAVEPSQSPVLSGGQPGPHPIQGLGAGFVPQIMDTSLLDGVIQVEAEPAREYARRAAREEGLLVGISSGATLAAIAQKLPELPAGARVLGFNYDTGERYLSVEGFLPA

SEQ ID NO: 9017 - protein, 308 aa, Arabidopsis thaliana
MGKASRDKRDIYYRKAKEEGWRARSAFKLLQIDEEFNIFEGVKRVVDLCAAPGSWSQVLSRQLYLPAKSSAESKDGDLPLIVAIDLQPMAPIEGVIQVQGDITNARTEVVIRHFDGCKADLVVCDGAPDVTGLHDMDEFVQSQLILAGLTIVTHILKEGGKFIAKIFRGKDTSLLYCQLKLFFPTVTFAKPKSSRNSSIEAFAVCENYSPPEGFNPRDLHRLLEKVGSPSGGSDLDCSSGWLEGPNKVYIPFLACGDLTGYDSDRSYPLPREADGSSYQSLDPIQPPIAPPYKRALELKKASAQSFNS

SEQ ID NO: 9018 - protein, 465 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQISLGNEKGLTPLINIQGYVLGNPVTDKNIETNYRVPFAHGMGLISDELFESLERSCGGKFFNVDPSNARCSNNLQAYDHCMSEIYSEHILLRNCKVDYVLADTPNIRTDRRRVMKEFSVNDSSSLPPPSCFTYRYFLSAFWANDENVRRALGVKKEVGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 9019 - protein, 426 aa, Oryza sativa
GARVVTGNSAIMRGGPPHLTKPAMAAAGASALRPHLALLPAGGGGGGGGGTRSYALQALSFVSPLLPHCGRRRRCVLRSKASSSPSPPPSPGKEAVAVPTAESCVNLGLELFSKGRVKDALEQFENALELNPNPVEAQAALYNKACCHAFREESNKAADCLRTALRDYNLKFGTILNDPDLAPFRASPEFKELQEEALRGGEDIGSGFRRDLKLISEVQAPFRGVRRFFYVALTAAAGISTFFTIPRLILAVQGGDGAPDLLETVGNAAINIGGIVVLVALYFWENKKEEQQITQISRNETLSRLPVRLSTNRIIELVQLRDITRPVILAGSKASITRAMQRAERYRTELLKRGVLLIPVIFGASQKAQSKPRGFGSSRSAASAPSVGDDFEKRTESIAAKSRLKAEERFKADIVSPEQWERCLFF

SEQ ID NO: 9020 - protein, 477 aa, Unknown
  Synechococcus sp. CC9605
MPTSRVLFWHRRDLRLADNLGLVVAAQISPAVTGVYVLDPAVINPPPELPPMAPARLWFLIESLVELQQRWREAGSRLLVVEGDPVAVLPQVAQQISAEAVVWNRDVEPYARKRDRQVAKTLQADGRRVVADWDQLLIAPELLKTGAGDPYRVYGPFLRNWRGQVLAQKPATVAAPTGLVDLPPELMPAGDPLPALRESHGFQGSEICPCRPGEAAALEQLTTFCNGPLLGYEPDRNFPGTAGTSYLSAALSVGTLSPRQAWCAAQDSREQARSEEQLQAIAVWEQELGWREFYQQALFYFPELADGPYREQWRRFPWENNEDWFDFWKEGQTGMPIIDAAMRQLNQTGWMHNRCRMIVASYLVKDLICDWRWGERAFMELEVDGDLAANNGGWQWSASSGMDTKPLRIFNPATQASKFDSAGDYIRRWVPELRHVNTKDLLSGEIGALERRDYPEPLVDHKNQQARFKALYATIRS

SEQ ID NO: 9021 - protein, 395 aa, Alkaliphilus metalliredigenes
MSAIEIKKGVYWVGAVDWDIRNFHGPSYHTQKGTTYNAYLVIDEKVTLIDLVDLHFVDDMINNIKEIIDPSLIDYVVVNHVEPDHSGAFPKLMEYIPEAKVFCTKNGKEGMLHYYFGDYNYETVKTGDKLNIGEKTLEFIEAPMLHWPDSMFTYIKEVALLMPNDAFGQHLASSHRFDDENDLCEVMEEAKKYYANILMPFNPLVLKKIQEIQKMGLEFDMIAPSHGIIWRTDPGKIVEKYLSWSQNETKRKAVVVYDTMWNSTQLMAKAIVDGLISEGIETKLYRASKSDVNDIMTEVLDAKAVLIASSTINNTMLPHLAYLLEEMMGLKPKKKIGAAFGSYGWGKGAVKNIEKKMKETGIELVKEGLEIKYVPTEADLKTCFEYGKEIGKMIE

SEQ ID NO: 9022 - protein, 322 aa, Schizosaccharomyces pombe
MTHNKVVIIGSGPAGHTAAIYLARGELKPVMYEGMLANGIAAGGQLTTTTDVENFPGFPDGINGTTLTENFRAQSLRFGTEIITETVSKLDLSSRPFKYWLEGAEEEEPHTADSVILATGASARRLHITGEDTYWQAGISACAVCDGAVPIYRNKPLAVVGGGDSAAEEAQFLTKYGSKVYVLVRRDKLRASPIMAKRLLANPKVEVLWNTVAEEAQGDGKLLNNLRIKNTNTNEVSDLQVNGLFYAIGHIPATKLVAEQIELDEAGYIKTINGTPRTSIPGFFAAGDVQDKVFRQAITSAGSGCQAALLAMHYLEELEDTD

SEQ ID NO: 9023 - protein, 335 aa, Glycine max
TPFSLLLCLIWRLRSLSIAKDVTELIGKTPLVYLNRIVDGCVAKVAAKLEMMEPCSSVKDRIGYSMIVDAEEKGLITPGESVLIEPTSGNTGIGLAFMAAAKGYKLIITMPSSMSLERRTILRAFGAELVLTDPAKGMKGAVQKAEEIRDKTPNSYILQQFENPANPKIHYETTGPEIWKGSSGKVDALVSGIGTGGTITGAGKYLKDQNPDIKLYGIEPVESPILSGGKPGPHKIQGIGAGFIPGVLDVDLLDEVVQISSEEAIETAKLLALKEGLLVGISSGAAAAAAIKIAKRPENAGKLIIAVFPSFGERYLSSVLFESVKREAESMVFEP

SEQ ID NO: 9024 - protein, 361 aa, Unknown
  x Citrofortunella mitis
MALPVSAIGFEGYEKRLEVSFFEPGVFADPGGRGLRSLSKHQLDEILKPAECTIVSSLSNEYLDSYVLSESSLFVYPYKVIIKTCGTTKLLLSIPAILKLAESLSLSVRSVRFTRGSFIFAGAQPFPHRSFSEEVAVLDGHFGKFGMDSTAFVMGSPDNTKRWHVYSASAEAGSHVNLVYTLEMCMTGLDRKRASVFYKTNESSAAMMTEDSGIRKILPKSEICDFEFDPCGYSMNSIEGDAVSTIHVTPEDGFSYASFEAVGYDFEVVKLTSLLERVLACFKPAEFSVALHSDIVGDEHGDTFTLDFKGYSCGEKIYEELGNNGSLIYYSFSRTDCSTSPRSILKCCWSEDEKDEEVEGK

SEQ ID NO: 9025 - protein, 297 aa, Debaryomyces hansenii
MAQELTHPSIKDGWFAEISDTMWPGQAMSLKVEKVLHVEKSKYQDVLVFKSTDYGNVLVLDDCIQCTERDEFSYQEMIAHLALNSHPNPKKALVIGGGDGGVLREILKHESIEEAWLCDIDETVIEVSKKYLPEMSQSYKNPRTKVHIGDGFKFLAEYKNQFDVIITDSSDPEGPAESLFQKPYFRLLKDALTEKGVITTQAENIFLHMEIISRLKKDCKEIFPVAEYGYTMIPTYPSGSIGFMVCSKDPNANVTKPLRFDWDDEFVRKNLKYYNKKIHEACFVLPTWADEKLNKQN

SEQ ID NO: 9026 - protein, 405 aa, Burkholderia xenovorans
MSADRHVIVGAGHAARRAAETLRERDPHARITMIGAEPHAPYDRPVLSKDALLAPGGEQKAFIRGLDWYAAHDIELRLATTVESIDRARHEVGLHDGSSIGYDRLLLATGSRVREFAGPVDERVPLYYVRTLADSLALRTALAPGRQVAILGGGFIGLEVAAAVTQAGCEATVIEPAAALLQRSLPPAAARFVAALHARRGVTLRLAETPSRIGYEHGRALLETDRGTLAADLVVVGIGVLPNVELAREAGLQVDNGIVVDAQCRTSDPRIFAAGEVTAHFNPLLGRHVRIESWQVAENQPAIAAANMLGDTQEYAEWPWLWSDQFDCNIQTLGTIEASHTLIERGDARNGPFCVLALDAGRRLRAVVAINAGREMGACKRLVVAGKVLDPALLADPAVALRSLL

SEQ ID NO: 9027 - protein, 396 aa, Rhodopirellula baltica
MPPRWLFFDRLDAALWGMSEGRRSDERGPGLIPPPRNSRKPVNSLGRHDRKKPVGVANFRSEPYFLPSFPAPPAFWQGVSFTQFTAFWGEGHRIHAFCVVFTALGLLFSCLLESQFSEPAMDQIPEMPRICAAKILMANEIVKEMIEAGVHFGHRTSLWNPKMAPYIFGKKNQIHILDIRETLRGLLRAKKYLSQVAAGGSLILFVGTKRQAGEAVEEQSLRCGMPFVSERWLGGTLTNFRTIRSRLGRLEELEALRAGDGINDYSKKMQSSLNREYRKMYRNLNGLRTMNRLPEVMFIVDPGKERNAVREAKRLGITTVALIDTDSDPSQIDLPIPGNDDGIRSVEMIMRELADAVIAGKGQTQTEAAPNAQAAPEAAAPAEQPAEEAAAASSEG

SEQ ID NO: 9028 - protein, 705 aa, Wigglesworthia glossinidia
MLKATIQKFQYGKNIVTIETGMIARQATSAVMVRMDDTSVFVTVVADKKEKLGQKFFPLTVNYQERTYSIGRFPGGFFRREGRPNENEVLVSRLIDRSVRPLFPKNFFNDIQIIATVMSVNPQVNPDIVSIIGASAALSLSGLPFKCPIGSSRIGYIDNKYILNPTTSELIDSKLDMIVSGSSNAVLMVESSSNILQEKNILEAILFGNEQNKIVIENIDKLKKKFKKENLEYDLKSLNNNDIQFVIEDLFFDRIKDSYKIPEKKKRLEKIENIKNDILNNFINNNNTNEEEILYIIQNIERKIVRNRIISGKPRIDGRTEDMVRNLDIHLGILPRTHGSSLFTRGETQALVTTTLGTERDAQNIDDLVGDKIDRFLFHYNFPPYCVGEVGIISSPKRREIGHGKLAKRGMLAVMPDIDKFPYTIRIVSEITESNGSSSMASVCGASLSLMDAGVPISSSVAGIAMGLIKEKDKFVVLTDILGDEDYLGDMDFKVMGTREGVTALQMDIKIEGITSEILQVSLDKAKNARINILNEMDKVIKKPKNEISIFAPRIYKIKINPEKIKDVIGKGGSVIRMLTEKTKSSIEIEDDGTVKVISTDIKNAQCALKKIKDITHEIKINKIYVAKITRISEFGIFACLINNKEGLIHVSKIPYKKFSDINNNFKIGQIISVKVIEIDRYGRIRLSFTGTDKNKNKKFFNKNN

SEQ ID NO: 9029 - protein, 324 aa, Glycine max
MATLVLYQFFLKLLLLISVFQLSFAARRLNQLVQDQSQLLHYHNGPLLYGKIAVNLIWYGHFKPSQKAIITDFVTSLSSPSSQSSQPSVATWWKTTEKYYHLSPKNKKAASSLSLSLGDQFLDEGFSLGKSLTSKNLVELASKGGQRNAINVVLTSADVAVEGFCMSRCGTHGSSSSASHVKKNNNGKNYKFAYIWVGNSETQCPGQCAWPFHQPIYGPQSPPLVAPNNDVGLDGMVINLASLLAGTATNPFGNGYFQGPAEAPLEAASACPGVYGKGAYPGYAGDLLVDSTTGASYNVKGANGRKYLVPALYDPSTSSCSTPV

SEQ ID NO: 9030 - protein, 336 aa, Streptococcus suis
MKRIAVLTSGGDAPGMNAAIRAVVRQAISEGMEVYGINEGYAGMVAGDIHELSARSVGDIISRGGTFLGSARYPEFAKLEGQLKGIEQLKKHGIEGVVVIGGDGSYHGAMRLTEHGFPAIGVPGTIDNDIVGTDFTIGFDTAVTTAMDAIDKIRDTSSSHRRTFVIEVMGRHAGDIALWAGIASGADVIVVPEEDFNINDIVDRIKAGYDNGKKHSIIVLAEGVMPAAQFAEELKAAGDTSDLRVTELGHIQRGGSPTARDRVLASRMGAHAVKLLKEGRGGLAVGIRNEQMVENPILGTAEEGALFSLTTDGKIVVNNPHKADLELADLNRNLSI

SEQ ID NO: 9031 - protein, 333 aa, Prochlorococcus marinus
MLKDKNILITGGNSGIGFYATINLLKAKNNLYIPIRSIPRKDQFFFKLLKYFDKKYLDKYLNLIENIDLANLRNIEILRDYLNKKNVSFDVIILNAGLQYTGSFYPKVSKQGIELTFAVNHLAHFYLVNSLIGLINNKKESRIIITSSDVHDPKSSGGNVGKKAGLNNLVNFKQEITGKYLNFNSDKAYKNSKLCNILFAKELSKRLQIKAYEVAVITWAPGLVIPNEDLGFFRYSKKFNFFGYIIFSIIAKNILGISENVENAGKLLSEIVTDPEFNNIKYLHLSNKLVFFKKHKLLKSEISEEANKSDLALRLWNLSEELCQSFGFVSLNI

SEQ ID NO: 9032 - protein, 641 aa, Oryza sativa
  misc_feature (42)..(42): Xaa can be any naturally occurring amino acid
  misc_feature (480)..(480): Xaa can be any naturally occurring amino acid
MMGGGLVMDQGMMFPGVHNFVDLLQQNGGDKNLGFGALVPQXSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTEKXPSPPAIFPATYNTPNQALNNLDFGLPMDGQRSITELMNMYDNNFVANKRLSNDNATIMERPNAVNPRIQIEEGFFGQGSGVGGSNGGVFEDVNGMMQQPQQTTPAQQQFFIRDDTPFGNQMGDINGASEFRFGSGFNMSGAVEYPGAMQGQQKNDGSNWYY

SEQ ID NO: 9033 - protein, 377 aa, Oryza sativa
MFWFNLGNTLNCNHPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 9034 - protein, 215 aa, Euphorbia esula
LEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGN

SEQ ID NO: 9035 - protein, 592 aa, Bacillus halodurans
MKTVVTTLNAKYIHTCLALRCLKAYAEPEFPIEMVEYTIKDPAMNIVADLHQRKPDVIGFSCYIWNIQETIQVIEMLKKVMPSVKIVLGGPEVSYDTREWMERLHAVDFIVVGEGEETFKHLLEEMNTTAKYHLVFGLAYRKGDDIVINPPRPKLPLNELPSPYRFSEDVASLSKRVTYFETSRGCPYSCQFCLSSIEVGVRYFDLERVKADLLYLINSGAKLIKFVDRTFNIRRDYALEVFRFLIENHQGCVFQFEITADIMRPEVLAFLNEHAPKGIFRFEIGVQSTNDLTNELVQRRQNFEKLKRTVTMVKEGGKIDQHLDLIAGLPEEDYQSFRKTFNDVFAMHPEELQLGFLKMLRGTGLRLRAEDHNYLFMDQAPYEILGNNVLSFDEIVRIKRVEDVLEKYWNAHRMDTTILYLVEYEFDSPFDFFQSFGDYWDEKGWARIGHQLEDLFIRLFAFLEDRRTDNLPIIKGLMMYDYFRGHKHKPRKTWWPFSLTKEKQSSLIKRLAATPEVFSEALARHQLSEKELHKHTMLEVIPFSLADWLKRGVIVKEDTLLLSLYQPKGEGTEVFSGPLHSLTNQKEETIHE

SEQ ID NO: 9036 - protein, 1041 aa, Desulfotalea psychrophila
MKRYFFSVISVCFLVVWAIPALASDLQLTPAEQSWLRAHPDIRLGVDPDYAPFESIEGGVYVGLAADYVSLVSKKLGLSLVPVPDLTWKEVMALAEQGELDLFPAVVQTPERNELWLFAKPHMAYSTVIFTRDDYWNVFGLADFAGKKVAVVRGYAILDFIRSAHPHLDIVLVDSVDMGLRQLEAGRVSAFVNDIATGVSAIQKMNLKNLKIAAYTDLKDKGLGFAVRKDWPELVAMIDKVLASITPEEHAAIHNRWIKVESFSPWQHWARWLFIGLAMVAVSLLAFTGWIYLLRKQVASRTTKLQASEAWTVAILDTASNPIITIDEDETVLSFNLGAERSFAYSAEEIIGQKVKILLPDLYEKYEDEFATSFFAKDDAHLIDMDREIDARRKNGTIFPIHLSVGEMIVSGKRMFVIILVDLSVQKQRNLELELARDAAEAAMEAKAIFLANMSHEIRTPMNAILGFLAIVLESSSLPADLRKHIVTAHGSAESLLVIINDVLDVSKFDSGRMELVFSVFHLPRTIGKALQTLYMPAQEKELNIHLNYDEDLPYCFLGDSVRLRQVIINLVANAIKFTEEGSITIEVKGTSGEDDLLLFTVVDTGIGIRPEQVARIFEPFTQADDSSTRNIGGTGLGLAICKEIVDLMGGRIWVESEKGKGSSFNFMVPLPRAECIKDCPKAGRPAETGDDCPKLAELSERAEPVSRKIFRILLAEDMKDNAELAQFRLEQQGHIVTHVWNGLEAVEAFQRDEFDLIFMDVQMPVLDGHSATRQIRKIERGAGGYIPIFALTASVMREDREKCIAAGMDVIIGKPIDFQFLFAKMEEIVSEGVGVVQRGWIDFSPVMAVAAVEQGLLTWANSVVYAGTLIDFSEAHLGDASTLQQLFQQNDIRGMQCLIHTLKGVAENLALSDLVKIISDVDSSLLMDDRERTTLLLLDLKEALKNVVVATGQLALAGEGAVQPVKKEDLKKIGDLLAELLVQLEEDNPAVVEPLVAELSQYLSQNDLLLLQKNIDDFEFVRAKLQVRKLADMLAIKLEV

SEQ ID NO: 9037 - protein, 721 aa, Prochlorococcus marinus
MEGKNTSITFDGREIRLTTGLYAPQANGAVMIECGDTSLLVTATKTNKKEAADFLPLICDYEEKLYAAGRIPGGFMRREGRPPERATLIARLIDRPMRPLFPIWMRDEIQIVASCLSLDERVPADVLAVTGASLATLLGEIPFYGPMAAVRVGLLGDDFILNPSYREIEKGDLDIIVAGSPEGIVMIEAGANQLSEQDTIEAIDFGYEAVTELIKAQENLLKDLGIKQVKPSEPEVDNTLAAYLEKNCTKPIDLVLKKFDQSKEERDLELEKIKLEVHSKIDSLKDDNQLKVLTSENEKLIHSDFKKLTKKLMRSQIINDGKRVDGRDLDEVRKISAKAGILPKRVHGSAVFQRGLTQVLSTTTLGTPSDAQEMDDLNPSTEKTYLHHYNFPPYSVGETRPMRTPGRREIGHGALAERAIIPVLPGKETFPYVLRVVSEVLSSNGSTSMGSVCGSTLSLLDAGVPLKAPVSGTAMGLIKEGKEVRILTDIQGIEDFLGDMDFKVAGTEKGITALQMDMKITGLPVSIISDAIKKARPARLHILEKMQDAIDKPQESLSPHAPRLLSFRIDPELIGTVIGPGGRTIKGITERTNTKIDIEDGGIVTIASHDGAAAEEAQKIIEGLTRKVHEGEIFSGVVTRIIPIGAFVEILPGKEGMVHISQLSEARVERVEDVVRQGDEVTVRVREIDSRGRINLTLRGVAQNGGMSYPEPTPTPVAPLN

SEQ ID NO: 9038 - protein, 229 aa, Glycine max
METNNQQQQQQGAQAQSGPYPVAGAGGSAGAGAGAPPPFQHLLQQQQQQLQMFWSYQRQEIEHVNDFKNHQLPLARIKKIMKADEDVRMISAEAPILFAKACELFILELTIRSWLHAEENKRRTLQKNDIAAAITRTDIFDFLVDIVPRDEIKDDAALVGATASGVPYYYPPIGQPAGMMIGRPAVDPATGVYVQPPSQAWQSVWQSAAEDASYGTGGAGAQRSLDGQS

SEQ ID NO: 9039 - protein, 98 aa, Anabaena sp.
ATFKVTLINEAEGTKHEIEVPDDEYILDAAEEQGYDLPFSCRAGACSTSAGKLVSGTVDQSDQSFLDDDQIEAGYVLTCVAYPTSDVVIQTHKEEDLY

SEQ ID NO: 9040 - protein, 344 aa, Salinibacter ruber
MSTSITLFGAGSWGTALAVHLAAAGRDVTLWARRDEAVERMRTTHRNPTYLSDIEIPPSVHVTSDLEAAAGASSLWAVAVPSQNLRSVATRIAPLTRPGTTVVSLAKGIENETLQTMSQVLADELGGMEAQQIGVLYGPSHAEEVAENQPTTLVAAAPTEPRAEWVQDAFMTERLRVYVNTDVVGVEIGGSAKNVLAIAAGIGDGVGYGDNAKAALVTRGLAEIRRLGIAMGAKPRTFAGLAGIGDLLVTCMSPHSRNRYLGEQIGNGMTLEEIESEMDMVAEGVRTTQSVQDLARHHDIEMPVTEAVHRVLFENRRPEDMVDELMTRSAKREHWLPQGLRNVS

SEQ ID NO: 9041 - protein, 343 aa, Mycobacterium leprae
MRIGILTGGGDCPGLNAVIRAIVRTCDARYGSSVVGFQDGWRGLLENRRMQLCNDDRNDRLLAKGGTMLGTAHVHPDKLRAGLHQIKQTLDDNGIDVLIPIGGEGTLTAAHWLSQEDVPVVGVPKTIDNDIDCTDVTFGHDTALTVATEAIDRLHSTAESHQRVMLVEVMGRHAGWIALSSGLASGAHMTLIPEQPFDVEEVCCLVKRRFQRGDSHFICVVAEGAKPVPGSITLRQGGMDEFGHERFTGVAAQLGAEVEKRINKDVRVTVLGHVQRGGTPTAFDRVLATRFGVNAADASHAGEYGQMVSLRGQDIGRVPLEDAVRQLKLVPESRYDDAAAFFG

SEQ ID NO: 9042 - protein, 135 aa, Haemophilus influenzae
MQILHTMLRVGDLDRSIKFYQDVLGMRLLRTSENPEYKYTLAFLGYEDGESAAEIELTYNWGVDKYEHGTAYGHIAIGVDDIYATCEAVRASGGNVTREAGPVKGGSTVIAFVEDPDGYKIEFIENKSTKSGLGN

SEQ ID NO: 9043 - protein, 98 aa, Anabaena sp.
ATFKVTLINEAEGTKHEIEVPDDEYILDAAEEQGYDLPFSCRAGACSTCAGKLVSGTVDQSKQSFLDDDQIEAGYVLTCVAYPTSDVVIQTHKEEDLY

SEQ ID NO: 9044 - protein, 320 aa, Unknown
  marine gamma proteobacterium HTCC2143
MSISEPPARFADLQSIDDPVFRRAGIRCSILRLDTFSSYANGNKFFKLKQNILQAKAQGFTRMLSFGGAFSNHIHALALAGRHFGISTVGIVRGDNLSVLNPTLTDAVAAGMELQFISRQDYKRRNDADFLNYVRGQYPDCFVVPEGGSNVLGVQGCMEIIDHIHSHEVGRGGLIVVPCGTAATLAGIAAACDNGEKVLGFSVLKNSHYLDAEVEKFIADLSIESRDNWTISHDYHCGGYAKLSTELVSFIDKFEQQHNIPIEPVYTGKMLFGLHQMLQLPHQSIAAGTHVIAVHTGGLQGGRGMVEKMQRKRMSIASPK

SEQ ID NO: 9045 - protein, 427 aa, Arabidopsis thaliana
  misc_feature (87)..(87): Xaa can be any naturally occurring amino acid
MVRDIEDEIRDEKNPRPLDEDDIALLKTYGLGPYSAPIKKVEKEIKDLAKKINDLCGIKESDTGLAPPSQWDLVSDKQMMQEEQPLXQVARCTKIISPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 9046 - protein, 145 aa, Coprinopsis cinerea
MAPKPASTAGKAPASTASKAPAKSAEASKAAKKTSKPAPADGEKKKRKKVRKETYSSYIYKVLKQVHPDTGISNKAMAILNSFVNDIFERIATEASKLASYSKKSTISSREIQTAVRLILPGELAKHAISEGTKSVTKFSSAGAK

SEQ ID NO: 9047 - protein, 579 aa, Schizosaccharomyces pombe
MKVVPSEKIKPNWWRETSVYQIYPASFKDSNGDGFGDLEGIISKVDYLKALNVESIWLCPIYPSPLKDMGYDVSDYKQIDSRYGTLEDLDRLMKALHERDMKLVMDLVLNHTSDQHEWFKESRSSKTNPKRDWYFWKPARYNEKGERLPPNNWRSYFDTSAWEWDEATQEYYLHLWSVGQPDLNWETPKVREAVHDILRFWLDRGVDGFRLDAINMISKDQRFLDAPITDDRYEYQLAYQYYANGPRIHEYLNGIGNILTEYDAFSVGEMPYVLDTNEILHVVGADRRELTMIFQFDFVDLDLDPNQHKYIEGSWELSDLKKSLKKWQSALLSGGGWNASFIENHDQTRTVSRYLSDSPKYRAYSSKLMALFIIFQSGTPLVFQGQELALANIPRDWPIDEYLDVETQNFWKLFMSGNPSQEEIEKTMDIVNKRARDNGRTPMHWDSSPNGGFTKAGVKPWMRVTNDYKEWNAANQVNDPESPYTFWSKALELRKELKDAVVYGSFELISEEDPSIVAFVRESSTYKLIILLNFTGNKVSYDCPLNLTSYEILLDNYKDFICMTSPVTLNPYQAVLLKL

SEQ ID NO: 9048 - protein, 339 aa, Oryza sativa
MPNLECRMYEPRFPEVDAAVMIQVKHIADMGAYVSLLEYNNIEGMILFSELSRRRIRSISSLIKVGRQEPAIVLRVDRDKGYIDLSKRRVSEEEAHACEDRYNKSKLVHSIMRHVAETLGIDLEPLYQRIGWPLYRKYGHAFEAFKLIVADPDAILDSLTYEEKETGADGQEVTKVVPAVTPEVKDALVKNIRRRMTPQPLKIRADVEMKCFQFDGVLHIKQAMRKAEAAGNDNCPVKIKLVAPPLYVLTTQTLDKDQGISVLTDAIKACTAEIEKRKGKLIVKEAPRAVSEREDKLFNEHIETLNEQNAEVDGDADSEEEEDTGMGDIDLTNSGVNAD

SEQ ID NO: 9049 - protein, 112 aa, Methanococcus maripaludis
MKKIEAIIRIERLDIVKGILSENGFLSLTISEVKGRGVQGGITERYRGTEYVVDLLPKVKLEMVVDDKDIDEVITIIRENAETGKPGDGKIFIIPVEDAVRIRTGESGIKAI

SEQ ID NO: 9050 - protein, 546 aa, Methanococcus maripaludis
MERPTKMYCNQCQETVKGTGCVKVGVCGKKDNVANLQDLLIYTLKGISYVSEKTGENNGAIDRYIVDSLFASVTNTNFDDKYLIENVKEGLKLRDSLKSKCGGNCGQLPDFATWNAKTDLEILEKSNSKEVSLQATENEDIRALRVTTLYGLKGIAAYLHHAMVLGENSGEIHKFIKKALIDISDDSKSADELTALVLETGKYAVDTMALLDKANTTKYGNPEITEVDIGVRENPGILISGHDLKDMEDLLEQTKGTGIDVYTHSEMLPAHYYPEFKKYEHFAGNYGGSWYKQKTEFESFNGPILMTTNCIVPPADSYVDRIYTTGVVGYPGLKYIPTVNGKKDFSEVIEQAKKCPSPVELETGKIVGGFAHNQVLALADKVVDAVKSGAIKKFFVMAGCDGRNSDREYYTEFAKNLPKDTVILTAGCAKYRYNKLNLGDIGGIPRVLDAGQCNDCYSLAVIALKLKEVFELDDINKLPIAFNIAWYEQKAVAVLLALLYLGIKNIHVGPTLPEFLSPNVAKVLIDKFELGGISSVEEDMKMFLGE

SEQ ID NO: 9051 - protein, 610 aa, Schizosaccharomyces pombe
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGLF

SEQ ID NO: 9052 - protein, 112 aa, Methanococcus maripaludis
MRKIEAIFRPERLLAVKNALFEEGFISLTLTEVKGRGVQGGIIERYRGNEYLVDLLPKVKIEIVSNDSDVEKIVKLISENAVTGKPGDGKIFVIPVEDVIRIRTNETGKDAI

SEQ ID NO: 9053 - protein, 202 aa, Unknown
  Synechococcus sp. CC9605
MARQGTIHRVTGETDVKVRLDLDGSGQCQASTGVPFLDHMLHQISSHGLIDLEINAVGDTHIDDHHTNEDVGIAVGQALAQALGDRRGIHRFGHFVAPLDEALVQVALDCSGRPHLSYSLAIPSQRIGTYDTELVKEFFVAVVNNSGLTLHIRQLDGVNSHHIVEACFKAFARALRMATEVDPRRAGAIPSSKGVLEQAGAS

SEQ ID NO: 9054 - protein, 333 aa, Chlorobium tepidum
MKITVLGAGSWGTTLAMLLANKGHEVRLWAHRPEFARALEADRENKRYLKGVLFPDNLRVVENLHDAVETAEMIVTAVPSHALRETAAAFAHLPLDGKIIVNVAKGIEQHTGKRMSEVLLEALPRIAPEQIAVLYGPSHAEEVARQQPTTVVACSVSEATARRVQEAFHTSSFRVYVNTDLIGVEIAGSVKNVIAIAAGISDGLGFGDNAKAAIITRGLAEISRLSSKLGADPLTLSGLSGIGDLVVTCLSQHSRNRYVGEQIGKGRKLDEVIGEMSMVAEGVLTSKAVVKLAERLGVEMPISQAVYEMLYENKPAPQAILELMERDPKPEHY

SEQ ID NO: 9055 - protein, 447 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGTDGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQARL

SEQ ID NO: 9056 - protein, 488 aa, Unknown
  Synechococcus sp. CC9605
MTVAPTRSYDRSDWASSFVNVEQELTDVALTPVRGTVPAELQGTFYRNGPGRLERDGHRVHHPFDGDGMIAAMRFENGSVSLSNRYVRTEGWLAEEKAGKILYRGVFGSQKPGGRLANAFDLRLKNIANTNVVRLGDQLLALWEAAEPHALDPRSLETRGLSRLDGVLKKGEAFSAHPRFDPGHNGRPCMVTFGVKTGPRSTIRLMEFATDGPEAGALLHDRSDSFPGFAFLHDFAITPNWAVFLQNAIAFNPLPFVTGEKGAAQCLASQPGGKGRFWLIPRDSGRFAGQKPRILEAPDGFVFHHLNAFEDGDHVVVESIVYDDFPSIGPDEDFAEVDFDTVPEGTLHRCRLDLSRESVQTERISERTCEFAMVNPERQGLSARYAWMAVAERETGNDPLQAIQKLDLDSGATHTWSAAPRGFVSEPLMVRRPGAESEDDGWVLDLVWNGARVASDLVILNARDLSEVAVLELPLAVPHGLHGSWAAG

SEQ ID NO: 9057 - protein, 492 aa, Pseudomonas fluorescens
MPERDPAMSEEILINITPMESRVAVVENGVLQEVHVERTQKRGIVGNIYKGKVVRVLPGMQAAFVDIGLDRAAFIHASEISLREGPAVESISALVHEGQSLVVQVTKDPIGSKGARLTTQLSIPSRYLVYMPRTAHVGISLKIEDEAERERLKQVVSDCVAKEGIKEAGGFILRTAAEGAGADEILMDIRYLRRLWDQINEQIKTIGAPSVIYEDLGLALRTLRDLVSPKIEKIRIDSRETFQKTTQFVAELMPEIADRLEHYPGERPIFDLYGVEDEIQKALERKVPLKSGGYLVIDPAEAMTTIDVNTGAFVGHRNLEETIFKTNLEAATAIARQMRLRNLGGIIIIDFIDMEDEEHQRQVLRTLEKQLERDHAKTNIIGITELGLVQMTRKRTRESLEQVLCEPCSSCQGRGKLKTPETICYEIFREILREARAYQAEGYRVLANQKVVDRLLDEESGNVAELEGFIGRTIRFQVETMYSQEQYDVVLL

SEQ ID NO: 9058 - protein, 218 aa, Glycine max
LCCQRHCFIQVFIFLLPVEALPLLLFSYHKLAGHASDRIFAPYTVYKGKAAFSLIPCLPTFTKLDSGTVVVDRRGSIMMSFMHSIGERKYDWDKRQKFALSATEVGSLITMDAQDSCDFFHDPSMLSSNAGQVRKSLSIKPHANGYFVSLTVVNNLLNTKDYFSVPVTTAEFAVMKTACTFALPHIMGWDQITNQQSRGIDGLQAKGDSKVSELEWER

SEQ ID NO: 9059 - protein, 384 aa, Unknown
  Mycobacterium sp. JLS
MARDYYGLLGVSKGASDQEIKRAYRKLARELHPDVNPDEEAQARFKEISAAYEVLSDPEKRRIVDLGGDPLESAGASGGNGFGAGFGGLGDVFEAFFGGGGGSRGPIGRVRPGSDSLLRMRLDLAECATGVTKQVTVDTAVLCDLCHGKGTHGTSTPATCDTCGGRGEIQTVQRSLLGQVMTTRPCPVCGGVGEVIPDPCHRCGGDGRVRARREISVKIPAGVGDGMRVRLAAQGEVGPGGGPAGDLYVEVHEKPHDVYVRDGDDLHCTVSVPMVDAALGTTVSVDDILGGPLELIIAAGTQPGAVSTLRGHGMPHLRSGVRGDLHAHIDVVVPAKLDHTDIELLRQLKEHRSRDVAEVRTSSSPAASNAGGLFSRLRETFTGR

SEQ ID NO: 9060 - protein, 328 aa, Escherichia coli
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASVEILLWDDYFAPGYGVPNDEGMEAVKLLARLEGILLDPVYTGKAMAGLIDGISQKRFKDEGPILFIHTGGAPALFAYHPHV

SEQ ID NO: 9061 - protein, 244 aa, Arabidopsis thaliana
MANHETIFDQLKKQIPVDEEEPLILNRDSSVGLVIVDVVNGFCTIGSGNMAPTKHNEQISKMVEESAKLAREFCDRKWPVLAFIDSHHPDIPERPYPPHCIIGTEESELVPALKWLESEDCATLRRKDCINGFVGSMESDGSNVFVDWVKENQIKVIVVVGICTDICVFDFVATALSARNHGVLSPVEDVVVYSRGCATFDLPLHVAKDIKGAQAHPQELMHHVGLYMAKGRGAQVVSKISFET

SEQ ID NO: 9062 - protein, 125 aa, Glycine max
FRPTRSSLACTVEIVEDVFAAIDHINQHFGSRTECIVTEDSEVAETFLSQVDSAAVFHNASTRFCDGARFGLGAEVGISTSRIHARGPVGVEGLLTNRWILRGSGHVVDGDQGINYTYKELPLKA

SEQ ID NO: 9063 - protein, 393 aa, Debaryomyces hansenii
MDRYEENYLDGSEIATLQHQEQEEQEEQIPSHPAPTQNIVDEEELLAAQAAAEAAAAAQLQQPGGAFNNVGQGLTGVYRDMMMQYWQETINSIEHDEHDFKNHQLPLARIKKVMKTDEDVRMISAEAPILFAKGCDVFITELTMRAWIHAEENKRRTLQKSDIAAALTKSDMFDFLIDIVPREEEKPKKSYSSLSRSGSYANIPPNSNPTLSNASQQQIPTSQPKNISHIPGNINEDQDIKNDDRQINDPQILHQQMLQQQMLQQQQQQQQQQQQPPPPPQQPQHQQQAQHQQHQQQLEQQQLEQQQLEQQQLEQQQQQQQQQQQQQQQQQQQQQQQQKDQSQAEQPEPQLPPQQIKLEQNYSEMPQFPEGTTQPPQISNRNEFQNFNFQVYE

SEQ ID NO: 9064 - protein, 510 aa, Schizosaccharomyces pombe
MISKLLKIVLLTAGVIGNTLADSRIHEQYLVKAFPNEPVDYEGRMHAGHLNQTDQLDGDLFFWMFESVKPEYEHRSILWLNGGPGCSSEDGSLMEVGPFRLDDNNTFQLNPGRWDELGNLLFVDQPLGTGYSYSLAKDFQSNNEKMANDFSIFFEKFLEEFPERANDEWFIAGESFAGQYIPHIAAKLKEKNLVNLGGLAIGNGWINPLSHYETYLNYLVEKGMVDFESELGQYLHHSWAECLLAFDKIGSGSGDLSKCESFLGDILYMVSKEPGKACMNMYDISLESTYPTCGMDWPYDLSYLTEFLSTREAMTSLNVNLEKVHDWEECNDDVALQYAREGIESSSKLIQDLVSTVPILLFYGENDFLCNYLSGEKLTRSLEWNGAVGFQNQSAQPFYLPGYSDQPSGSYVSSRNLTFARIVEASHMVPYDHPNEMKTLITAFFNNDFASLPSVPKPSPDLGNGNYKWLYLGLIPVALTIIILFSIYLCRRFGLFGLSKQRYQPISPTP

SEQ ID NO: 9065 - protein, 203 aa, Wigglesworthia glossinidia
MKNMCSNWWLSEHYSDKFVKESKKCKYRSRAWFKIDEIQKKNNIIKPGMVVLDIGSSPGGWSKYSSQKVGMSGKVIACDIDLMNPIPNVSFILGNIFEKITIKKIKKVKKKVHIILCDISPNITGLSIIDHSRWISLNNNILNICKYLLLKNGKLIIKSFNSVEIKNFCKKIENSFKKIKIFKPISSRSRSKEIYIVAVNYKL

SEQ ID NO: 9066 - protein, 570 aa, Unknown
  Frankia sp. EAN1pec
MHAVAVVTPGPQARGSGSDPAPSQVSRPGEVWLVGAGPGDPGLLTVRGRELLATADVVVTDRLAAAVLLDVARPDARVIHVGKSPTTSRSQDEVNALLVEHARAGARVVRLKGGDPFLLGRGGEEAEACAAAGVSCTVVPGVTSAIAVPAYAGIPVTHRGVAQDLAIISGHLPPGHPESTVDWAALGASRATIVVLMGVARLVDIVDALLAGGRPPGTPAAVIERGTTPAQRVLRTTLDALVVDAVAFGLRSPAVLVVGEVAARRDAAVPIPPVVEADADHGERVPDGYGTGDTRVPDGQGISDGRGVSGGQGGRASSGRPGVAGDAPLAGIRVLVPRTRARQGLLARRLRELGGEAVETVVSRLVPTGDATPLREALPGADGLVLADSDEVAAVVSLLRGAGTDVRALAGLTLVAASASAAAALDALGLACARSSAEVQVAHTVVTEVPVPGLRVVICGAAPPPVGIRTLRRVRLLADAPAEADPRIAEELRHGDVDAVALASSTAARCLVELYGPLPDSVLVAAMGRRTAQACEAVGLRVDAIPSEPGIYPLAAAVADLVAGRRAPTA

SEQ ID NO: 9067 - protein, 582 aa, Gibberella zeae
MDSTIPTSLLTALNCRGNIHLVIGTNPLAATRCGQSLGSGAQPILIAPEGAELHYALQKRIDDGSVQWHKKEFQDTDLLRLGRQEVDGVVDAVFVTSAPRDAQTIHISTLCKRNRIPVNVVDAPQLCTFSLLSTHSDGPLQIGVTTNGRGCKLASRIRRDIAASLPTNLGAACTRLGDVRRRIHTEDALVAEDDPASPDDSFDQDAHFNRLVTEEDAKNRRVRWLSQVCEYWPLKRLAAITDDDVETVLKSYPGNGPDIKRDPGTPEKRVGTIILAGSGPGHPDLLTQATHKAIKSADLILADKLVPSGVLDLIPRRTPVQIARKFPGNADRAQEELLEMALAGVQEGKTVLRLKQGDPYVYGRGGEEVAYFRQHGYGDRVSVLPGVTSALSAPLFAAIPPTQRDIADQILICTGTGKKGKAPSPPEFVPSRTVVFLMALHRINGLIRELTTHVELEPLDPVNEDAATAQPPPPPEPTQVSPITGESKRVLWPRNTPCAVIERASCPDQRVIRTTLEHVAEAIETEGSRPPGLLVPLRGFMFQEQKTQYKQACAFVQGVEATDMKEPANSSNEMGTLGARDE

SEQ ID NO: 9068 - protein, 130 aa, Triticum aestivum
  misc_feature (51)..(51): Xaa can be any naturally occurring amino acid
  misc_feature (59)..(59): Xaa can be any naturally occurring amino acid
  misc_feature (69)..(69): Xaa can be any naturally occurring amino acid
  misc_feature (75)..(75): Xaa can be any naturally occurring amino acid
  misc_feature (90)..(90): Xaa can be any naturally occurring amino acid
  misc_feature (99)..(99): Xaa can be any naturally occurring amino acid
  misc_feature (102)..(102): Xaa can be any naturally occurring amino acid
  misc_feature (104)..(105): Xaa can be any naturally occurring amino acid
  misc_feature (112)..(112): Xaa can be any naturally occurring amino acid
  misc_feature (116)..(116): Xaa can be any naturally occurring amino acid
  misc_feature (121)..(121): Xaa can be any naturally occurring amino acid
  misc_feature (125)..(125): Xaa can be any naturally occurring amino acid
MSRRGDWVYENNGGTCVAIAGADYCVVAADTRLSVGYSILTRDHSKICDLXADKCVTSXSPGFKGDIKXLHKNLXARELLYQHQHNKRIXCPAMDILSXTLXYXXFFPYYPXMCSXGFYSXGKVXFTKMH

SEQ ID NO: 9069 - protein, 520 aa, Gossypium hirsutum
MVGNSLAGLQDHLKLAREYALEGLYDTSIIFFDGAIAQINKHLNTLDDPLIRSKWMNVKKALSEETEVVKQLDAERRSFKEAPNGRRPSSPPIHAKSSFVFQPLDEYPTSSGAPMDDPDVWRPPSRDTSTRRPARGGQAGMRKSPQDGISGRGNTRTAATGRGAKAGASSRTNTGVRGSTTGKKGTGSGKSSKGDSANGDAEDGKLKRSQYEGPDPDLAEMLERDVLETTPGVRWDDVAGLTEAKRLLEEAVVLPLWMPEYFQGIRRPWKGVLMFDPPGTGKTLLAKAVATECGTTFFNVSSATLASKWRGESKRMVRCLFDLARAYAPSTIFIDEIDSLCNARGASGEHESSRRVKSELLVQVDGVNNTGTNEDGSRKIVVVLAATNFPWDIDEALRRRLEKRIYIPLPNFESRKELIRINLKTVEVAADVDIDEVARRTEGYSGDDLTNVCRDASLNGMRRKIAGKTRDEIKNMSKDEISKDPVAMCDFEEALAKVQRSVSQADIEKHEKWFSEFGSA

SEQ ID NO: 9070 - protein, 72 aa, Wigglesworthia glossinidia
MTKEENIEMQGIVLDTLPNTMFKVELENKHVVLAHISGKMRKNYIRILTGDKVTVELTPYDLSKGRIIFRSR

SEQ ID NO: 9071 - protein, 178 aa, Zea mays
  misc_feature (77)..(77): Xaa can be any naturally occurring amino acid
  misc_feature (111)..(111): Xaa can be any naturally occurring amino acid
GSTSCARDMTPLSGVSDIIPTMGICESDCAPCGYFMNAIHGSAFSTVHATPDDGYNYASDEVVGLDATGLTYGDLVXRALECFGPLDYFDAGTIFCVRGLAGTWGKALGAXDYDCNNMVEQELPVCGLLQNHIFCAAENAVATFSKSDVHCFDRENVESAPTAMKKDYTVPNLLCWEE

SEQ ID NO: 9072 - protein, 502 aa, Magnetospirillum magnetotacticum
MALVATAASKAFSVRAIDNNGLYRLYSHDDIAAEVEHFRPDVIGLSIITANALTSYETAEMLKRRFPDIPILAGGLHVSHQVGEALESGIDYVVRGEADLTIVPLLSALVEARDRGMPPDFTGIAGVSHGRGEAFVDGGNATLPLNLDEHSDVDFGLYDLGDFYRHPRDSLAIGSVLTQRGCPFRCTFCSDQYLSQSVRYRSIARSVDEIEDKLDRFGVNIFNIRDADFTMHNERVVEFCNELIRRGLHNRINLTIETDSFRVIPRDTLALMKQSGFSSIGFGIERLTPEIQRRIKKNISRSRIMENLKNCRELGFVISVHCLIGFSFDTMEDIAREQALFDELADQYVDIVSASIVVACPGTSEFSAVPPERSSWYLNPSAFPSRRPLYQVVRRFQYDPRHVPIYDFPPGMMERMMDFRDHFRKKTIGKRGRPLLWAYLLMLQIARLSEALYAASPRLERATFGWTLDWLETLNAIFTKLWAKRNDDRVNANHSCGQTPQP

SEQ ID NO: 9073 - protein, 335 aa, Anaplasma marginale
MQVTILGAGAFGTALSIALCNTGKKVRIWSRNGQVVESLRTHGENSVYLPGFKVPREVLVHSDMGLATDGPAAILMCVPAQELRSLCNTITAASALEAGVPLLVCSKGIENSSLKFPSEVVAEMFPQNPVFVLSGPALARELASGLPCAMVLAGDEITTAETLASQLSGPALAIVHSGDLMGVQVGAVMKNIIAIASGIIAGMGLGHNASAIVMVQGMSEIKAVCEAKVGVAATETLIGLSCLGDLVLTCTAPGSRNMSFGSSVGKAGRAGASGQQKPMLVEGVESVTAMVNMGKALNLELPICSAIARMLHGQLGVRQAAAEILSAPVKSRLNV

SEQ ID NO: 9074 - protein, 98 aa, Anabaena sp.
ATFKVTLINEAEGTKHEIEVPDDEYILDAAEEQGYDLPFSCRAGACSTCAGKLVSGTVDQSDQSFLDDDKIEAGYVLTCVAYPTSDVVIQTHKEEDLY

SEQ ID NO: 9075 - protein, 112 aa, Methanococcus maripaludis
MKKLEAIIRMERVGLVKNALYKSGHASLTLTEVKGRGVQGGIVERYRGTEHVVDLLPKVKIELVVNEKDVDSVIKIIAENAYTGKPGDGKIFVIPVEDVCRVRTGEMGPDAI

SEQ ID NO: 9076 - protein, 99 aa, Zea mays
  misc_feature (37)..(37): Xaa can be any naturally occurring amino acid
  misc_feature (62)..(62): Xaa can be any naturally occurring amino acid
  misc_feature (70)..(70): Xaa can be any naturally occurring amino acid
  misc_feature (89)..(89): Xaa can be any naturally occurring amino acid
RAEQALLTVAAHAEMSPLIMISLSTDVTVFMGRSAFXTSQRVERVRDHCAPSINGKTHFDIXHERANEFXDRAKSKDDEGFNRGHILVXGSIGHIAVYY

SEQ ID NO: 9077 - protein, 347 aa, Flavobacteria bacterium
MDFHKLTIQQVTKVTPQAVEIRFDIPQELVSDFNYQSGQYLTLKAIIDGNEVRRAYSLSSAPHENHWSVVVKAVENGVFSNYAMTLRAGDQLDVAAPEGLFVHEKSTTAQTYLGVAAGSGITPIISIIKTVLETEPDSKFALIYGNQSISQTIYFEQINDLQDQYGDRFIIRYSFSREERDGELFGRVTKGNLNFFLKQDCTDYAFAKAYLCGPEDMITMTTDNLVEKEIIAKENIHFELFSTKENKIEITEDSHLTEVTVILDDEEHTFTMKRSDNMLDVMLKNDIDAPYSCQGGICSSCICQIEEGSAQMAKNAILTDSEIAEGLSLACQAYPTSAKVKVNFDEV

SEQ ID NO: 9078 - protein, 98 aa, Anabaena sp.
ATFKVTLINEAEGTKHEIEVPDDEYILDAAEEQGYDLPFSCRAGACATCAGKLVSGTVDQSDQSFLDDDQIEAGYVLTCVAYPTSDVVIQTHKEEDLY

SEQ ID NO: 9079 - protein, 112 aa, Chromobacterium violaceum
MKKVEAIIKPFKLDEVREALSEIGINGLTVSEVKGFGRQKGHTELYRGAEYVVDFLPKVKIEVVLPDDLVERAIETIVETARTGKIGDGKIFVVPVEQVVRIRTGETNEQAI

SEQ ID NO: 9080 - protein, 587 aa, Magnetospirillum magnetotacticum
MEGAVALGMRRLSVIDLAGGNQPIHNENGSISVVFNGEIYNFRELRRELEEEGHIFSSHTDTEVLVHLYESHGRGMLDRLNGMFAFCLLDRRAGRLFLARDRVGKKPLYYAHGDGAFAFASEIKSLLCHPAVRREADPAAAALYFTHGYVPAPFTPFMGIRKLPAGHWLELDLASGEIQVGRYWDLDYSQVDEDLCEEEAVAGLESALLAAVERRLISDVPLGVFLSGGVDSSLVVAMMARFREGRDIHAFSIGFHEKAFDESGYAESVARAWGVDHHVTRFSDAEMFSVIDEILPRMDEPLSDPSLIPTYLLSKVTQDSGIVVALSGDGADEMFGGYPKYYIHRYAAWLDRLPGILGRDVPAWLFSQVPLKAENNIFNYKVERFVSGLRLAPRHRNQFWVAPFMPDELTRLLPEQEVPRAVWEVTDQYDSRFNGRGVVDRMMYFDAKMMLQDMYLAKVDRASMAVSLEVRSPFLDLEVMDAAVHLPWQLKVRGRETKYLLKKLASRYLPHDVVYRFKRGFGLPLAVWMRTLAPRISETLTQGDCGGIDAAYVQSLLREHLDGTRDHAVKLWAVYAYLTWLRNWGGS

SEQ ID NO: 9081 - protein, 996 aa, Lactococcus lactis
MMTMIDVLERKDWENPVVSNWNRLPMHTPMDLLEKQSLNGLWNFDHFSRISDVPKNWLELTESKTEIIVPSNWQIEFKDKSDVPIYTNVTYPIPIQPPYVPEANPVGAYSRYFDITKEWLESGHVHLTFEGVGSAFHFWLNGEYGGYSEDSRLPAEFDISNLAKEGQNCLKVLVFRWSKVTYFEDQDMWRMSGIFRSVNLQWLPDNYLLDFSIKTDLDEDLDFANVKLQAYAKNIDDACLEFKLYDDEQLIGECHGFDAEIGVVNPKLWSDEIPYLYRLELTLMDRSGAVFHKETKKIGIRKIAIEKGQLKINGKALLVRGVNKHEFTPEHGYVVSEEVMIKDIKLMKEHNFNAVRCSHYPNDSRWYELCDEYGLYVMDEANIETHGMTPMNRLTNDPTYLPLMSERVTRMVMRDRNHPSIIIWSLGNESGYGSNHQALYDWCKSFDSSRPVHYEGGDDASRGATDATDIICPMYARVDSPSINAPYSLKTWMGVAGENRPLILCEYAHDMGNSLGGFGKYWQAFREIDRLQGGFIWDWVDQGLLKDGNYAYGGDFGDKPNDRQFSLNGLVFPNRQAKPALREAKYWQQYYQFELEKTPLGQVFAFTVTNEYLFRSTDNEKLCYQLINGLEVLWENELILNMPAGGSMRIDLSELPIDGTDNLFLNIQVKTIEKCNLLESDFEVAHQQFVLQEKINFTDRIDSNEEITLFEDEELLTVRSAKQKFIFNKSNGNLSRWLDEKGNEKLLHELSEQFTRAPLDNDIGVSEVEHIDPNAWLERWKGIGFYELKTLLKTMIIQATENEVIISVQTDYEAKGKIAFSTIREYHIFRNGELLLKVDFKRNIEFPEPARIGLSLQLAEKAENVTYFGLGPDENYPDRRGASLFGQWNLRITDMTTPYIFPSENGLRMETRELNYDRLKVRAMGQSFAFNLSPYSQNQLAKKGHWHLLEEEAGTWLNIDGFHMGVGGDDSWSPSVAQEYLLTKGNYHYEVSFKLT

SEQ ID NO: 9082 - protein, 544 aa, Mycoplasma pulmonis
MKNKELWWRTGSIYQVYVRSFKDSNNDGNGDINGLISKLDYLHWLGIKAIWINPIAKSPMVDNGYDVSDYKDIDPLFGTMSDFENLIEKAHSKNIKIIWDFPLNHTSSEHPWFKQALKGNPKYLKYYYFTKTYKLNRDSVFGGSFWTKTSNGYYYAHVFAKEQPCLNWFNQDVVDEFVEIINFWLDKGVDGFRFDAFDEIGKPTDLFTRENFYEHDKKFVIEKFKELRQKTWKDDNEIMSVSESWAMNSKDVNENTNLENKAYSLTFNFDHMISEFEYVDGKKTWKGFDFIKFKKIIAQWQKDVSNGWNSLYFNNHDQPRAISRFLHDQVDFLDQKAKAFALTLHGLKGTPFIYQGEEIGMDNSDHTNDISKINDVNDLRTYEYHVLKQKIMTHNDFMKLSSIFSRDNARTPIPWNSKGGFNDSGKSWLPYNKSFKTINVEDQIDQENSVLSWYKKVIDLRNNPKIRSTIIQGDFELIADEDPNIFAYKRKDDFQELVFVINWSQKLIDNNLNLKNYEVFLNNYPTYQSSKLLPWQALILIRKS

SEQ ID NO: 9083 - protein, 525 aa, Burkholderia xenovorans
MKTVQHAAYEILRRHGLTTIFGNPGSNELPFLKHFPSDFRYILGLHEGVVTGMADGYAQATGNPAFVNLHSAAGTGNAMGALANAWNSHTPLVVTSGQQVRSTIGMEPLLANVDAVNLPRPLVKWSTEPASAEDVPRSFAQAIHIARTPATGPVYLSIPYDDWDQPAPEYAHYLAAREVQHAGLPSEAILQALADRLQRATNPVLVLGPDVDAQHANESAVALAERLKMPAWMAPSAPRCSFPTTHACFRGVLPAGIASISRLLDGHDLILVVGAPVFRYHQYEPGALLPAGAELVSITCDVLEAARAPMGDAIVADIALTLEALAARAEPAARPMPVAVARPAAAAETPGPLAPERVFDIVDAIAPRDAIYVNESTSTTNLMWQRLRMTSQGSYYFAAAGGLGFAMPAAAGIQLAQPGRRVIGIIGDGSANYGITALWTAAQYSIPTIFIIMKNGTYGALRWFAGVLGVEDVPGLYVPGIDFCALARGYGVEALHADSGASLTVALERALSSSRPTLIEVETLA

SEQ ID NO: 9084 - protein, 450 aa, Idiomarina loihiensis
MSYIKETIEKLKQTSPAQVEFYQAVEDVLESIEPLLEERPKYREHSIIERLLEPERQIMFRVPWMDDDGKIQVNKGYRIEFNSALGPYKGGLRFHPSVNAGIVKFLGFEQIFKNALTGLPIGGGKGGANFDPKGKSDAEIMRFCQSFMSELYRHIGPHTDVPAGDIGVGSREIGYLFGQYKRLANRFDGVLTGKSELWGGSQVRKEATGYGVVYFAQCMMDDQDDSLDGKRCLISGSGNVAIHAMEKLYELGAKPISCSDSSGTIYHDSGIDLDLVKRIKEEQGGRLKEYLETHEDAEYTSKDDYPEEGHCVWRYEADIAFPCATQNELTEKDAQALLENGCKYIVEGANMPTTQAAVDLFIESGVGYGPGKASNAGGVATSQLEMAQNASMLRWDFEEVDEKLKDIMSNIYQDAKRTAEDFGHPSNLVLGANIAGFRKVADAMLEQGVV

SEQ ID NO: 9085 - protein, 61 aa, Cucumis melo
DTLLDADLESDILGWQYISGSLPDGHELERLDDPQIQGSKYDPDGEYIRHWLPELARMPTE

SEQ ID NO: 9086 - protein, 415 aa, Magnetospirillum magnetotacticum
MDPTITVVVGGAHVNALTEHTLLGRPEIDLAILGEGELTFSEFLTRIDAGEDWCQIQGIAFARDNDLVRTESRPLIENLDDLPFPARHLLPMELYFSNHENPYVYRNRHTFMLASRGCPKRCIYCSIQSVWSHKWRHHSADYVVRQIEHLVRDYGVGEIHFVDDNLTANPKTAMEIFQTLIERKLDVKWTCPNGTAIWTLDEKLLDVMKTSGCYRLTFGIEAASKETQAYIRKNLNTERARAMLSYANKIGIWTVSTFIFGFPHQTKEDMQDSIRYAISSGTDFATFYSLMPFPKTELWEILKKEDLINEGDFFENIGYYLSTRGLDTTLYKSDEIREMTHLGYKRMLSTQVKRLITNPGHYFRKINSVDDFRYFCKLLGNFLFMARTLMKSAIFGKNRKVGGTVYWQRKAVQRE

SEQ ID NO: 9087 - protein, 112 aa, Haemophilus influenzae
MKKIEAMIKPFKLDDVRESLSDIGISGMTITEVRGFGRQKGHTELYRGAEYMVDFLPKVKLEVVVPDELVDQCIEAIIETAQTGKIGDGKIFVYHVERAIRIRTGEENEDAI

SEQ ID NO: 9088 - protein, 483 aa, Magnetospirillum magnetotacticum
MKVLFINPWQKTLFGDEKARPGHPHLGLAYLVAVLKKAGHSCAVFDQGLENDDDLLFRRLHDWQPDLVGITSFSFSIDYAADLIRRIKEVSDVPVIIGGAHVSAVRERVLEETVADFAMYGECETAILDFLVQLGGERDFAKVPNLIRRTEECGLVANPATAMISELDDLPYPDFEAFEFERYNYYSAKALPIITSRGCPYKCNYCSVKLSMGRGFRKRNPESIVDEMEFWKKRYGIRRFEVNDDCFSLDLKRAEAICDLIIERKLGITYEMYNGIRADRVSEVLLRKMKASGCVFVSFGCESGDQEIVYNMGKKLKLEDVRNAVELTRKVGIRNSVNFIVGHRNETFEAFQRTLDFAASLPTDFVNFYNLVPYPGTEVYEWMKAEARQLIPDQEFLSRIGSRNFEPVYETDEFPRADRIRAMELGNALYEKTVLIYRFGRVAGTLAYLVSRNRTLFTIGRKLALDNPIGFFIYSKVTAASRR

SEQ ID NO: 9089 - protein, 889 aa, Oryza sativa
MAASVEYKLAPHPWASNAPSSNLDLFPSGGGKRRSGSETDSDDEDSIPPDWRSLYHPRLEVAEPAVKDPRDEATSDAWVRRHPALVRLTGKHPFNSEPPLPRLMSHGFITPAPLHYVRNHGAVPKADWSTWAVEVTGLVKRPARLNMEQLVTGFEAVELPVTLVCAGNRRKEQNMVRQTVGFNWGPGAISTSVWRGVRLRDVLRWCGVMGASAGAANVCFEGAEDLPGGGGCKYGTSLRREVAMDPAHDVILAYMQNGEPLTPDHGFPVRVIVPGFIGGRMVKWLKRIIVASSESESYYHYRDNRVLPSHVDAELANAEAWWYKPEYMINELNINSVITTPGHDEVLPINALTTQRPYTMKGYAYSGGGRKVTRVEVTLDGGETWQVCNLDHPERPTKYGKYWCWCFWSVDVEVLELLAAKEIAVRAWDESLNTQPEKLIWNLMGMMNNCWFRVKTKTCRPHKGEIGLVFEHPTQPGNQAGGWMARQKHLETSESAVSTLKRSTSTPFLNTATTQYTMSEVRRHTTPESAWIIVHGHVYDCTGFLKDHPGGADSIMINAGTDCTEEFDAIHSDKARGLLEMYRIGELIVTGSDYSPQSSSADLTSIVESPTAAAAPAVPVSTVALSNPREKVKCRLMDKKSLSYNVRLFRFALPSPDQKLGLPVGKHVYVCASIGGKLCMRAYTPTSSVDEVGYIELLIKIYFKGEDPKFPDGGLMSQYLDYLPLGATIDIKGPIGHIEYAGRGAFTVNGERRFARRLAMVAGGTGITPVYQVIQAVLWDQPDDGTEMHVVYANRTEDDMLLREEIDRWAAAHPARLKVWYVVSKVARPEDGWEYGVGRVDERTLREHLPPGDGETLALVCGPPAMVECTVRPGLEKMGYDLDKSCLVF

SEQ ID NO: 9090 - protein, 61 aa, Hordeum vulgare
DTLLDADLESDALGWQYISGSLPDSRELDHIDNPQLEGYKFDPHGEYVRRWLPELARLPTE

SEQ ID NO: 9091 - protein, 570 aa, Zea mays
  misc_feature (480)..(480): Xaa can be any naturally occurring amino acid
LHENPVHTPLRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTITCYQAIINNLDDAHEYIDTVIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEXVEIHDGPYNVIKNWDYTGLVNAIHNSEGNCWTMKVRTEEQLKEAIATATGAKKDCLCFIEVIVHKDDTSKELLEWGSRVSAANSRPPNPQ

SEQ ID NO: 9092 - protein, 61 aa, Hordeum vulgare
DTLLDADLESDALGWQYISGSLPDGRELDRIDNPQFEGYKFDPYGEYVRRWLPELARLPTE

SEQ ID NO: 9093 - protein, 213 aa, Glycine max
MGTPETSREPCPDRILDDIGGAFGMGAVGGSAFHFLKGLYNAPRGARVVAASQAVRLNAPRVGGSFAVWGGLFSSFDCTMVYLRQKEDPWNSIFAGAATGGFLSMRQGLPAAARSAAFGGVLLALIEGAGIMLNKFLSAQQPMPMIVDEPLPPNGLPGQPVASAPDAASQSSWLGGWFGDGKKDEAAAEATGGSETKVLESFDAPPVPNFEYK

SEQ ID NO: 9094 - protein, 61 aa, Hordeum vulgare
DVLLDADRESDILGWQYISGCLPDGHELGRLDNPEVQGQKYDPDGEYVRTWIPELARMPGE

SEQ ID NO: 9095 - protein, 296 aa, Unknown
  Rhizobium sp. WSM870
  misc_feature (106)..(106): Xaa can be any naturally occurring amino acid
  misc_feature (281)..(281): Xaa can be any naturally occurring amino acid
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEXGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHXFVNNGYRGYLEDRRP

SEQ ID NO: 9096 - protein, 421 aa, Thermococcus kodakarensis
MVEIDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPCTDIPAPDVYTNPKIMAWMMDEYETIMRRKGPAFGVITGKPPGVGGIVARMDATARGAAFTIREAAKALGWDDLKGKTIAIQGYGNAGYYLHKIMSEEFGMKVVAVSDSKGGIYNPDGLPPADEVLKWKKEHGSVKDMPGTQNITNEELLELEVDILAPSAIEGVITKENADNVKAKIVAEVANGPVTPEADEILHEKGILQIPDFLCNTGGVTVSYFEWVQNINGFYWTVEETRKRLDDKMTKAFWDVFNTHKEKNIHMRDAAYVVAVSRVYEAMKHRGWVKK

SEQ ID NO: 9097 - protein, 506 aa, Onion yellows
MKISIKDIFQKPELFYQKKIVLNGWVRNCRYQKKLIFIDLNDGTFLENLQIICKETKTKNIETAAEITEFHENQKVNTKNESPNNINLEKLKEMLQIGASLQVEGILKATNNPQTPFEISAQNVSLLGASDFSYPLQPKKHSKAFLRQISHLRVRTKLFGAVFRIRNTAFFALHSFFQKKGFFHINTPIITANDGEGAGELFQLTTLNLEALPQTKNIPNASKLADETISKNEIDYQKDFFGKKVFLTATGQLEAEAMALGLNKVYTFGPTFRAEKSNTPRHAAEFWMLEPEMAFCNLSQNLKVAQEMLQFVIAKCLEQNYQDIEFLDKTEKNCLIEELKNISEEKEFLTVKYEQALEILQKSNTKFENPLFYGADLATEHEKYLTETHFKKPVFIVDWPKEIKAFYMKNNPDQKTVAAMDLLVPRVGELIGGSQREENLSVLIEKMNQMKIPQKDLEWYLDLRRFGGCIHSGFGLGFERLLIFLTGLDNIRDVIAFPRTYHNLVF

SEQ ID NO: 9098 - protein, 583 aa, Solanum lycopersicum
MSSGGCSIVWFRRDLRLEDNPALAAAVRAGSVIAVFIWAPEEEGYYCPGRVSRWWIKKSLAHLDSSLKKLGTSLITKRSNDSVSSLLQVVKSTGATRVFFNHLYDPISLVRDNCAKETLSAEGVSVCSFNADLLYEPWEVVDDESRPFSTFSDFWEKCLTMPYDPEAPLLPPKRIISGDASRCPSDNLVFESELEKGSNALLARAWSPGWSNADKALTTFINGPLIEYSKNRSKADSATTSFLSPCLHFGEVSVRKVFHRIRTKQTLWANEGNKAGEESVNLFLKSIGLREFSRYMSFYHPYSHERPLLGQLKYFPWLVDEGYFKAWRQGRTGYPLVDAGMRELWATGWLHDRIRVVVSSFSVKVLQLPWTWGMKYFWDTLLDADLESDALGWQFITGTLPDGCEFLGIDNPQFEGYKFDPNGEYVRRWLPELARLPTEWIHHPWDAPESVLQAAGIELGSNYPFPIVEIVAAKERLEEALSQMWQLEAAARSAIENGMEEGHGDSTDEFVPIAFPQAMQIEMEANNVPVRNNNPTITALRRYGDQIVPSMSSSFFRNEDEETSVDIRNSVVDSRAEVPIISM

SEQ ID NO: 9099 - protein, 212 aa, Debaryomyces hansenii
MNLMTISQSLDESYTKHKIIPDVVDKFDTQGLLTIEYNEQDHVALGNTLKVENTQHHPVIQFTLNSPGQENDFEISNNDKFTLVLTDPDAPSHKDHKWSEYAHWIVTDLPLNANSNDVESAESLTTVLDYSKGKELLSYQGPAPPPKTGKHRYVFLLFRQDPSVSKFETPKDRPNWGTGTPSSGVRDWIKKNGPELKLLGVNFFYAQNDTQE

SEQ ID NO: 9100 - protein, 526 aa, Burkholderia vietnamiensis
MSNVELFHYLLLLICGAGALTWLAERVSIPPAVVLLVGGCVVAVAGKRVPDMDPALLLAAVLPPLLMSSGFYTAWKEFRHELASIASLALGAVAFTTVAVALAVHAANPALPWAACFTLGAIVSPPDAVAAKAILQRHPLPARLVAVLEGESLVNDASGLLLYQMAVSAALAVTITTAGATALFFSLTLIGIVTGLVCGHAMCWVLQRVREPMLGIVVTFAMAWGSYGIAEAVHGSGVLSVVTCGLVLGVRQHRVFGADLRIKAKATWEAVVFVLDALVFILIGLALHAILARVNQEGAVLMAGLRVALPATAAAIAARVVWVFVAMWLPARLRAPRAGHPPWSWREAVVLGWSGMRGVVSLAAAIALPADFPARDLILFSTFLLIIATLVVQGGTLAPLIRVLKLRPAVRRTMSEHAVRAHTFGAALAALDARGPDGDGLERASRERLLTEYRNRVAFNERAHRDGAQPAQVRARMLGVELEMVGVSRDALLALHRDGRVDDAVLHRIESELDFEELRLQRLLEP

SEQ ID NO: 9101 - protein, 489 aa, Arabidopsis thaliana
MSTVESSKPKIINGSCGYVLEDVPHLSDYLPGLPTYPNPLQDNPAYSVVKQYFVDADDSVPQKIVVHKDGPRGIHFRRAGPRQKVYFESDEVHACIVTCGGLCPGLNTVIREIVSSLSYMYGVKRILGIDGGYRGFYAKNTVSLDSKVVNDIHKRGGTILGTSRGGHDTTKIVDSIQDRGINQVYIIGGDGTQRGASVIFEEIRRRGLKVAVIGIPKTIDNDIPVIDKSFGFDTAVEEAQRAINAAHVEAESIENGIGVVKLMGRYSGFIAMYATLASRDVDCCLIPESPFYLEGEGGLFEYIEKRLKESGHMVLVIAEGAGQDLMSKSMESMTLKDASGNKLLKDVGLWLSQSIKDHFNQKKMVMNLKYIDPTYMIRAVPSNASDNVYCTLLAQSAVHGAMAGYTGYISGLVNGRQTYIPFYRITEKQNHVVITDRMWARLLSSTNQPSFLGPKDVFDNKEKPMSALLDDGNCNGVVDVPPVTKEITK

SEQ ID NO: 9102 - protein, 356 aa, Zea mays
MAFTGDADGFALDFIREHLLGAGCGGDPDPVHCTVDLDGDDITFPVLPPPQPEFEPMPFLPPPPPPPQHQHQGYIGVDPTNEYMGEPAAVFPEQEPAPPVIITFGSEPSSPVKQPLTIAVPPRPYYASAAAATAPTAAQLVAAAAEAVEDFRKYRGVRQRPWGKYAAEIRDPKRRGSRVWLGTYDTPVEAARAYDRAAFRMRGAKAILNFPNEVGTRGADFWAPPAPAKKADTAAANKRKRQQLVEDADGDDVEVVAVVVSKAAKVVDEIPASSPSQDQTSCTSRSSSVSTRETTATASSTVTSAAEETGSGAVGLPMTPSSGNWEQYWEALLGSLPLLSPQSPLPALGFPQLTVT

SEQ ID NO: 9103 - protein, 112 aa, Leptospirillum ferrooxidans
MKKVEAIIKPFKLDAVKEAVTALGVYGMTVTEVKGYGQQKGHTEQYRGAEYVVEFITKIKVEIVVADAKVSPVLEAIRRTAMSNSIGDGKVFVSPVETALRIRTGETGDAAL

SEQ ID NO: 9104 - protein, 194 aa, Vitis vinifera
DSYVLSESSLFVYPYKIIIKTCGTTKLLLSIPPILKLADTLSLSVSCVRYTRGSFNFPGAQPYPHRHFSEEVAVLDSYFGKLGSGSKAYVMGSSDKSQKWHVYSASAEVRSACDPVYTLEMCMTGLDREMASVFYKTHSSSAVKMTDTSGIRKILPDSEICDFEFDPCGYSMNAIEGAAISTIHVTPEDGFSYA

SEQ ID NO: 9105 - protein, 108 aa, Unknown
  Oceanobacter sp. RED65
MSDNIITLSDDSFDADVLQSDVPVLVDYWAEWCGPCKMIAPVLEEIAEEYDGKLKVAKLNIDQNEATPPKFGIRGIPTLMIFKGGNVEGTKVGALSKSQLTAFIDSTI

SEQ ID NO: 9106 - protein, 727 aa, Anabaena variabilis
MTESTKTLCPYCGVGCGLEVTPPAQLNKATNRDSQGNPIWRVRGDKAHPSSQGMVCVKGATIAESLDKNRLHYPMVRDSLDQEFRRVSWDEAFDLITKRIQTVRLTQGAEAICMYGSGQFQTEDYYIAQKLMKGCLGSNNFDANSRLCMSSAVSGYIQSFGADGPPCCYEDLELTDCAFLIGTNTAECHPIVFNRLEKYHRKNHQVKMVVVDPRRTPTAEAADLHLAIKPGTDIDLLNGIAHLLMRWNMIDVGFIDDCTSNFSAYAEVIRHYSPEVVARQCGITVEDLEIAARYWGESQRVLSLWSMGVNQSSEGTAKVRTIINLHLMTGQVGKPGMGPFSLTGQPNAMGGREAGGLAHLLPGYRLVKNPQHRAEVEGFWGFPSGQISPHPGLTAWDMITGLEDGNVGLLWIAATNPAVSMPDLERTKKALLRSPFTIYQDAYHPTETTAYAHVLLPAAQWGEKTGVMTNSERRVTLCQAFRQPPREAKPDWEIFAEVGRRLGFEDKFAFGNSDQVYAEFAQLTKGRPCDMSGISHQKLQAQGPTQWPYPEMGNGDKNKRLYTDLRFHTPDGRARFGAYYSQGLAEPPDPAYPFVLTTGRLYGHWHTQTRTGRIEKIRAMHPEPFIEIHPRDAAKLGIIDHQVVEVRSRRGSAKFPAKVTKAISPGTVFVPMHWGTLWAEDAEANALTHSESCPDSLQPELKACAVQLIPISVEITAENYQLQSSQW

SEQ ID NO: 9107 - protein, 111 aa, Vitis vinifera
KVLVIGGGDGGVLREVARYSSIEQIDICEIDKMVVDVSKQFFPAVAVGYEDPRVKLHVGDGVAFLKAVPAGTYDAVIVDSSDPIGPAQELFEKPFFQTVANALRPGGVVTT

SEQ ID NO: 9108 - protein, 102 aa, Vitis vinifera
ECAYQEMIAHLPLCSIESPKRVLVVGGGDGGVLREISRHSSVELIDICEIDKMVIDVCKKFFPQLYVGFEDPRVQLHVGDAVEFLRHVPEGKYDAIIVDSSD

SEQ ID NO: 9109 - protein, 350 aa, Streptomyces avermitilis
MIHRRCVGGRRNHGGRVAQGSSRSRLPQQGTPVTMSSTSSTPPWNVQRLPGADGRVFLVTGGNAGIGYFVAEQLSATGATVVLGSRNPAKAEAATASIRARVPGSRVRAVRLDLADLSSLETAVESLEVERLDAVVHNAGVALDDPPREETGDGHELMFGTNHLGHFALTQWLMPLLSAAPAARVVTMGSFAAKSERLDLDDLQSRKDYQPKRTYGRSKLAQMYFGVELDRRLRAAGSTVASVVVHPGGALDSLTPSRPPVHVRSTGARLSAAPAALLLQGKHAGAWPAVRAVLDPAVRGGQLWGPRVFGLRGEPRREPVWDHLADPSVAARLWDASCDLMGTDLSTISG

SEQ ID NO: 9110 - protein, 995 aa, Listeria monocytogenes
MGAKVSVQINGVARDVVEGTRILDYLNAEGIQHPHICYSEQIGPIQSCDTCMCEVDGELVRACSTNLTDGMEIKTNSELAKDAQLEAMDRILENHLLYCTVCDNNNGNCKVHNTTELLGVEKQERPYREKGYLNDFSHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEAAMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSIGFISSSKTTNEENYLMQKLARQVFETNNIDNCSRYCQAPASDGLTRTVGIGADSGTVEDIETAGLVIIVGASPADGHPVLASRIKRAQKTRGQKLIVSDLRKHEMAERSDLFMHPKQGTDFVWLTAVAKYMIDQGWHDEAFMENRISNVADYLSFLEPFTLEYAEKETGLSVETLKKVAQMVYEADGTAVCWGMGVTQNIAGSHTSSAIANLLLVTGNFGRHGAGAYPLRGHNNVQGACDMGSLPNVLPGIQPLGNDEVRARFEEAYGVSISPEPGLKNNEMLDAIEAGTLHSMYVIGEEMAWVDSNSNHVQEILASLDFFVVQDVFLSKTAQFADVVFPAAPSLEKEGTFTNTERRVQRLYEVLEPLGDSKPDWWIIQEVAKACGKTDWNYDHPSEIMDEIASLAPFFAGVRYDRMQGFNSLVWPVSADGKDMPLLYEERFNFPDGKAQFSTLPYIAPITFPEEYNLTLNNGRLLEQFHEGNLTDKSKGLDYKLPEVFVEVSHELAKERDLESGSLVRLSSPYGRIKLRAVVTERMKGNEVYVPMHSVSSETAVNLLTSSAGDVRTKTPAYKQTKVNLTVLEKTGKNPLPDHNPRNRKRFPQNGAEVARKWSREDYQPISKVNCACGGNCGCGGKRRNH

SEQ ID NO: 9111 - protein, 289 aa, Streptococcus suis
MPKTILITGSTDGIGKHLAMKLASEGHEVILHGRNSEKFRVALSDIQLKTGNKKIHGYLADFSKLADVYRFSQEIKRDFEQIDVLVNNAGAYFGDARVATAENIEMTFMLSVQVPYILTTELLPLLEKAVGRVIHTSSFMHHFAQTRGLDFGLEQSYSAAMAYNNAKLYTIWLAIAQAEALEKQGSSVTVNAYHPGLIATNLGNDGVKRNLRSRILTSLMKPFSKDLDQGIETGYYLSLSPEVAGQSGRYFAEKKVAKVSLKGFDVPKSQALLAYLDKKIQVFKESYRD

SEQ ID NO: 9112 - protein, 570 aa, Desulfotalea psychrophila
MTEDMKISGQELSFAELFEMEENNKVVEVGDVAIGTIIGSVDDHFLVDVGDKAESYIAKSEFRLEDDTEVVVGDTFEVFVERRKEEGGLLLSREKAIAIKVWEDIAKIQEEDSTIEGRIESRVKGGMSVDIGVPAFLPYSQIDLRPVKDLDALIGESLEFKVLKFNKKRNNVVISRRAILEEARNKLREEMRSKLEEGQIIKGAITNITDYGLFIDMGGMDGLCHITDLSWGRVSHPAKLYKVGEELEVKVLKYDKEHDRVSLGVKQLRDDPWATVVDRYPVSQQATGKVVSITDYGVFVELEEGVEGLIHVSEMTWSKKPRHPSKMVAVGDEIEVMVLNIETETKRISLGMKQLQPNPWDLVTENYPVGSIIEGKIKNITDFGVFIGIEEGIDGLIHVSDLSWTERIKHPTEKYAKGEMIQAVVLKIDKENERFSLGVKQLIPDPWQEAYNNYPSGTVVEGEITNVTDFGVFVKLEEGIEGLVHVSEISKDKIKTPVGMYQVGDTLKAIVINVSAKDRKIGLSVKTLEGEDEEVVVEKFKKAEKVASEAAPSTFGDLLKAAAVGTDSEQ

SEQ ID NO: 9113 - protein, 731 aa, Kluyveromyces lactis
METPLIKKQPVPLEPHETPHVHDDPDEPPFQYEEPSFFRKAIYDVFLWLFTKIFDCFFREIRTRGGYKVPTQGPIIFVAAPHANQFVDPVILMGQVKKTVNKRVSFIVAEKSLRRPAVGTFARCAMSIGVVRAQDNLKPAKGKIRIDPDNYKRLIGVNTEFTKYHQKGLIGLPKSLGNVEIDSIVSDTELFLRKEFKMQKPEVKSTLLNGTSFKYAAKVNQSRVYHNVFEHLAHDQSIGIFPEGGSHDRTDLLPLKAGVAIMALGCMDVHPDVNVKIVPCGMNYFHPHKFRSRAVVEFGHPIEISRELVDKYRDPATNREAVKELLDTVSEGLKAVTVTCPDYETLMVVQAIRRLYAGHLVSKLPLPLVVEMNRRIVNGFQTLKDDKVIVKLKEDILKYNAHLRDYNLPDHQVETAKVNLIQSLGLLIWRSVKLVVLLILSLPGIILFSPVFILAKSISKKKAKEALAASTVKVKANDVIATWKILIGIGVAPLLYSLWSLLFVWYFKESLTKNKFISFIFAYTCCATVTYSALIIGDHGMDIFKSIRPLYLAVTSPKGLQSLKDERTVLSEKINEIVNEYGPRLFPDFNVETFASYATGHSSTDEQLEEQEDRKTMELKRRRRLAKLKKRFKEQEEKQDADSSAPTSAKPESASTTTTAATTDDESDAISMINSDNSLSNIPIFSNRERSTSSTSIGSLGSSIELAANPDEERNHSISGIADQVRRKRLD

SEQ ID NO: 9114 - protein, 332 aa, Burkholderia thailandensis
MKVAVLGAGAWGTALAAHLAARHDTLLWARDAALVAELAARRENVRYLDGVALPPALRYEADLTAALSHAQADDALCVIAAPVAGLRALCRAMRDAGRVPAHFVWVCKGFEADTRLLPHQMVAEELPDHASYGVLSGPSFAREVAQGLPVALTVASASAACRGRTLAAFHHGAMRIYTGDDVVGVEVGGAVKNVLAIATGIADGLGLGLNARAALVTRGLAEMSRLGVALGGRAETFTGLTGLGDLILTATGDLSRNRTVGLQLAAGRSLDDILAALGHVAEGVRCARAVLSIARERGVDMPITEAVCAVLFDGVAPRDAVSGLLRRDAKAE

SEQ ID NO: 9115 - protein, 379 aa, Xanthobacter autotrophicus
MAKRDYYETLGCDRGADDTVLKASYRKLAMKWHPDRSQGNGEAEVMFKEVNEAYEVLKDPQKRAAYDRFGHAAFENGGGGGPGFGNDFASSFADIFDDLFGGAMNRGRGGGQQRGRGADLRYNMEITLEEAFSGKTAQIKIPTSVSCETCSGTGAKPGTQPKACRMCGGAGKIRHAQGFFTLERTCPNCQGRGSVIEDPCSDCGGAGRVTRERNLSVQIPAGVEDGTRIRLGGEGEAGVRGGAAGDLYIFLSIEPHTFFQREGADLYCRVPISMVTAALGGTVEVPTIDGDKSKVKIPEGTQSQKRFRLSGKGMPIMRARNHGDMYVQVVVETPQKLTKRQKELLAEFEKDSSGETHPESTGFFAKVKEFFQGAAGEGA

SEQ ID NO: 9116 - protein, 365 aa, Thermoplasma acidophilum
MAKDYYKILGVDRNATDEEIKKAFRELAKKWHPDLHPENKQEAEEKFKEISEAYEVLSDPQKRRMYDQTGTVDFGAGGQNFNWDNFTHYSDLNDIFNDIFGGNFASDFFSGFGRGQREEQYDLDLYTNLDITLEDAYYGTEKRIKYRRNAMCPDCNGTGAKNGKLITCPTCNGTGQQRIVRGQGFFRMVTVTTCQTCGGRGRIPEEKCPRCNGTGTVVVNEDISVKIPKGATDNLRLRVQGKGQSYNGRTGDLYVVLRVRNDRNVQRINDDLMIDQKINFAQAALGDTIEVNLFREKYSLKIPEGTQPGEVLRIKGAGMPHLNGHGSGDLLVRVNVEVPKRLTQKQKDLIREIFDIKENHRSWFH

SEQ ID NO: 9117 - protein, 1442 aa, Magnaporthe grisea
MAPKKKIAVMTSGGDAPGMNAAVRAIVRMSIHLGCDAFCVYEGYEGLVQGGNFIRQMQAEDVRGWLSEGGTLIGTARCMAFYERPGRLTAAKNMVLNGIDALIICGGDGSLTGADKFRAEWPSLLEELVSKGELKEEQIAPYKHLNIVGLVGSIDNDLSGTDATIGCYSALSRICEMVDYIEATAASHSRAFVIEVMGRHCGWLALLAGVATGADFIFIPEHPQEGNWKEGMYAVVEKHRKLGKRKTIVIIAEGANDRNGKKITPEEVKDLLADKNGLALDTRITTLGHVQRGGRAVAYDRIIATQMGVEAVRAVIEATPETETCFIAVNENKIVRKPLMQAVKDTKKVATAIEAQDFDQAMSLRDSEFAEQYQSFQIMTTPEPALLLPKEKRMKIAFINVGAPAGGMNAAIRAGVLWCQSRGHEAIAIHNGFAGFARHHGDKPLGAVRPFDRLEVDGWASRGGSEIGTNREVPSQSGMELIAKLIGQYGFDALFVIGGFEAFQAVSELRRAQEEYPSLRIPMALLPATISNNVPGTEYSLGSDTALNALVDYSDMIKQSAAATRRRVFVIETQGGKCGYLATLAGMACGASAVYTPEEGISLDMLAADVAHFKEIFAHDKGQSRAGRLVLVNEKASNGGVPSPMDRSRAVRLAIKCIQHLEQYGPKPHEKVKADPRSAGVIGIRGADVVMTPMKEVEDTETDWPNRRPLNAFWTEMKESVDILGSRGPYPRPEPTLKGLKAKDVKRGLEARASEFLTRVLLSAQPREPFVWLACFSTPTALVICNGMEYDGFTDADFVSLLFTSRLCRLSFAILLNFSRDLYWLRKERQQLPFRSRLLLSTTSPTHFGQVLAKVKEGRDAEEVPDSQMDNTIAQSLEGLQAQHQESIKGLRATTAGMVTLASPRALPSCLVLLSLAVQLCSASMAAWWVGDKRAPQILRWNATLGAITYSSCHTKDTPAFPLDPPNVLDVAQKPRNGTSLTGQGWWNSKTTAASIFYQAEDGSLVNTYQECDLSTGKFRRLTTDIISKDAPAPIHPESGLASVLLANEGTNEGYRLFYHDDKKQVNVIGFRPATSKFYYDGIVSQDLPSGMALAAGFNSNRNYSVVFPRDDENLEHARATADDSRHGITILPRPLKDSNVGNMTSLANRTGLVLDKDFNMTTVPRLPNWTSNPKLALSTDSGTKRNVFWLGSDRRPHKLYITTQGWALQDTNVGVDEWPAADADSDLALAYERGTDNVRLYYVVGGILHELRHDKARTGNGYEWKIAAALPVVAPPDSQSGGDGGLSTGAKIGLGVGIALGVVAVGAACMSVWYVRRLKKTQAADRAQADDEEEEKRRRYEQVQQEQQQYNPYQYQQVQQHGGPHYPQSNGTSQFGSEMGSPKTTYHYGGYIPDKKAPLASASPVPQEMNATPVVYELPEQRRATEMDGGSDVMSPQSTHR

SEQ ID NO: 9118 - protein, 1108 aa, Coprinopsis cinerea
MSALAAPSSFMNSDSLSSQSPPKPSSPIVVSPPYSTNRQPTRPFKNMGSVDLRGQLPFPTGPTISLDPPPGTTFAESLKAWTDNHVARWLSDMKCGMHAEVFRINDIRGDVLLELDQDTLKEMNIVSIGDRIRILNAVKLLRQRAAARTPSPIHVTRPTASHTRTGSENLSLEQGVASGRGHSRKESTRPPPITIHPNANKGDLPDLIREPPPDSASGRSMMAPPPVRPLPVPQNATPTASQVSTPGGSHRPNLPPLPPPPRGQPPPPPTTNRTPNRWNSSASEAPSQPLPPTPQNQGLLTPSNGSTWDSRSKPSRSTSPLPPPRGVRGPVAKASGAGVASPNNSPARRLGGHPYAMPSVQATLHPPTGLQNPNLSPIDEHFAAAGQNSSSTSTPSPPSQPYRSYTPANAYNTPSLDDIRKKIVKFVIPEEGTSYMIDVTNCSSGQEVIEKVLKKIGKGGFRGIDNDGHGDRDDGSLNVDGWAVYLASGEESPSEPLTETQLLNICNAPDHPARERGLAVRRLRRQEDRSGSPLARNLQPPTQPTSKATKRASSISILSGLGVRNPDKVLGDPPSPSNEAPSPPPPPLWQSGAGNAKRPSKLRNFFGQRPPSELITDHLPEFFPMAEKKVLRTARHSILLRSGTLKRQSALSGEKDEGEPIPRMSLSTDDGHSIDLHSDDDDDDIPLSASVAPRLLPPIETGSKRLSFMSELRSKRDRSDTASMMTVDEITAEVESRRVSKMPDMSNANDLEGWTKVENAASFDTAPTVPADEVEVDDDEATLATEDDEDEDEDDSDDDFGIAIPTRTNNKWIKGALIGAGSFGKVYLGMDASNGLLMAVKQVELPQGDGPSQERKKSMLSALEREIELLKVLQHENIVQYLYSSSDDEYLNIFLEYVPGGSVATLLSNYGAFEEPLVRNFVRQILQGLSYLHERDIIHRDIKGANILVDNKGGVKISDFGISKKVDDNLLGGNRLHRPSLQGSVFWMAPEVVKQTGHTKKADIWSVGCLVVEMLTGEHPWAQLTQMQAIFKIGSSARPTIPSDISAEAQDFLQKTFEINHELRPHAAELLQHPWLSKKGKKAAAAAAAAAAAASASAASSTNDSPSS

SEQ ID NO: 9119 - protein, 61 aa, Musa acuminata
DTLLDADLESDALGWQYISGSLPDGRELDRIDNPQFEGYKFDPHGEYVRRWLPELARLPTQ

SEQ ID NO: 9120 - protein, 208 aa, Zea mays
MAEHLASIFGTEKDRVNCPFYFKIGACRHGDRCSRLHNRPTTSPTIVLANMYQRPDMITPGVDAQGVAIAPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPQHRRDNP

SEQ ID NO: 9121 - protein, 61 aa, Musa acuminata
DTLLDADLESDILGWQYVSGSLPDGHELKRLDNPEVLGQKYDPDGEYIRNWIPELARLPTE

SEQ ID NO: 9122 - protein, 817 aa, Debaryomyces hansenii
MNEFPDEHRNSTSFTMHLLGDQVLGELYQDSRELKQWLIKSNCQHHYNKFIENGITFDLLKELDSSSLKEIGINKLGDRLRLELAISSMKSEKLADNITVDELYKIMNLHLTDSITLLSGGNISNGSVSTPTNESGTLTTLTNNPYLHSNVSSSSNAANKDANKNVTFILQDGSTKKVNVTGCFNAQSIKRKVLKRLGIKQQETLYNTYIHTSLNSKSNPGVNLLFDVELVTICYSPDRLEKHRIILCRKDEYPSDMAIESSKRLMAKYERYSQTDSLKTKSQDNFSQYHMPDPRKTHASPILRNFFGQRPPSELISSNLAEYFPEAHQKDLEATVRNSVRYSVRLSRRFNLPSSILSGASSNISIHNSQNKRSSILSNGTVSGPNGAPGTPSVSSMDQNSVAAKRKPSGRTIGEMMVNNINAIDQAVSSNDVQSVFSKPQSIGSDISGPGQGSFEPKSMKSHTSPILNRSSIAASFVDPFHTDNNRNSRIELLSIDSDDDEDDFIDEYGTYTSGELDHDFKDNMLDSISEDGPKNWLQGARIGAGSFGTVYLGMNPLTGELMAVKQVSLPDKNSINNSLQTAMIEALQHEMTLLKEINHENIVRYLGSSTDDNFLNIFLEYVPGGSVQSMLSSYGPFEEPLIRNFIRQILIGLSYLHGEDIIHRDIKGANILIDIKGTVKISDFGISKKVGNSDVDMDDETNSQKKGERRASLQGSVYWMAPEVVKQTAYTKKADIWSVGCLIVEMFTGKHPFPDFSQMQAIFKIGTHITPQIPEWCTSEAKDFLYKTFELDYEKRPDAIDMLAEPFLNPLIMSKQ

SEQ ID NO: 9123 - protein, 355 aa, Glycine max
MSLLSDLINLNLSDITDKVIAEYIWVGGSGMDMRSKARTLSGLVNDPSALPKWNYDGSSTGQAPGEDSEVIYIHKQFRDPFRRGNNILVMCDAYTPAGEPIPTNKRNKAAKIFIHPDVAAEEPWYGLEQEYTLLQKDVQWPLGWPLGGFLGPQGPYYCGTGANKAFGRDIVDSHYKACIYAGFNISGINGEVMPGQWGFQVGPSVGISAADELWVARYILERITEIAGLVLSFDPKPIQGDWNGPGAHTNYSTKLMRDDGGYEIIKKAIAKLEKRHKEHIAAYGEGNERRLTGPDETADMNTFLWGVANRGASVRVGRQTLKAGKGYFEERRPASNMDPYVVTSMIADTTILWKP

SEQ ID NO: 9124 - protein, 86 aa, Hordeum vulgare
DFVRSNELQEGDFIVLYSDVKSGKYLIRGVKVRAAQELAKHKNGSPEKGGASEVKAEDGGCKEKSPHGVRRSRQEAASMNQMAVSI

SEQ ID NO: 9125 - protein, 133 aa, Xenorhabdus nematophila
MSENLKSLNNIRTLRAQARECELTTLEEMLEKLTTVVEERRDEESQARAQIEERTRKLQEYREMLEKDGIELSDLVDALSGKATSKSKRAARPAKYSYFDEGETKTWTGQGRTPAVIKKAIEEEGKKLEDFLI

SEQ ID NO: 9126 - protein, 1111 aa, Yarrowia lipolytica
MDELEQLEIIALVSTLTQEINNYTGINDKTLAEFVLGMYEESKGDRDDFATKLKAVGGDFPDSFVDRMRQLISDLHPKYRGNSMPAPVKEEPTVKKEEPSEKLSVLTMKDTAPIKSDMGPEEVTKPRNEERDREYRDRSDRRDRSKRRSLSPDQGELDLEPIINKVYKGRVKNLTSFGAFVTLSGLKNKTDGLVHVSVLAANRVDHPSDVVSVGDVVYVKVCKIDGRKIGLSLNDVDQQTGQVMERVERSRGRDGGSEERGRRYQKQDEQPVKKRTRLTSPERWEIRQLIASGVVNAADYPDLDEDIESLQQEATVGVEEDVEIEVKEIEPPFLAGQTFQSLELSPVRVVKAPDGSLNRAAINSAVSAKERREKKQKEKAEDLLSQDAASETRDSRNSLDVASDPLAHHKYGAADPEWKQATIGTKNTAYGNRQRDSMSIAEVRRSLPVYEFRQDLINAIRDNQIIIVVGETGSGKTTQITQYLYEAGFAKNKRIGCTQPRRVAAVSVAKRVAEEVGCKVGKEVGYLIRFEDWTCPQTKIKYMTDGMLQREALVDPDMDQYSVLMLDEAHERTIATDILFALLKKAAKRRPDLRLVITSATLNAEKFSSYFDGAPIITIPGRTFPVEEHFAKEPEADYLEAAIDTVMDIHVTQDPGDILVFLTGQEEIDSACEILYERSKKIESVAGPLIILPVYSSLPSEMQSRIFDPAPPGSRKVVLATNIAETSITIDGVYYVVDPGFVKINAYDSKLGMDSLQIAPISQAQATQRAGRAGRTGPGKCYRLYTENSFHNEMLTNTVPEIQRQNLSHTILMLKAMGINDLLNFDFMDPPPHNTLLSALNDLHHLSAIDGEGLLTKLGRNMADFPMEPAMAKVLLNSVDHNCAEEILTIVAMLSVQSVFFRPKNMAEKADAKRKKFMDPTGDHLTMLNVYNAWKRNNCSKMWTNENFIQDRSMRRAQDVRNQLVSIMGRYKHRISSCGASTDIVRKVLCSGYFKNSAEKDPQQGYKTLIERTPVFMHPSSALFSKPSQYVIYHTLLLTSKEYMHCVTSIDAKWLPWAAPTFFSFADTSKLSKEKKSKKIVPLYDRYAQDQDSWRLSSARRMPEKDANIFG

SEQ ID NO: 9127 - protein, 212 aa, Salmonella enterica
MSLFDKKHLVTQADALPGRNTPMPIATLHAVNEHSMTNVPAGMEIAYFAMGCFWGVERLFWQLPGVYSTAAGYAGGYTPNPTYREVCSGQTGHAEAVRIVYDPAVIRYEQLLQTFWENHDPTQGMQQGNDHGTQYRSAIYPLTPEQNAAAHASRERFQSAMAAAGDHRPITTEIAHATPFYYAEDEHQQYLHKNPYGYCGIGGIGVCLPPDA

SEQ ID NO: 9128 - protein, 304 aa, Unknown
  Nostoc sp. PCC 7119
MTQAKAKHADVPVNLYRPNAPFIGKVISNEPLVKEGGIGIVQHIKFDLTGGNLKYIEGQSIGIIPPGVDKNGEPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 9129 - protein, 97 aa, Zea mays
SSALVLSLATGVSLFLERFVFFNSHREYVSKQVPSHKGNVHFVAAVERPKQLPALEHFFSRPLAFSLGIVFSCASMGQIVPHGFLSASIFGYDACFF

SEQ ID NO: 9130 - protein, 783 aa, Gibberella zeae
MAPKKKIAVMTSGGDSPGMNAAVRAVVRMSLHMGCDAFCVYEGYEGLVQGGDFIRQMQWDDVRGYLGEGGTLIGTARCMAFYERPGRLVAAKNMVLSGIDALIICGGDGSLTGADRFRAEWPSLLEELISTGHLKEEQTTPYKHLNIVGLVGSIDNDLTGTDATIGCYSALARICEMVDYVEATASSHSRAFVVEVMGRHCGWLALMAGVATGADFVFIPERPRENDWQEEMKVVVRRHRALGKRKTIVIVAEGARDNNGTKIGAEEIKDILADKSKGGLALDTRITTLGHVQRGGTAVAYDRMLATLQGVEAVKAVLEATPETETPFIAINENKIVRKPLMQAVAETQELAKAVDAKDFDKAMSLRDAEFADQWNSYMLTTNVMVDDEKLPERERMRIGFINVGAPAGGMNAAVRAAVAYCLSKGHEPLAIHNGFAGFARHHDDKPLGAVRPFDWLEVDGWASKGGSEIGTNRELPAESGMELIANLIEEHNFDALFIVGGFEAFHSVTQMRKARTQFPSLCIPMCLLPATISNNVPGTEYSLGSDTCLNELVNYCDKIKQSASATRRRVFVIETQGGRSGYIATLAGLDVGASAVYIPEEGISLEMLNSDVNHLKEVFRKDKGQTRAGRLILVNEKASKVYSAKLIADIIREEAHDRFESRESIPGHVQQGGVPSPMDRCRAVRLAIKCIQHLEGYGRNAHNHVKKDPKSASVIGIQGSEVVFSGVEDLEENGTDWPNRRPKTAHWMGLSETVDMLAGRPSYPVPEKSLTGLIAKDTKRGL

SEQ ID NO: 9131 - protein, 291 aa, Pyrobaculum aerophilum
MSKVPGPIVLMEPLSGKTSLIIKINAIHVSKRSKYQGILIVDTDDYGRTLVLDDYIQSSYYDEIYYHESLVHPAVTTHPRPSDVLILGGGEGATLREVLKHNTVKRAVMVDIDGDVVELSKKYLPQMHQGAFDDPRSEVRIEDGFVYVENALKRGEKFDVVIMDLTDPYSSDIAKQLYTPEFFGKVKRLLREDGIVVTQAGNSFYFPEAYDYVLQGVKGNFPIIAEYSVWIPSFGYAVNFVLGSLKHDPHSLSAEEVDKRLSERGVRAEFYSGKTHIALMNMPVIKKILRV

SEQ ID NO: 9132 - protein, 655 aa, Burkholderia cepacia
MCGIDGFLNSVACDEETARGTLARMTASLAHRGPDGQGIWVDPEAGIALGHRRLAIVDLSVHGRQPMASACGRYVMVFNGEIYNHRELRAELERAGRAPAWRGHSDSEVLIAAIVAWGVDATLRRATGMFAFALWNRASRVLTLARDRIGEKPLYYGRIGDALVFASELKALRGYPGFDGAIDRDALCLYLRQSSVPAPHTIYRGIHKLPPGTYIQFEHARDTPRLRAYWTLEQVIEDGRAQPFEGSADDAVGQLDAVLRQAVARQMEADVPLGAFLSGGIDSSTIVALMQAQSSTPVDTFTIGFHEAGYDEAGYAKAVARHLGTRHTELYVTADHALGVVPKLPSIYDEPFSDASQIPTFLVSELTRRHVKVSLSGDGGDELFGGYTRYFLTPRLWRKLHRVPGAVRARIAAALHALRPDHADQLAAVAQGAWGGVEARESAARIGDRLHKLGHVMTAESRIGLYRLLMSSVHHPERLALSGQEPATPLDTVSAWPAHLSFAEQAMAIDTLTYLPTDILAKVDRAAMAVSLETRMPFLDHHVVEFAWRVPAHVRLPEGQSKALLRRLLDRYVPSALIDRPKQGFCAPVDHWLRGALRDWAEALLRPSRLREEGYFDADAVERLWRQHVTGRMNWQHQLWTVLMFQAWLEAQRAA

SEQ ID NO: 9133 - protein, 378 aa, Cucurbita maxima
MHVVTSTPEARHDGAPLVFDASVLRHQHNIPKQFIWPDEEKPAATCPELEVPLIDLSGFLSGEKDAAAEAVRLVGEACEKHGFFLVVNHGVDRKLIGEAHKYMDEFFELPLSQKQSAQRKAGEHCGYASSFTGRFSSKLPWKETLSFRFAADESLNNLVLHYLNDKLGDQFAKFGRVYQDYCEAMSGLSLGIMELLGKSLGVEEQCFKNFFKDNDSIMRLNFYPPCQKPHLTLGTGPHCDPTSLTILHQDQVGGLQVFVDNQWRLITPNFDAFVVNIGDTFMALSNGRYKSCLHRAVVNSERTRKSLAFFLCPRNDKVVRPPRELVDTQNPRRYPDFTWSMLLRFTQTHYRADMKTLEAFSAWLQQEQQEQQEQQFNI

SEQ ID NO: 9134 - protein, 103 aa, Coccidioides immitis
MTGRGKGGKGLGKGGAKRHRKILRDNIQGITKPAIRRLARRGGVKRISAMIYEETRTVLKSFLESVIRDAVTYTEHAKRKTVTSLDVVYALKRQGRTLYGFGG

SEQ ID NO: 9135 - protein, 253 aa, Methanocaldococcus jannaschii
MPKNINISGEIMTGKVILVGAGPGDPELITIKGLKAIKEADVVVYDDLISKELLNYAKKDAELIYVGKRKGKHSFKQEEINKILVEKAKEGKLVVRLKGGDPFVFGRGGEEILELKKHNIPYEVIPGITSAIAVPEVAGIPVTHRKVATSFTVVTGHEAEDKKEKQVDLSKLNADTIVILMGITNLENLVKELLQNPKRSKETPVAIIMEGTTKNQRVIKGTLGDIVEKAKKENARPPGVIVVGEVVNVLDSQ

SEQ ID NO: 9136 - protein, 304 aa, Ralstonia pickettii
MTRQMILAVGQQGPIARAETREQVVVRLLYMLTKAASRGANFIVFPELALTTFFPRWHFTDEAELDSFYETEMPGPVVRPLFEKAAELGIGFNLGYAELVVEGGVKRRFNTSILVDKSGKIVGKYRKIHLPGHKEYEAYRPFQHLEKRYFEPGDLGFPVYDVDAAKMGMFICNDRRWPEAWRVMGLRGAEIICGGYNTPTHNPPVPQHDHLTSFHHLLSMQAGSYQNGAWSAAAGKVGMEENCMLLGHSCIVAPTGEIVALTTTLEDEVITAAVDLDRCRELREHIFNFKQHRQPQHYGLIAEL

SEQ ID NO: 9137 - protein, 731 aa, Crocosphaera watsonii
MFVMFRREVQLPLGKLVRQTQSLLPEEKRPKLVQWDEMYQLEKLIISLGDYFQELQYLQEEIAEQKASEKALEELNLAKSEFLSMMGHEIRTPLNAVTGMTGLLLDTELSDQQKEFVNIIRNSGENLLTMINNILDFSKIEANKLELEEAPFELGLCIEEVLRLFVSQASQKKLELAYLLEPNTPSGIVGDSTRLKQILANLIGNAVKFTPEGEVVIYVSSTVIEGGEGEVNPNYELRFAVKDTGIGIPKERCHRLFQPFSQVDASTTRQYGGTGLGLVISKRLSELMGGKMWVHSEEGKGSTFNFTLRAKAATSSSPVTSQEGESELMGKRVLIIDDNLTSQKILINQAQSWGMFTCAVDSGEKALEWLKRGITFDVAILDMNLPDMNGLELVREIRKQPNCTRLPLIMLSAITETEKTFQSSEEEFVAVLCKPVQRSQLYNVLMEIFSEIPRAPIRVTQSQSVQCSEKSLMGQTHPLKILVAEDVVVNQQVIHLLLEKLGYCADIVSDGQEVLEALKNFAYDVVLMDIRMPEMDGLTATDHICQNYAPDKRPRIIAMTAESMEGDRERFIAGGMDDYICKPVRIKELQEALSRCQPRSESLAIEPKMFNQLRNIAGKRTNEIIKGYLQDTALRIETMNKAIEKRDTEQLYQAAHALRSPSGNLGATNLYYLCKEMETIAREGSLEEASERILGITIEYDRVYYALKKELMREPIPEPIPEPMVKFGGIS

SEQ ID NO: 9138 - protein, 440 aa, Prochlorococcus marinus
MDNKQINFFKSKDLNTVLKPFKKGSVVKIDSFDIRENQNELNIGLFGWYAICPSKELKINTLHYFSLYDEPLILYRDENENVRCIKNICPHRGASFYGGTLSNGVITCPYHGAKFSPEGSCQNLDRITCSHIVDNNYDNYAKKIHLSQYKALEKDEYIFVHFTKKSETDLNNISEDLPISNYELSNNGFSHDDYVSEEVLVDFKCDWSRIIENHLDILHLFWVHGDTIPDKDVNKNVLVSFKQKINITPKYIESIYFYKNNPSKEFIRIKYIAPGRILIYKGNPSESRYLQVLDHIPLGNNKARVIVRHYRKFLKNKLLNNLILFKETQRKIFYKIFNEDYMILKTQTYNHKYGFIKKDEIKLLGEDRIINYFWKWYKKSEEKDSPWKNINKTENLTVYDNVILKYPPEIKNLEVINNIDIIRKTLVRFAAPLLIFMLII

SEQ ID NO: 9139 - protein, 101 aa, Rubrobacter xylanophilus
MQSGTPESGEAGLSESHRVTFKKSGVTIEVAEDEYILEKAEEAGLDLPYDCRSGTCTTCMQRCLEGEVDQDLAFAISEEELEEGYRLICIGSPLSDVVLDA

SEQ ID NO: 9140 - protein, 323 aa, Mycoplasma pulmonis
MKIAIIGTGAYGSALANVLLKNNNQVSFYGIDEGEINDLKMGLNTKYFGQKKLFKLPYLVTNDLKQATQDCDFLILSTPSKFVESVVDKLIEIWPNKNLNILNISKGLNPSSEEIFSEFFQRKYQGQINSYASLIGPSFADEVFNGDFTIVNVSGKDLKFLEQVKTSFDQKNFKVFISPFQREIEYYSIFKNIYAIASGILSAVFKNYNALCSALVIAFQEINQFIISKYGQNPGMIEIASLGDFMLTCTSNKSRNFSFGFLVGQNGIDKAVEINKKTVEGYDNIKIMVKVLKEQLNEYPFLKSIQEVLLQKKKPELILDFLD

SEQ ID NO: 9141 - protein, 182 aa, Dechloromonas aromatica
MDLQKAQAMLANAELIHDEAIVQAAVAEVAQAIRERLADKYPLVLCVMTGGVVFCGQLLTKLDFPLDFDYLHATRYGPETQGGKISWRSAPWTSVKGRSVLVVDDILDEGVTLAAVKESLRRMGAEEVLTAVFADKLNGKEKPVAADFIGLTVPDRFVFGYGMDAGGVWRNLPAIYAMKDDA

SEQ ID NO: 9142 - protein, 232 aa, Zingiber officinale
YHPNIVKLRAAYEDADAVHLVMELCEGGELFDRIVARGHYSERSAAAVLRTVAEVVRMCHANGVMHRDLKPENFLYANKKENSPLKAIDFGLSVFFRPGERFSEIVGSPYYMAPEVLKRNYGPEIDIWSAGVILFILLCGVPPFWAETEQGVVRAILRGMIDFQREPWPPISESAKSLLKQMLNPDPRRRLTAQQVLEHPWLQNAKKASNVPWGDIVRARLKQFSVMNRFKK

SEQ ID NO: 9143 - protein, 344 aa, Anisodus tanguticus
MATLVSNWSSNNVSESFIAPLDKRAEKEVPLGNDVPIIDLQQDHHFVVQQITKACKDFGLFQVINHGFPEKLMVETMEVCKEFFALPAEENEKLQPKGKPAKFELPLEQKAKLYIEGEQLSNEEFFYWKDTLAHGCHPLDEELINSWPEKPATYREVAAKYSVEARKLTMRMLDYICEGLGLKLGYFDNELSQIQMMLTNYYPPCPDPSSTLGSGGHYDGNLITLLQQDLPGLQQLIVKDDNWIAVEPIPTAFVINLGLTLKVITNEKFEGSIHRVVTDPTRDRVSIATLIGPDYSCTIEPAKELLSQDNPPLYKPYPYAEFAEIYLSDKSGYDAGVKPYKINA

SEQ ID NO: 9144 - protein, 580 aa, Burkholderia xenovorans
MRMQIGAFLARRLTEAGVRHLFGVPGDFNLSFLEQIQEADGIEFVGNCNELNAAYAADGYARTSGIAALVTTFGVGDLGAIGGIAGAYAENVPVVHITGTPPLHAVNSRALVHHTLVNGDYDNIGRCMSEFTVAQTRITPANAAFEIDRVLRSCWLERRPVHLQLPSDVTHVVVEVPEAPLMLADPSSDPHQLREATRRIVEALASARFPAIVVDADADRFGVTELVQKLAEKCSIPCASLTPAKSALNETSRHYVGTYVGAASAEPVRSIVENADCLIGVGLRFTDTSTALFSQHFNPEAFIDLRRHDLSLGTTQIPGVTLRDVLARVVDDAQPVVRERATQALAAASDALPASSGNVPLTHAALWPRIRRFLKPRDVILGEAGTSHASLSAMKLPPGATYIAQPIWGAIGYTLPALFGSLVGTPSRRHLLFIGDGSFQLTAQELSSILRRDLKPVIFLLNNSGYTIERLILGEHSAYNDVANWHYAGLPHAFDRRERALSLVVETVADLEAALNRAESAEHLVFIELKLPMMDAPESLKKFADIFADFDYGERGPRNPSKLVASEAPAHGHSLTDETA

SEQ ID NO: 9145 - protein, 519 aa, Helicobacter pylori
MLLIVFFKFYFQYSIKKKSFYFIFVIIQAIFIFNLRRCRMDNQKITHQNITQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFADIPIHYWVILCIALVFLLNFFSVKIFAEGEFFFSLIKVLAVIAFIGIGAIGIIYQIYSHGFGSIFDNFHFGDKGFFPNGSAAVFSAMLAVIFAFTGTEVIGVAVGETKNASEVMPKAIKATLWRIVFFFLGSVFVISVFLPMNDSSITQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSVSQYSFRKQYLKAGHSLEDLPYKAPFLPFLQLIGITGCAIGVIGSAMDKDQRIGMILTIVFAVICYIGYYFTQKANENNKKDLI

SEQ ID NO: 9146 - protein, 379 aa, Unknown
  Azoarcus sp. EbN1
MNAPLVIVGTGAAGYALLRALRQIDRDRPLVLITRDDGAAYEKFHLARALGARTRPRGLVLATVEQMAHRYGATILAHRHILRIDRLRHELVMREGRHGYGQLVLATGAAALREPGLRGTAASQALTLGSLADYAYLRSELAGRNRVVVLGGGLAGCELADNLARSSCHVTLLEPANQLLAETLPALSAARVAQALQAAGVQVMTEDGIQRIDQGPDELELTTLAGVRFPADLLVLARGVVPRTELARDAGLAVARGIVVDPALGTVDPDIFALGECAEIDGRLFRLAEEIEAGAQVLAEVLCGRKRRMRWPARLRRLQIESCPVTVCEPPPLAGEWHEAATQRGVRAVFRDRRGALRGFALLGDQVAAAERLLGELGR

SEQ ID NO: 9147 - protein, 319 aa, Clostridium tetani
MRKIAVLTSGGDAPGMNAAIRAVVRTGLDKGITVLGIERGFDGLLNGEIFEMTRRSVADIIQRGGTILRTARSEEFKTEEGQKKATDILRVFGVEGLVVIGGDGSFQGAKSLSELGVKTIGIPGTIDNDLAYTDYTIGFDTAVNTVLDAINKLRDTSTSHGRASVVEVMGRNCGDIALYAGLAGGAESIIVPELRFDIDKLCKTILEGKKNGKMHNLIIVAEGAGKANDIAKTIEKVTGVGTRATVLGHIQRGGSPTANDRILASRMGNRAVELLLEEKSSRVVGINDNRIVDMDIHEALSIEGKFDEKLYEIAKALSY

SEQ ID NO: 9148 - protein, 508 aa, Chromobacterium violaceum
MSKKQDAPELRRSLQARHLSMIAIGGSIGTGLFLASGATISGAGAGGALLAYALVGLMVYFLMTSLGEMAAFMPVSGSFQAYGSRFVDPAFGFAQGWNYWYNWAITVAVELAAAAIIMNYWYPGIPGVVWSGGFLAIIFALNYFSVKGFGEAEFWCSMLKVATIIAFIVIGFLMILGIMTEPNPSRIAPGLQVMMQGEGPFVGGLAAFVGVAMVVGFSFQGTELIGVAAGESANPGRTIPRAVRQIFWRILMFYMLSILIIGLILPHNDPSLLKNDMKDVGASPFTLVFNRAGLAFAASLMNAVILSAILSAGNSGMYASTRMLYAMAKNGMAPKVFGKLTDNGVPRNALYATTLVACLCFLTSLFQSNAVYMWLLNSSGMTGFIAWLGVAISHYRFRRAYVKQGYSLDDLPYKAKWFPLGPLFAFALCLLIMLGQNYTAFTAAKVDWNGVIATYLGIPLFLALWWGYRVKHNTRMVPLEKVELAEAHRNALMQREENRGGKPAAAQA

SEQ ID NO: 9149 - protein, 181 aa, Arabidopsis thaliana
MALEKHIEKVLFSDEVIAHRVNQLGIDITSDFSGDSEETPIFVGVATGACLFLADLVRRIDLPIAIDFIRAESYGSGTVSSGVPRVSFDLKLDITNKHVVLVEDIVDTGNTLSCLIEHMKAKKASSVSVCTLLDKPSRRKVHYKLVGKGKFYSGFECPDEFVVGYGMDFAEQYRNLSYIGV

SEQ ID NO: 9150 - protein, 358 aa, Solanum abutiloides
WDTSVAIEVKVGDSIEIVRFFHCYKRGVDRVFVDHPMFLEKVWGKTGSKIYGPKAGKDYLDNELRFSLLCQAALEAPRVLNLNCSKYFSGPYGENVLFIANDWHTALIPCYLKSMYQSRGIYLNAKVAFCIHNIVYQGRFAFSDFPLLNLPDEFRGSFDFIDGHEKPVKGRKINWMKAGILESHRVVTVSPYYAQELVSAVDKGVELDNVLRKTSITGIVNGMDTQEWNPATDKYTDVKYDITTVMDAKPLLKESLQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLI

SEQ ID NO: 9151 - protein, 303 aa, Streptococcus pneumoniae
MYDTIIIGAGPAGMTAALYAARSNLKVALIEGGLPGGQMNNTSDIENYPGYANISGPELAEKMFEPLENLGVEHIYGYVENVEDHGDFKKVMTDDQTYETRTVIVATGSKHRPLGVPGEEELNSRGVSYCAVCDGAFFRDQDLLVVGGGDSAVEEALFLTRFAKTVTIVHRRDQLRAQKVLQDRAFANEKISFIWDSVVREIKGENRVESVVFENVKTGQVTEQAFGGVFIYVGLDPLSDFVKELNIQDQAGWIVTDNHMKTAVDGIFAVGDVRLKDLRQVTTAVGDGAIAGQEAYKFITEHS

SEQ ID NO: 9152 - protein, 405 aa, Rhizobium leguminosarum
MTDRLVIIGAGQAGFALAAKLRALKDTRPITLIGAEDVAPYQRPPLSKKYLLGEMAFDRLLFRAEHWYADNDVDLRLSTWAEQIKPDSKQVLLQDGSVLDYGTLALATGSTPRRLPAAIGGDLEGVYVARDKRDADLLADEMRPGRRVLIIGGGYIGLEAAAVARHRGLEVTVIEMADRILQRVAAKETADIMRVIHEAHDVVIREKTGLKHLIGKDGRVTGAALSDGSVIDIDFAVVGIGVAPNDQLAKEAGLEVANGIVVDEFARTSDPAIFAAGDCAALPWQGGRIRLESVQNAVDQAEAAAAVIAGGSEPYDPKPWFWSDQYDVKLQIAGFNLGYDETLLRPGTREGAHSVWYFREGRLIAVDAINDAKAYVTGKKLLESGTNPDKSILADPSADLKSLLG

SEQ ID NO: 9153 - protein, 413 aa, Triticum aestivum
MAAAAGGATTSTRRGPGGGGRPMDDENLTFETSAGVEVVGSFDAMGIREDLLRGIYGYGFEKPSAIQQRAVIPIITGRDVIAQAQSGTGKTSMISLSVCQVIETNVHEVQALILSPTRELATQTERVMQAVGNFMSVSVHACVGGKSIGEDIRKLESGVHVVSGTPGRVCDMIKRRTLRTRAIKLLVLDEADEMLSRGFKDQIYDVYRYLPPELQVVLISATLPHDILEITSKFMTDPVRILVKRDELTLEGIKQFFVAVEKEEWKFDTLCDLYDTLTITQAVIFCNTKRKVDWLTERMRTNNFTVSAMHGDMPQKERDAIMSEFRGGTTRVLITTDVWARGLDVQQVSLVINYDLPNNRELYIHRIGRSGRFGRKGVAINFVRKDDIRILRDIEQYYSTQIDEMPMNVADLI

SEQ ID NO: 9154 - protein, 303 aa, Unknown
  Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKKMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 9155 - protein, 534 aa, Bacillus cereus
MKNQDQALIFEVSKEGRIGYSLPKLDVEEVKLEDVFESDYIRVEDAELPEVSELDIMRHYTALSNRNHGVDSGFYPLGSCTMKYNPKINESVARFAGFANIHPLQDEKTVQGAMELMYDLQEHLIEITGMDTVTLQPAAGAHGEWTGLMLIRAYHEANGDFNRTKVIVPDSAHGTNPASATVAGFETITVKSNENGLVDLEDLKRVVNEETAALMLTNPNTLGLFEENILEMAEIVHNAGGKLYYDGANLNAVLSQARPGDMGFDVVHLNLHKTFTGPHGGGGPGSGPVGVKADLIPYLPKPILEKTESGYHFNYDRPEAIGRVKPFYGNFGINVRAYTYIRSMGPDGLRAVTEYAVLNANYMMRRLAPFYDLPFDRHCKHEFVLSGRRQKKLGVRTLDIAKRLLDFGYHPPTIYFPLNVEECIMIEPTETESKETLDGFIDKMIQIAKEVEENPEVVQEAPHTTVIKRLDETMAARKTSFTLCKASSCTSLIRITKEELAEVGSFFVWRICPALTDSKLPTQNLAGAKKPGGR

SEQ ID NO: 9156 - protein, 447 aa, Bacillus cereus
MLHRYLPMTEEDKKEMLQTIGVQTIDELFSDIPESVRFKGDLKIKEAKSEPELLKELSQMASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQNLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDALLQKNIIGGYDLGRDYKEHENHMLVAVTELRTKEEIDTLVNEMGAIQ

SEQ ID NO: 9157 - protein, 572 aa, Saccharomyces cerevisiae
MCGIFAAFRHEDVHRYKPKALQLSKRIRHRGPDWSGNAIKNSTIFVHERLAIVGVESGAQPITSSDGEYMLCVNGEIYNHIQLREECADYEFGTLSDCEPIIPMYLKHDIDAPKYLDGMFAWTLYDAKQDRIVAARDPIGITTLYMGRSSASPKTVYFASELKCLTDDCDTITAFPPGHVYDSKTDKITRYFTPDWLDEKRIPSTPIDYMAIRHSLEKAVRKRLMAEVPYGVLLSGGLDSSLIASIAARETAKATNDVEPSTYDSKARHLAGIDDDGKLHTAGWTSLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDREFLQLCMNIDPNEKMIKPKEGRIEKYILRKAFDTTGEPDAKPYLPEEILWRQKEQFSDGVGYSWIDGLKDTAEAVISDEMFASPKAEWGSDIPTTKEAFWYRLKFDALFPQKTVADTVMRWIPKADWGCAEDPSGRYAQIHEKHIE

SEQ ID NO: 9158 - protein, 270 aa, Sorghum bicolor
QLQQQEDDRILGLPGQPNGVAFGMYGGYVTIDDNNGRALYYWFQEADTADPAAAPLVLWLNGGPGCSSIGLGAMQELGAFRVHTNGESLLLNEYAWNKAANILFAESPAGVGFSYSNTSSDLSMGDDKMAQDTYTFLVKWFERFPHYNYREFYIAGESGHFIPQLSQVVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFW

SEQ ID NO: 9159 - protein, 112 aa, Pseudomonas putida
MKLVTAIIKPFKLDDVRESLSEIGVQGITVTEVKGFGRQKGHTELYRGAEYVVDFLPKVKIDVAIDDKDLDRVIEAITKAANTGKIGDGKIFVVNLEQAIRIRTGETDTDAI

SEQ ID NO: 9160 - protein, 415 aa, Bacillus cereus
MNEVLAKGKRAKEVARELVLKSTNQKNEALAMVANQLISETAYILEENKRDIEEGKAKGFSDSLLDRLMLTENRIIDMTEGIKQLIELRDPVGECVSAWERPNGLSIQEMRVPLGVVGMIYEARPNVTVDAATICLKTGNAVILRGSSSAIHSNKAIIAVIHRALKQTSLPQESVQLIEDTTRDSAKQLFTMNDYLDVLIPRGGKQLIDTVVREASVPVLETGAGNCHIFIDETADKQMAFDIIINAKTQRPSVCNAIETIVLHEKWAEQYGSELFSSLKDRGVELRGDQKALAIDSSIVLASEEDWGTEFLSLTLAVKLVSSIEEAIHHINTYGSMHSEAIISENEENVSKFFVSVDAAALYHNASTRFTDGSEFGFGAEIGISTQKLHVRGPMGLPALTSTKYVIRGNGQIRK

SEQ ID NO: 9161 - protein, 66 aa, Mesostigma viride
MEGVITESLPNAMFRVHLDNGFNVLAHISGKIRRNYIRILPGDRVKIELTPYDLTKGRITYRLRKR

SEQ ID NO: 9162 - protein, 254 aa, Gluconobacter oxydans
MTAPFVPAAAHVRRFLKSSAGGAFFLLLASLAGFVLANSPWAAGYRTLTTLPLKFPFLGKRGPDNVAAWVSDGLMTLFFLVVILEIKKEIVSGHLSSLRRVALPLIGAVGGMVVPALTYLLVTWGHPEATSGWAIPVATDAAFTLPIILALGRRVSPGARAWLMALAIFDDVLGIVVIALFYGGSMYWPALLAVVLVTAALIGANRQDQNTLGLWHGRHSALDCASGFRATPDTCWGHHRSVSARRGCKRCCHS

SEQ ID NO: 9163 - protein, 201 aa, Gluconobacter oxydans
MERTGRIRTLWAYGTGGILLWTALLDSGLHPTLAGVITGLCLPAGDAKGAATLDWVSSAVTPLVTWIVLPLFGFMNVGMSAAGMKPDMMLEAVPLGIMLGLMLGKPVGVFGATLLSIRLKVVMLPAGTSTGMLFGLSLLCGIGFTISLFVANLAFSGSDLIAPAKMGIFAGSALSALTGWFWLRFMPQNVTRPSEEGGFPR

SEQ ID NO: 9164 - protein, 791 aa, Aegilops tauschii
MTMMAMAKAPCLCARPSLAARARRPGPGPAPRLRRWRPNATAGKGVGEVCAAVVEAATKAEDEDDDEEEAVAEDRYALGGACRVLAGMPAPLGATALAGGVNFAVYSGGATAAALCLFTPEDLKADRVTEEVSLDPLMNRTGNVWHVFIEGELHDMLYGYRFDGTFAPHCGHYLDISNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVMEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLGDLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLQRFCCLMTKFRKECEGLGLEDFPTAERLQWHGHQPGKPDWSENSRFVAFSMKDERQGEIYVAFNTSHLPAVVELPERAGRRWEPVVDTGKPAPYDFLTDDLPDRALTIHQFSHFLNSNLYPMLSYSSVILVLRPDV

SEQ ID NO: 9165 - protein, 263 aa, Triticum aestivum
MAAAGVSREQRWSLAGATALVTGGSRGIGHAIVEELVGLGARVHTCSENAVELEGCRRRWEEMKLPVTVSVCDVSVRAEREKLMESAKQTFDGKLDILVNNVGRNVAKATVECTAEEYSHLMSTNLESAFHLSQLAHPFLRDASIAGGGSVVNISSVASSLGYSTLALYCISKGGVNQLTRSLAAEWAQDKIRVNSVAPGGINTELQNSVDPKVIENTLLRTPMHRLGEPVEVASMVSFLCMPAASFVTGQVMYVDGGRTISG

SEQ ID NO: 9166 - protein, 791 aa, Triticum aestivum
MTMMAMAKAPCLCARPSLAARARRPGPGPAPRLRRWRPNATAGKGVGEVCAAVVEAATKAEDEDDDEEEAVAEDRYALGGACRVLAGMPAPLGATALAGGVNFAVYSGGATAAALCLFTPEDLKADRVTEEVSLDPLMNRTGNVWHVFIEGELHDMLYGYRFDGTFAPHCGHYLDISNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVMEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLGDLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECDGLGLEDFPTAERLQWHGHQPGKPDWSENSRFVAFSMKDERQGEIYVAFNTSHLPAVVELPERAGRRWEPVVDTGKPAPYDFLTDDLPDRALTIHQFSHFLNSNLYPMLSYSSVILVLRPDV

SEQ ID NO: 9167 - protein, 363 aa, Gluconobacter oxydans
MIPVYPFSAATQPYPRQQWYIAGWSSEITSSPLRRRLLGQDILLLRTSGGDVRALKALCPHRQMPLCAEHQDGERLICPYHGAVFETSGQCVSLPFQKHIPKALDLKSFPVVEQNPFVWIWADLETPADMSRLPDTTSLFSHDTEKLLFGTGTCHVEARSQVVLENLFDQSHISFTHPASLGIRSCEDGPAKACSVLEEPTRLCFHHPLKVFPTPDAMIAFFPKIGSTMGIRSRAELFGVSLVVAAESEIVSCDEKGHVQDSMGQLAFLHGITPETDTTTHYHFAILRDFATGSEDISEQYASRNREVIAEDVRVLNAIEPCLDQIRACDEPNFMTDAEAVHVRRRIERLILEEEHLRTSSAG

SEQ ID NO: 9168 - protein, 313 aa, Zea mays
MDMDFNGDADSFALDFIRYLMLGGDSSIPVPSPVAASSDDVTCPVLPPQLEFQSVSFLPHQQRQGYIDLTTSECVGAAPAAATVVGEAVFRAQEPAPPVMIKFGTEPSSPLATTRQPLTISVPPSSYAWAAVEDYRKYRGVRQRPWGKYAAEIRDPKRRGSRAWLGTYDTPVEAARAYDRAAFRMRGAKAILNFPNEVGTRGADLWAAPTANKRKRQQMVEGEDDPEPEVEVVPMVNKAVKTEAQSSMTTQASSPSPSSTVASTTTGTTGGAGWLPVTPSSGSSEQYWETLLRGLPPLSPLSPHPALGFPLLS

SEQ ID NO: 9169 - protein, 569 aa, Spinacia oleracea
MASMALSLTSSPTYSLSFRSLPSLKPLSKSQPSISLPSLRSNASKSPSLSHKHFLSPPSLLLPHKLKPISASSPTNPPPPPAPVPSPAPVSAPAQVQPWQGASIKPLLASILTGVIIWFIPTPEGVSRNAWQLLAIFLSTIVGIITQPLPLGAVALMGLGASVLTKTLTFSAAFSAFGDPIPWLIALAFFFARGFIKTGLGNRIAYQFVKLFGSSSLGLGYSLVFSEALLAPAIPSVSARAGGIFLPLVKSLCIACGSNVGDGTERKLGAWLMLTCFQTSVISSSMFLTAMAANPLSATLTFNTIGKAIGWMDWAKAAFVPGLVSLIVVPLLLYVVYPPEIKSSPDAPRLAKEKLDKMGPMTKNESIMAVTLLLTVGLWVFGGKLGVDAVTAAILGLSVLLITGVVTWKECLAESVAWDTLTWFAALIAMAGYLNKYGLITWFSENVVKVVGGLGLSWQMSFGVLVLLYFYSHYFFASGAAHIGAMFTAFLSVASALGTPPFLAAIVLSFLSNLMGGLTHYGIGSAPVFYGANYVPLPQWWGYGFLISIVNLIIWLGVGGLWWKAIGLW

SEQ ID NO: 9170 - protein, 488 aa, Neisseria meningitidis
MMKLGFKPIPLAIAAVLCALVLALPVPDGVKPQAWTLLAMFVGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 9171 - protein, 233 aa, Zea mays
MAGDGELKLLGVWTSPFVIRVRVVLNLKSLPYEYVEENLGSKSALLLGSNPVHQSVPVLLHGGRPVNESQVIVQYIDEVWAGAGPSVLPADPYERATARFWAAYVDDKVGSAWTGMLFSCKTEEERAEAVSRAVAALETLEGAFAECSKGKAFFGGDAIGFVDVVLGGYLGWFGAIDKIIGRRLIDPARTPLLARWEEQFRAADAAKGVVPDDADKMLEFLPTVLAWVAAKAK

SEQ ID NO: 9172 - protein, 248 aa, Dechloromonas aromatica
MSVTMREMLEAGVHFGHQTRFWSPKMAPYIFGARNKIHIVNLEKTLAKYNEAMAFVKKLASSRGTILFVGTKRQAREIIGEEALRAGAPFVDQRWLGGMLTNFKTVKTSIKRLKDMEVAVEAGELEKMPKKEALTFRRELEKLQKSIGGIKEMAGLPDAIFVIDVGYHKIAITEAEKLGIPVIGVVDTNHSPDGVAYVIPGNDDSSRAIQLYARGVADAILEGRSQVVQDIVAAGGDDEFVEVQDAAQ

SEQ ID NO: 9173 - protein, 475 aa, Zea mays
MSAAMPPAMDPAAAGEMAREAAAWCSLHGLVVGDRADQRSATVPGVGLVHAPFSLLPAHFPESFWRQACELAPVFNELVDRVSMDGNFLQNALSKTRQVDDFTSRLLEIHRKMMEINKEENIRLGLHRSDYMLDSETSSLLQIELNTISASFPGLGSLVSDLHRSLIKQYGTSLSLEHKRVPANAASTQFSEALAQAWSEFNIDSAVIMMIVQPEERNMYDQYWLSKHLQDSHGITTIRKTLSQVEAEGQVLPDGTLLVGGQKVAVVYFRAGYAPNDYPSEAEWSARLMMEQSSAVKCPSISYHLVGTKKIQQELAKPNVLERFLKSEEIDKVRKCFAGLWSLDDEYIIKTAVEKPELFVLKPQREGGGNNIYGLDLRETLVRLQKEGGDALAAYILMQRIFPKASPAYLVRGGVCHEGLAISELGIYGAYLRNKDKVVINEQCGYLMRTKVSSSDEGGVAAGFAVLDSLYLTGK

SEQ ID NO: 9174 - protein, 385 aa, Oryza sativa
MAGVSAASAAGKIGSFLSKRPYAPPSWASHLSPAPSQTFSLGHFPTPIHKWNLPNLPNGTEVWIKRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTGKMF

SEQ ID NO: 9175 - protein, 1028 aa, Cryptococcus neoformans
MSRVPSGSQQPQYTQQPLYHPSSVHSQSTPIQQTHQQYHPHTGQPMTFQGDAHAYSYDRQSQINTWQANPGAAGSMEYHSAVAGSSRGADPYQPYSQSHRSSPSQSVTASRTQPASAQQYTPWAPVQTSATTPSSRGGGVKLEDLMSSDSRAGGKNQPLSGIPLSVSASFDTRSQFSAGPQGASAEKEKDKERDKATQQQGPSEFIKKLYKMLEEEQAQYGNSRTKKGEKGKRGSVGWGANGTSFVVWDMNDFTTKILPQTFRHSNFSSFVRQLNKYGFSKIWEFQHPNFQAGGKSDLESIKRKPVAPKKANNQEGDENSPRHIGLSNEDQTRMHLMEDRINMLEDALAKSRSEADEARMREMAMMGLVRDMIGHIAASESDNLARAYPPEMYHSNIARQPTTMPYTPAQPQSHQSFLNAAYNPAFSGNSVGGAVQAQASPHTDGTGSRGSFSGPSTGEIKPPASSSRLRAASNAGAAPSGSVNASVPLASQPSGNPPAGPVARAEDPAEDVIEIPNQMQDMYGGESVGIAPLFVETPAWLTEGTTVPLTMYRKQSDGQVLKAVYQAFAAGGKLPAGEGQDEDGNAIASGSSTSAAEIMAGSSQMGLQQSYGAGSSTSTGIPLPMDGSPSSESSSRKGKGKKSRGTSLKEQRESKLKPHWAQTPRILVVEDDIVYRTLSKKFLQKFGCETETVENAQGAVDKMNGTKYDLVLMDIFFGPNMDGRKATSLIRQFNNYTPIISMTSNAQPQDVDSYYQSGMNDILAKPFTKNHLFTILDKHLVHLRHAQLYERLIPLGVGVPPLSDQHVQEALAVSAANLQNTNGQLQLENGPTAETQNEQQDSNGELELGIRNPLAGSGWSDEAYQLVLAQFLQTGVMPDITTISAVSSSPNPNGIDGTIGTSIVFGESSGFSRKRSIEAISDDNWDGQAQTSASVQAQAQAQAQAQAQAQAQAQAQAQAQAQAQTQAQAQNTIMQGDQQQGMSLQMPMNVGMGMEVNMGNMPESGMMNQDISNGSDGREAKRARGMAG

SEQ ID NO: 9176 - protein, 121 aa, Zingiber officinale
LSPMASSSATMVVSCARSSSGMVAPFSGLKSLSGVPFPTKRANAHLSHLPSNGCRVRCMQVWPIEGKKKFETLSYLPTLKDEALLKQIEYLLRSNWIPCLEFCKRGFVWRRTTKVLMAENT

SEQ ID NO: 9177 - protein, 362 aa, Solanum acerifolium
WDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRRIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9178 - protein, 343 aa, Unknown
  Mycobacterium sp. JLS
MSSDRERRSPHRRRRPTMAHVLPVLDLTDADTDPAGFRARLREAAHDAGFFYLVGHGVPVEGFERVLRLARDFFTQPPERKNEISQLLSPQFRGYSRLGGELTNGTVDWREQIDIGPERDVIEGAEGYWRLQGPNLWPAQPPGFRAAFEEWGAALSEVGVRLLRHWAVSLGAAEDTFDAAFADRPATLMKVVRYPGTTQTAQGVGAHKDSGVLTLLLVEPGSVGLQVESGPDEWIDVPPLPGAFIVNIGELLEVATGGYLRATRHRVLAPPPGTDRISIPFFLNPALDALIPILPLPPELAVRSRGVETDPDNPIFNTYGENAWKSRTRAHPDVAELHHGITR

SEQ ID NO: 9179 - protein, 142 aa, Coffea arabica
RRHNSATPEEQIKMVENCGFPSLDSLIDATVPKSIRLDGMTFSKFDEGLTEAQMIDHMQKLASKNKVFKSYIGMGYYNTFVPPVILRNLLENPAWYTQYTPYQAEISQGRLESLLNYQTMIADLTGLPMSNASLLDEGTAAA

SEQ ID NO: 9180 - protein, 253 aa, Oceanicola granulosus
MSRVGLVTGAGTGIGAATARRLAQDCGTLVLCGLGAVELEAVAEEVRALGAAARAVALDVTDSAGRSELFARIGRDHGRLDLLVNNAALIGAPALADHLDETEAHFERVLAVNLTAAFFMCQGAARLMQRAGGGAIVNVSSVGGSAAQYRAAAYCASKAGLDSLTRTLALDWASLGIRVNAVAPGDIRTARTEGLKAAMSGGAVPENPWFRDTPLGRPGTPEEMAEVIAFLASPAASFVTGEVVRADGGFLIY

SEQ ID NO: 9181 - protein, 413 aa, Cryptococcus neoformans
MSAPEVFQLSFGPLTGVAFSPDRTHVAVSPNNNEVHIYQRQGAEWIHKDTLAEHDKLITAISWAPNSNRIVTCSQDRNAYVWTPTESGWKPALVLLRINRAATCVKWSPNEDKFAVGSGARTIAVCYFDEENNWWVSKHVKKPLRSTVLSIDWHPNNVLLAAGTAEAKAYVFSAYIKGVDSKPEPTVWGERLPFGTICGEFISPDGGWVHSVAFSPSGNILAYVSHDSSLSIVYPSGPGAPPAAHFALRLPSLPFVDLTFTSESALIAAGHDCQPIVFTGSESGWVLSHSLDDPSSGGSRPLTPTATGSRSGGVGRLGNNEAFNMFKAADSRGQRGVPAPGATPTSAGLTPVGADGLLTTVHQNTITWVEPYEWGQGGEVTKVGTAGKDGRLVVWPVTAAKSGLAGRMAGLSV

SEQ ID NO: 9182 - protein, 362 aa, Solanum aculeatissimum
WDTSVAVEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYSNKAKGVAKFNVPLAHMITAGADFMLVPSRFEPCGLIQLHA

SEQ ID NO: 9183 - protein, 465 aa, Unknown
  uncultured bacterium 463
MSEFTTVVAALKGELAVGSQVMVKGWLRSKRDSKAGISFLAVHDGTAFDAIQAVVPSDLDNYESEVLKLSTGCAVVICGELVESQGKGQSVEIQATEVEVVGWVDDAETYPIAKKRHTFEYLRTQAHLRPRTNTFGAITRVRTTLANAIHNYFHDNDFNWINTPILTGSDCEGAGELFRVSTLDFANLPLDGKGGVNFEEDFFAGESFLTVSGQLEVESYCLAMSKVYTFGPTFRAENSNTSRHLAEFWMVEPEIAFADLNDDADLAESLLKHVFTRILEEREDDMAFFQQRIDKTVIDRLRAVIDNNFERMDYSEAITILKNSGKKFEYPVEWGVDMASEHERFLAEEHVGRPVVVMNYPKDIKAFYMRLNDDEKTVAAMDVLAPGIGEIIGGSQREERLDVLDARMDEHLREELWWYRDLRRYGTVPHAGFGLGFERLLNYVTGMENVRDAIPFPRTPGNADF

SEQ ID NO: 9184 - protein, 456 aa, Unknown
  Photobacterium sp. SKA34
MTALTLTIKQWILNRNSLIILADILLFLTLLNTLPFEANVTLGLSILSFIAVLWLTEALHVSVTAILVPLLAVFFGVFQTQQALANFSNPIIFLFLGGFALAAALHKQQLDQVIADKVLIAAKGKMSIAVLMLFGVTAGLSMWISNTATTAMMLPLVLGVLNKVNSKTGHNTYVFTLLGIAYCASIGGIATIVGSPPNAIAAAEAGLNFTEWMYFGVPVTLFLLPLTVGLLYVLLKPNLNHTFEIDHTPVSWTKGKLLTLAIFLLTVSCWIFSKPINAFLGGFAKFDTLIALSAIVLLCVSRVVSWKDIQKSTDWGVLILFGGGICLSNILKATGTSVFLAQELSTFLNQAGLFLTILVVAIFVVFLTEFASNTASAALLIPVFATVAEALGVSPVVLSALIAIAASCAFMLPVATPPNAIVFSTGFIKQQEMMRVGIYLNILCITFLTMFTWLFW

SEQ ID NO: 9185 - protein, 309 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRTASGGGGVVVVTALSPTGSDVSEQSQSSGSVLPVSSSCHVFKPTARAGGVVIESSSSEEEEKDPMTCLSLSLPWVNESTTPVELFPVKREEEEEKEREISGLGGDFMTVVQEMIKTEVRSYMADLQLGNGGGAGGGASSCMVQGTNGRNVGFREFIGLGRIE

SEQ ID NO: 9186 - protein, 314 aa, Unknown
  uncultured bacterium 463
MSDFGSGTSTSEVIEGVDLKGKCALVTGASSGLGVETSRSLASAGAAVIMVARDASKLDTAVAQVRAAVPDAQLDTALLDLADLESVRAGAQTILAKCPSIQLLINNAGVMACPLMRTAQGFEMQLGTNHVGHFLLTCMLAPALVAGAPARVVNLSSAGHRFSAMDLDDPNYHRRDYEKWQAYGQSKTANALFSVGLDQRLQGQGVRSFAVHPGMIMTELSRHMDPSDMEIILAGRNIEDIGFKTVEQGSATSVWAATSQDLDGLGGLYLEDCHIAEPATPDNEAGIESYALDPVTADKLWQLSEDMVGENFNF

SEQ ID NO: 9187 - protein, 237 aa, Marchantia polymorpha
MYNSNLLVIQKLLSTNAYLGHRIPTSDFQGYLYGFRNEMAIIDLEKTLICLRRTCNLIGSIISAKGHLLLVNTNPEYNKIIQQMAKKTNQSYINHKWIGGFLTNWKHMKKVKKHFQDFSAHPNLKDAFTSSPFDYFPRFKKMQKCFEGIMTHNIPDCLVIINANQNSMAILEANQLQIPIVALVDSNIPNRLHKLITYPVPVNDDSIKFVYLFCNLITKTVILSKRSQRPKVKVKRL

SEQ ID NO: 9188 - protein, 360 aa, Solanum atropurpureum
WDTSVAIEVKIGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRRIPLIGFIGRLEEQKGSDILVAAIHQFIGLDVQIVVLGTGKKKFEQEIEQLEVLYPNKAKGVAKFNVPLAHMITAGADFMLVPSRFEPCGLIQL

SEQ ID NO: 9189 - protein, 76 aa, Oryza sativa
  misc_feature (19)..(19): Xaa can be any naturally occurring amino acid
DEIVVSKDQVEAVVYKIIXKARTREIGDGKIFLIPVSDVIRIRTRRTKGSERRRMGPRGWPGTKLVPSSQMPEFFN

SEQ ID NO: 9190 - protein, 112 aa, Neisseria gonorrhoeae
MKKIEAIVKPFKLDDVREALTEIGITGMTVSEVKGFGRQKGHTEIYRGAEYAVDFLPKVKIELVLADDAVERAIDVIVEVARSGKIGDGKIFVLPVEEAIRIRTGERSDAAV

SEQ ID NO: 9191 - protein, 113 aa, Chlorobium tepidum
MKLITAIIQPDRLDHVREALIQADITRITVSRVSGHGRQEDIEYYRGQKIAPNLLPKVRLDIAVNDQFVNVTVDTIVAAARHESGEIGDGKIFITPLEECVRIRTNERGGSAI

SEQ ID NO: 9192 - protein, 362 aa, Solanum aviculare
WDTSVAVEVKVGDSIEIVRFFHCYKRGVDRVFVDHPMFLEKVWGKTGSKIYGPKAGRDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9193 - protein, 265 aa, Yarrowia lipolytica
MAMHRVAPDIPLWVGSIYSLSAHISFEKYNINHIISMVRGELPGNQIQGYTHLHVEMDDDEEENIMQYFPETNKFIEDACGEWMTKVAESGKYKNYPENVESVHLEYPHNPDPPGVLVHCMAGISRSSTIVIAYLMKKLGLTAEQGLALVKKGRKIANPNPSFVEQLKIYEQCGYEIDDSKPLYRQWILKKDSEGIPNIGSTPKFKYRSETEGLTSRGQGFSADFRRQIRPKMNQSGAVEDATEATPEQTAPSMKTSLLRCRMCR

SEQ ID NO: 9194 - protein, 400 aa, Hordeum vulgare
VDRVSLDGDFLQDSLSKTRQVDDFTSRLLDIHRKMMDANKEENIRLGLHRSDYMLDSETNSLLQIELNTISVSFPGLCSPVAELHRTLINQYGKLLCLDAKRVSLEMRRSRQFPLKTLAKAWDEFNVDSAVVMMIVQPEERNMYDQYWLVKYLRESHGVTTIRKTLSEVEAEGQVLPDGTLVVNDRKVAVVYFRAGYTPNDYPSEAEWSARLLMEQSSAVKCPSISYHLVGTKKIQQELAKPNVLERFLENKEEISKLRQCFAGLWSLDDEEVVKSAIENPDLFVLKPQREGGGNNIYGLDVREALIRLKKEGGDALSAYILMQRIFPKASLANLVRGGVCHEALTVSELGIYGAYLRNKDKVIINDKCGYLMRTKVSSSDEGGVAAGFAVLDSLYLTDK

SEQ ID NO: 9195 - protein, 239 aa, Rhizobium leguminosarum
MTKAPIAGNRTGRKLGQRVKNKKMKASSRQWLERHINDPYVQRAQLEGYRARAAFKLLEIDEKHHILRGARRIIDLGAAPGSWSQIAAKVTGSTDDDIRVAAIDFLEMTQLPGVKILQLDFLDPSAPEKLLEAVGGTPDLVISDMAAPTTGHHRTDHLRTMHLCEVAAHFAVEVLGEGGHFLTKTFQGGTERELLAMLKQNFRQVVHVKPNSSRAESVEMFLLAKGFKGRKAEGEAEEA

SEQ ID NO: 9196 - protein, 362 aa, Solanum candidum
WDTSVAIEVQVGDSIEIVHFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSRGIYLNAKVAFCIHNIAYQGRFAFSDFPLLNLPDEFRGSFDFIDGHETPVKGRKINWMKAGILESDRVVTVSPYYAQELVSAVDKGVELDNVLRKTSITGIVNGMDTQEWNPATDKYTDIKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9197 - protein, 339 aa, Arabidopsis thaliana
MVHGRLCNRDGWILTAMVVTEFSNVGVNTLVKAATSKGLSPFVVLVYSYTFGSLLLLPLTFFSFRSRSLPPLTFSILCNMGILGLIASAFQILGYNGIKYSSPTLSSAMSNVNPAFTFILAVVFRMENISLGKKSSVAKVLGTILSIIGALVVTLYHGPMLMSSHSDWIIGGGLLALQYILVSVSYLVMAHTMGRYPSAVVVTLVHNVCIAVVCAFVSLLAEKDNPKAWVIRFDITLITVVATGILNSGYYVIHTWAVSHKGPVYLSMFKPLSILIAAVSTFIFLGESLYLGSVMGGILISIGFYMVLWGKAKEDKVDIIGAIESSPSHNAPLLDNFKS

SEQ ID NO: 9198 - protein, 496 aa, Lemna gibba
  misc_feature (305)..(305): Xaa can be any naturally occurring amino acid
  misc_feature (324)..(324): Xaa can be any naturally occurring amino acid
MERGREAAMHREADAGPSSLAIVPAEGQRGSISDAVASSLQQHRVIRWERFLPRRSLRVLLVEPDDSTRHIVTALLRKCSYHVASVADGIKAWDIVKEKNFNFDIILSEVEVPSFSGISLLTKIMGTELSRSIPVIMMSSQDSVSVVFKCMQKGAVDFLVKPVRKNELRNLWQHVWRRHCSTRYPNGAENGANNPSASENMSNNNGAGNEMKDSRMAEGCDDNDDQSSGSNPLIHIESTRTNEARAVEENKPSTEKAEEEEASVASKSKMDTDFRINDFSHPRVKNGFHEKHVLNHSAASASLGXFSTYYPVSVNRLPLLFRYXNTRICLPAHKSRSTLVAQESQSQSQRPELESQERSRNGEAVIRQRQGMIPFPFTVNSPIPFQNFCPGYGPLVQPVFYQDGGVHEESQTPSPGRRPGTESEEQRIEAERSGFDCDPNRSHREAALMKFRLKRKDRCFEKKVRYHSRKMLAEQRPRVKGQFVRQTADPTDAESV

SEQ ID NO: 9199 - protein, 175 aa, Taraxacum officinale
DQFMEAYCEMLIKYEQELSKPFKEAMLFLSRIESQFKAISFSPSDSGCGEGGMDRNGSSEEDLDVDVNNNNLVDPQAEESELKGQLLRKYSGYLGSLKQEFMKKRKKGKLPKEARQQLLDWWTRHYKWPYPSEAQKLALAESTGLDQKQINNWFINQRKRHWKPSEDMQFVVMDA

SEQ ID NO: 9200 - protein, 460 aa, Lemna gibba
MAEEGEEMRIDAAGEEPRVVKWEKFLPRMFLRVLLVEADDSTRKIVAALLRKCGYKVSSASDGLEAWKTLKEKPNDTDLVLTEVELPNVSGYALLSMMMEHETCKSIPVIMMSSNDSMKMVFECMLKGAADFLVKPIRKNELRNLWQHVWRRQSSNRAENVPPVIGAANSEYNSASNHTSDCMDSNNKRRAGSEKGNDTQSSCTRPDREAEISDDLMTDREDISDKLERETQGKDDARETCVKVVESTGGLGQPSSSGEGDFVDSREDQTHHHYGFKRCRVLQPGQILGVDYNPAFKHQLKLDSVCNFRGRIQWRSAQKQGHKLNHSSSSAFSWYSAKSTLSPLPPPTENPDAASSENPNSSSPTSLFYTQPGQPETLKCPDQKTPRPTQDDHSSITYENGAPQSKLRLSIEREAALTKFRLKRKDRCFEKKVRYQSRKKLAEQRPRVKGQFVRQVNSGL

SEQ ID NO: 9201 - protein, 112 aa, Unknown
  delta proteobacterium MLMS-1
MKKVEAIIKPFKLDAVKEAVTALGIHGMTVSEVKGFGRQKGHTEVYRGAEYVVDFVAKIKVEIVVESEKASLLVETITQAARNGNIGDGKIFVTPVESVCRIRTGELDQDAI

SEQ ID NO: 9202 - protein, 175 aa, Oryza sativa
MAPTVMASSATSVAPFQGLKSTAGLPVSRRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 9203 - protein, 293 aa, Oryza sativa
  misc_feature (120)..(120): Xaa can be any naturally occurring amino acid
  misc_feature (261)..(261): Xaa can be any naturally occurring amino acid
  misc_feature (273)..(273): Xaa can be any naturally occurring amino acid
MASSVAAAASTFLGTRLADPAPQSGRIVARFGFGGGKKAAAKKAARPSAPTTDRPLWFPGAVAPDYLDGSLVGDYGFDPFGLGKPAEYLQFELDSLDQNLAKNNAGEIIGTRFETGEVKXSTPFQPYTEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLASDPEKKERLQLAEIKHARLAMVAFLGFAVQGXAATGKGPLNNWXATHLSDPLHTTIFDTFSSSS

SEQ ID NO: 9204 - protein, 220 aa, Zea mays
MGRRPARCYRQIKSKPYPKCRYWRGVPDPKIRIYDVGMKRRGVDEFPYWVHLGSWEKENGSREALEAARIACNKDMTKSAGKDAFHLRVRVHPVHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGKAFLEAVA

SEQ ID NO: 9205 - protein, 338 aa, Kluyveromyces lactis
MFKERLLNILKHIRPMSTETTAKYYPKIVESAQADQSLKLNHTCFRVKDPKVTVAFYQEQFGMKLLDHKKFPDMKFDLYFLSFPNKQFSNNSQGAIDVFRENGILELTHNYGTESDPAYKVNNGNEEPHRGFGHICFSVSNLEAECERLESNGVKFKKRLTDGSQRNIAFALDPNGYWIELIQNNESGEGNNYKFNHTMVRVKDPIKSLEFYQNVLGMKILDVSDHSNAKFTLYFLGYENDQKGIARGSRESILELTHNWGTENDPDFAYHTGNTEPQGYGHICISNKDPATLCAEIEKLYPDIQWSPKFNQGKMKNLAFIKDPDGYSIEVVPYGLGV

SEQ ID NO: 9206 - protein, 158 aa, Schizosaccharomyces pombe
MSHFYDLAPKDKDGNPFPFSNLKGKVVLVVNTASKCGFTPQYKGLEALYQKYKDRGFIILGFPCNQFGNQEPGSDEEIAQFCQKNYGVTFPVLAKINVNGDNVDPVYQFLKSQKKQLGLERIKWNFEKFLVNRQGQVIERYSSISKPEHLENDIESVL

SEQ ID NO: 9207 - protein, 114 aa, Desulfotalea psychrophila
MLMKKIEAIIKPFKLDDVKSALSEVGITGMTISEVRGYGRQKGHSEMYRGAEYVVEFVPKIKLEIVVSADRATEVVAKIREHAYTGKIGDGKIFVSPIEYAVRVRTGEENKEAV

SEQ ID NO: 9208 - protein, 938 aa, Kluyveromyces lactis
MTQSLPLLNGTEAYKLVTTQGLYDKTVKFYEKYLQLVHDKRVGTLTNSLITLKLVVDNSFKPLDVVNDKDWRAIVSSALVFSCTNIQHFRDLAAGETIQAYPNETNPIEIYLKDPNGYIIGITETKNAISIKPTLPKQSVEASLISSRSSRIDIASSGVSTDSSYPAIPKTAKAQKSIAVMTSGGDAPGMNANVRAIVRTAIFKGCNAFVVMEGYEGLVKGGPNYIKQVYWETVRNWSCEGGTNIGTARCKEFREREGRLLGALHLIEAGVDALIVCGGDGSLTGADLFRSEWPSLIRELLDQGRINKVQFDRYQHLNICGTVGSIDNDMSTTDATIGAYSALDRICQAIDYIEATANSHSRAFVVEVMGRNCGWLALLAGISTSADYILIPEKPASSREWQDQMCDIISKHRSRGKRTTIVIVAEGAISADLTPISSKDVHKVLVDRLGLDCRITTLGHVQRGGTAVAYDRILATLQGVEAVNAVLESTPDTPSPLIAINENKITRKPLVESVQLTKSVAEAIHSKDFKKAMQLRDSEFVEHLDNFMAINSADHIEPKLPEHTHMKIAIVNVGAPAGGMNSAVYSMATYCMSQGHKPYAIYNGWTGLTRHESVRSLNWKDLLGWQSRGGSEIGTNRHTPEEADIGLIAYYFQKYGFDGIIIVGGFEAFVSLHQLERARENYTAFRIPMVLIPATLSNNVPGTEYSLGSDTALNSLMQYCDIIKQSAASTRGRVFVVDVQGGNSGYLATHAAVAVGAQVSYVPEEGISLEQLTQDIENLTESFSEAEGRGKFGQLILKSTNASKVLTPEVLAEVITQEAEGHFDAKCAIPGHVQQGGLPSPIDRTRGTRFAIRAVGFIESQHKVLAAEANLDDDDFDFDTPKIIATASVLGVKGSDIVFSSIRQLYDFETELNKRTPKTIHWQSTRTIADHLVGRKKL

SEQ ID NO: 9209 - protein, 152 aa, Zea mays
  misc_feature (52)..(52): Xaa can be any naturally occurring amino acid
  misc_feature (72)..(72): Xaa can be any naturally occurring amino acid
  misc_feature (89)..(89): Xaa can be any naturally occurring amino acid
  misc_feature (112)..(112): Xaa can be any naturally occurring amino acid
  misc_feature (131)..(131): Xaa can be any naturally occurring amino acid
MRLLHDPVSYRSVVMAADAFAIDDDNIFQYLEASPHTFDDLSTIFYTKVYRXEQEWFLYIFGGSENEDALSXRHYELLIQRLCVPPLFXPRGVGHPGLIGGCRHFLPSRRAXERRLHSHAIRFWTQAESTXGASTTNLMCFFRCSAYFLVCV

SEQ ID NO: 9210 - protein, 73 aa, Bacillus subtilis
LGHIQRGGSPSAADRVLASRSRAYAVELLLEGKGGPCVGIQNNKLVDHDIIEILETKHTVEQNMYQLSKELSI

SEQ ID NO: 9211 - protein, 558 aa, Chlamydomonas reinhardtii
MGGADVQAITIAVTTGRDCAMSGDYSAGCTYYENAVELITRYVRTLGDPHAIRQWSALLKEVQDEHSSVRQCDKEARGMRVYDSVARSNSYPEMNDPRGSAAYDDGYRQPIVVCHNSGQEDPMVWRPPTRGEGRSGAPARGAPPPRARSSQDDNKLPSWANNNNGGGGGPPARGNAAGPSGRAGSAPRRPTGNAPAGNAAAGGSYDRPWRQNMQGKQGAAGPGGKPGDKGSAGEKAKKQYSGPDQELAAMLERDIVDQGTSVKWDDIAGLEEAKRVLNEALVLPMIMPDFFTGIRRPVKGVLLFGPPGTGKTMLAKAAATETSCTFFNVSSATLASKYRGESERMVRILFEMARDLAPSMIFIDEVDSLCSQRGTANEHEASRRVKTELLTQVDGVHGSEKDKEPGPDGEPPAPKHVFVLAATNFPWDIDEALRRRLEKRVYIPLPGQAQRLQLLKINLRDVAVAPDVNLEAVAGQMDGYSGDDITNVCRDAAMNGMRRLVAGKTPAEIKALREAGMTGGQEPITSDDFREALRKINPSVSKEDIKRHEEWLSVFGST

SEQ ID NO: 9212 - protein, 438 aa, Schizosaccharomyces pombe
MPPKEDWEKYQKPVDTEEENDKNPPPLDEGDIELLKSYATGPYARELAAIKEDTEAVLKRINDTVGIKESDTGLAPISFWDVAADRQRMSEEQPLQVARCTKIIENEQSAEKNAYVINLKQIAKFVVSLGERVSPTDIEEGMRVGCDRNKYAIQLPLPPKIDPSVTMMQVEEKPDVTYGDVGGCKEQIERLREVVELPLLSPERFVKLGIDPPKGIMLYGPPGTGKTLCARAVANRTDATFIRVIGSELVQKYVGEGARMVRELFEMARTKKACIIFFDEIDAIGGARFDDGAGGDNEVQRTMLELITQLDGFDPRGNIKVLFATNRPNTLDEALMRPGRIDRKVEFGLPDLEGRAHILRIHAKSMAIDKDIRWELIARLCPSQTGAELRSVCTEAGMFAIRARRRVATEKDFLDAVQKVVKGNQKFSSTADYMNMSS

SEQ ID NO: 9213 - protein, 470 aa, Escherichia coli
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 9214 - protein, 493 aa, Agrobacterium tumefaciens
MRDICPMHNEHDFSAAGDRLSTFPAFFRVEGRQVAVFGNGDEAFAKVRLLANTNAHIVAYADHPEADFARYISENSIDHRALAFASPLVDDATLVFAATGDEALDREIVSVARTKKIPANAVDQPEFCDFFTPALVARAPVAIAIGTEGAGPVLAQMIRARIDQMLSPSLGKLARLAVQYRDAAEENVPKGALRRNFWRRFFSGAVADAVALGDTSSARHAADRLLQSPERSEGRVWLVGAGPGAEDLLTLRAQRVLMEADVIVYDALVPQAIVDMGRRDAERLSVGKRKGCHSKSQNDINRLLVRLGLEGKRVVRLKSGDPLVYGRAGEEMAALREAGVAYEIVPGITSAFAAAADFELPLTLRGVASSLIFTTGHDLMGDVLPDWARLAVSGATIAVYMGRSVAASVAKRLIDAGLGVETTVAVIENASRADRRLLHGTLNDLPDLEYRDELIGPVMVIIGDAVAGANFDRSEALALAAKPASLKREYVNG

SEQ ID NO: 9215 - protein, 391 aa, Triticum aestivum
  misc_feature (216)..(216): Xaa can be any naturally occurring amino acid
  misc_feature (221)..(221): Xaa can be any naturally occurring amino acid
  misc_feature (260)..(260): Xaa can be any naturally occurring amino acid
MAVSAIGFEGYEKRLEITFSEAPVFTDPNGRGLRALSRAQIDSVLDLAKCTIVSELSNDKIDSYVLSESSLFIYPYKVVIKTCGYTKLLLAIPRILELAEELSLPLAAVKYSRGTFIFPEAQPSPHKNFSDEVAFLNGYFGGLKSGGNAYVIGDPAKPGQKWHVYYATQQPEQPMVNLEMCMTGLDKKKASVFFKTSADGYTSCAKEMTKLSGISXIIPEXMEICDFDFEPCGYSMKAIHGSAFSTIHVTPGDRFSYASXGVIGVDPASVAYGDMFERVLRSFGPSEFSVAVTIFGGPQPCWHLGGRRLNVGVYDSTNMVVQELPDGGALIYQSFTAVGEDSTGSPRSVLNCNVHGNFRERLPRWMLSFAGEDDAAQEKDERGAGKKMKSS

SEQ ID NO: 9216 - protein, 642 aa, Debaryomyces hansenii
MVRMSSYDDDPIIEIFDNDNSDDIQVINRDNTQYDQNLMNSTGNTPHNYYNDIYDNSQHEHTQQNRQHQPQEQLSSLSSILQLQAETHSNQQEPSGLTPILSSNDYNQLTTVSQPKYTTSLPPLAPLSESVIPNNLNIPPTLSLPKASESQDKKTNTVTTTTKKRKEASSSKTRPAFVMKIWSMVNDPANHDYIRWNDNGKTFQVFHREEFMKLILPKYFKHNNFASFVRQLNMYGWHKVQDISNGTLNKDDKSNDEIWQFENPYFIRGREDLLDKIVRNKTISQESDHLEAGNLNFQSVLNELDQIKVNQFAIGEDLRRVRNDNKTLWQENFLTRERHQQQAQTLEKILKFLAAVYGNSAGKLLEVDNGSIGLDDFNSNNQMTTYNYQQPPQAHNQAPHQPIQVPSMTDQPSQPPSPFNRPRLMLMDQAYQKSPSNNPSPRETAQRNSNSGSIEEIIRSYENTPNDSPNSNVNKIYQQLMNNEPGVSSPRHYFPELNSQNNSYFGVPNTPGQQYIKSGTPLGSSNNTSEVMNGLEQNIFKQGQSIQQVQDWIQKLAAQQQQQQQQQQQLQNLQSLHQNHKQNSDDYEKPDIDEFDVNEFLDNSNASNSQASNSVNSDLNDASSNKRSIDEVNDGNAKRKKQ

SEQ ID NO: 9217 - protein, 135 aa, Ralstonia eutropha
MRLLHTMLRVGDLQRSIDFYTRVLGMQLLRQSDNPEYKYRLAFVGYGPESETAVLELTYNYGVDKYDLGTAYGHIALETDNAAAACDRIRVAGGKVAREAGPVKGGTTVIAFVEDPDGYKIELIERHSTRDASRP

SEQ ID NO: 9218 - protein, 160 aa, Dechloromonas aromatica
MSQTLYDFSAQRLNGEPQDFEAYRGKVLLIVNTASECGFTPQYTGLEELYWMFKDRGFVVLGFPCNQFGGQEPGDAEAIGQFCQTRFDVTFPLFAKVDVNGDSAHPLYTWLKHEAAGVLGTEAIKWNFTKFLIDREGKVVHRYAPATRPDELVEAVEAQL

SEQ ID NO: 9219 - protein, 954 aa, Agrobacterium tumefaciens
MTTPTEFHFTDYQPYDFANRRHIGPSPSEMAEMLKVVGYKSLDALIDATVPSSIRQKVPLTWGAALTEREALDRLRETANKNQVLTSLIGQGYYGTITPPVIQRNILENPAWYTAYTPYQPEISQGRLEALLNYQTMVCDLTGLDVANASLLDEATAAAEAMAMCQRVAKSKATAFFVDANCHPQTIALIETRAAPLGWKVIIGNPFTDLDPVDVFGAIFQYPGTHGHVSDFTGLISRLHQTGAIAAVAADLLALTLLKSPGEMGADIAIGTSQRFGVPVGYGGPHAAYMSVKDAHKRSMPGRLVGVSVDARGNRAYRLSLQTREQHIRREKATSNICTAQVLLAVMASMYGVFHGPQGIKAIAQQTHQKAVLMAKGLEKLGYTIEPETFFDTITVEVGHMQGVILRSAVAEGVNLRKVGATKIGMSLDERTRPATLEAVWRAFGGNFSISDFEPDYRLPKDLLRTSQYMTHPIFHMNRAESEMTRYIRRLSDRDLALDRSMIPLGSCTMKLNATAEMLPITWPEFSDIHPFVPANQALGYKEMIDDLSEKLCSVTGYDAFSMQPNSGAQGEYAGLLTIRNYHLANGGTHRDVCLIPTSAHGTNPASAQMVGMKVVPVKVRDNGDIDIDDFRLKAEQYAENLSCCMITYPSTHGVFEETVREICEITHKHGGQVYLDGANMNAMVGLARPGDIGSDVSHLNLHKTFCIPHGGGGPGMGPIGVKAHLAPFLPGHPTTDGREGAVSAAPFGSPSILPISWSYCLMMGGEGLTQATKVAILNANYIAERLKGAYDVLYKSETGRVAHECIIDTRPLADSCGVTVDDVAKRLIDCGFHAPTMSWPVAGTLMIEPTESETKAEIDRFCDAMLAIREEARDIEEGRADKNNNPLKNAPHTVEDLVGEWDRPYSREKGCFPPGAFRIDKYWSPVNRIDNVYGDRNLICTCPPMEAYAEAAE

SEQ ID NO: 9220 - protein, 477 aa, Haemophilus influenzae
MNYIQLQRFNMSKVASIVDVLQGKVAIGETVTVRGWVRTRRDSKAGLSFLAVYDGSCFDPIQAIINNDIENYESEILRLTTGCSVIVTGKVVESPAEGQAVELQAEKVEVTGFVEDPDTYPMAAKRHSIEYLREVAHLRPRTNIIGAVARVRHCLSQAIHRFFHEQGFYWVATPLITASDTEGAGEMFRVSTLDLENLPRSENGKVDFSQDFFGKESFLTVSGQLNGETYACALSKIYTFGPTFRAENSNTTRHLAEFWMVEPEVAFATLADNAKLAEDMLKYVFRAVLAERKDDLQFFEKHVDKDVITRLENFVNSDFAQIDYTDAIDVLLKSGKKFEFPVSWGIDLSSEHERFLAEEYFKSPVVVKNYPKDIKAFYMRLNDDEKTVAAMDVLAPGIGEIIGGSQREERLEVLDKRMEEMGLNPDDYWWYRDLRKYGSVPHSGFGLGFERLIVYVTGVQNIRDVIPFPRAPRNANF

SEQ ID NO: 9221 - protein, 321 aa, Bacillus anthracis
MAVNEKVELATFAGGCFWCMVSPFEEMVGIIKVVSGYTGGHKENPTYKEVCSETTGHYEAVQITFDANKMPYEELLNIYWRQIDPTDVGGQFHDRGQSYETVIFYHNEEQHKKAEASKEELAKCGRFSKPIATKILPAATFYPAEEYHQGYHKKNTFRYELYRKGSGRDAFIKQHWPKDNAHLKEKLNDMQFYVTQENGTEPPFRNEYWNHKEEGLYVDIVSGEPLFTSIDKFDSGCGWPSFTKPVMSASVKEKMDVSHNMTRTEVRSKEGDSHLGHVFPDGPGPNGLRYCINSAALRFIPKEELEKEGYGDFLMLFGNKK

SEQ ID NO: 9222 - protein, 893 aa, Verticillium fungicola
MVVRAGTATRNNCTLPPSPPRTVGNSRAGSDDEGGTFDNSPPTPPVEKITNLLKPYALPPQNTPTQVLPEDLKTPDSHVPRDPRLIRLTGVHPFNVEPPLTDLYDEGFLTSENLHYVRNHGPVPECSDDESLSWTFAVDGLVEKPFTITVRDLIETHDQLTYPVTLVCAGNRRKEQNIVRKSKGFSWGAAGLSTALWTGVPIGALLRIAKPKRGARYVCFEGADKLPNGYYGTSVKLNWCLDENRGIMVAHKMNGQSLHPDHGKPVRIVIPGQIGGRSVKWLKKITITAEPSDNWYHIYDNRVLPTTISPEASADLPNVWKDEKYAIYDLNVNSAICYPQHDELIMLESAPETYKVRGYAYGGGGKRITRLEITLNKGKSWLLAGIRYPEDDYRRAPDGDVLYGGSTDMWWREACFCWCFWEIDIPVSDLCESDDMMIRAMDEGMMVQPRDMYWSVLGMMNNPWFRVVIHRENGVLRFEHPTRPALQAGGWMERVKASGGNLANGFWGEKTSSEAVEAPKEPEKDICMTNPKIDRVIKLEELKAHSGETEPWFVIKGHVYDGTPYLDGHPGGATSIINAAGQDTTEEFITIHSENAKAMMPKYHIGTLDAASLKALEGGDEDESVNDPTRPVFLQPKTWSKAILKSKTDVSSDSKIFSFRLDHPNQSIGLPTGQHLLMRLRDPATREAIIRAYTPLSETHAKGQLDVLIKIYRDSPGQPGGKMTQALDSIPLGHFIDIKGPVGKFEYIGRGQCTVSGVRRHVRRFIMICAGSGVTPIFQVLRAVTSAAEDETECLVLDGNRFEEDILCKAELDAMVARAPSRTTVLYKLSRPTETWQGLRGRMNKDFLEESIGAFGKSDGQEMVLVCGPGALEATVREVLGGIGWKAEDLLFF

SEQ ID NO: 9223 - protein, 354 aa, Solanum incarceratum
VKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9224 - protein, 242 aa, Prochlorococcus marinus
MFKFLKNIMNNEEPTLNNDINSIHRILKTDITRNPNPQEEEIIFGCGCFWGAEKCFWKLPGVVTTSVGYAGGDKSNPTYYEVCSGLTGHSEVVRVIWNKSEIDISDLLKMFWECHDPTQKNRQGNDMGTQYRSAIYFKKENNKKIIIASKEQYQKELNKKNLGLIETEIKMIDTYFYAEQYHQQYLASPGSRQYCSASPTKVKLGDFPGSKYKLKEHIWENFNWQVDKCVLRSDNNPINNNI

SEQ ID NO: 9225 - protein, 441 aa, Haloferax mediterranei
MQTSEPEGSSPNTAEAASQSSEPKPASESALETARRQLYRAADHLDIDPNVVERLKHPEAVHEVTVPIERDDGSVSVYTGYRAQHDSVRGPYKGGLRYHPGVTRDECVGLRMWMTWKTEVRRDGPIFGGAKGGIAVNPKDLTLDEKERLTRRFTQEIRTIIGPMKDIPAPDMGTDPQTMAWVMDAYSMQEGETVPGVVTGKPPIVGGSEGRDTAPGRSVAIIAREAIDYLSWDIEDTTVAVQGFGSVGAPAARLLDDYGANVVAVSDVNGAIYDPDGLDTHAIPTHEEEPEAVMTHDAPETFSNEELLELDVDVLIPAAVGNVLTAENADDVQANLIVEGANGPTTSAADANFAERGVPVIPDILANAGGVTVSYFEWLQDINRRTWSLERVHDELETEMLNAWSVVRDEYESRDVPWRDAAYIVALSRIAAAHDARGLWP

SEQ ID NO: 9226 - protein, 362 aa, Solanum jamaicense
WDTSVAIEVRVGDNIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFTFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVSYPNKAKGVAKFNVPLAHMITAGADFMLVPSRFEPCGLIQLHA

SEQ ID NO: 9227 - protein, 72 aa, Treponema pallidum
MTKEEAIEVDGVVKEALPNTTFRVQLQNGHEILAYLSGRMRKHYIRIVPGDSVKVALSPYDLSRGRIMFRER

SEQ ID NO: 9228 - protein, 381 aa, Arabidopsis thaliana
MSHSAVSQAGAVSVSIENQRSLRRSVFKNNSISFNSKSWSSSLALNQKTTSIRDGKRYPSTTICMSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKVEEYSDEIFKLLDNGAHIYFCGLKGMMPGIQDTLKRVAEERGESWDLKLSQLRKNKQWHVEVY

SEQ ID NO: 9229 - protein, 362 aa, Solanum luteoalbum
WDTSVAVEVKVADSIEIVRFFHCYKRGVDRVFVDHPIFLEKVWGKTGSKIYGPKAGQDYLDNELRFSLLCQAALEAPRVLNLNCSKYFSGPYGEDVLFIVNDWHTALIPCYLKSMYQSRGIYLNAKVAFCIHNIAYQGRFAFSDFPLLNLPYEFRGSFDFIDGCEKPVKGRKINWMKAGILESHRVVTVSPYYAQELVSAVDKGVELDNVLRKTSITGIVNGMDTQEWNPATDKYTDVKYDITTVMDAKPLLKETLQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9230 - protein, 362 aa, Solanum mammosum
WDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDINTVMDAKPLLKEALQAAVGLPVDRKIPLIGFIGRLEEQKGSDILVSAIHKFIGLDVQIVVLGTGKKTFEQEIEQLEVLYPNKAKGVAKFNVPLAHMITAGADFMLVPSRFEPCGLIQLHA

SEQ ID NO: 9231 - protein, 508 aa, Sambucus nigra
GIIWGLLLWCAFASGMVGGAKEDEGLYSATTYDYKDALTKAILFFEGQRSGKLPTNQRVKWRGDSALSDGKPHNVNLTGGYYDAGDNVKFGWPMAYTVSLLSWAAVEYKQEISPTNQLRYLQTAIRWGTNYILRAHTSSTTLYTQVGDGNSDHQCWERPEDMDTPRTLYKITSTSPGTEVAADNAAALAAASIVFQEVDSNYSAKLLRHSKLLFQFADQYRGSYQASCPFYCSYSGYQDELLWAAAWLYKASGDATYLNYVLGNQGWSHAVSEFSWDNKFAGAQTLLAKEFFGGKTNLGKFKSDSESFICALMPGSSSVQIQTTPGGLLYTRDSSNLQYVTSASMVFLIYSKILNAANIKGVQCGSVNFPTSQIKAFAKSQVDYILGNNPMKMSYMVGFGSKYPLQLHHRGASIPSMQIHPARVGCNEGYSAWYSSSKSNPNTHVGAIVGGPNSNDQFNDVRSDYSHLETTTYMNAAFVGSVAALVGDNSIREYMMLHINTTTMVNDV

SEQ ID NO: 9232 - protein, 233 aa, Silicibacter pomeroyi
MAKNTSGRGQRDLKVKVKTARGRKLSSTRWLQRQLNDPYVKRAQAEGYRGRAAFKILELDEKYRFLVPGARVVDLGCAPGGWCQVAVKRVNALGERSDKRVGRVLGIDLQEVEPIAGAEIHQLDFLDDGADDRIKEWLGGKADVVMSDMAASSSGHKQTDHMRIIALCEAAAYLAFDVLEEGGTFVAKVLAGGAEGDLQKLLKQKFTKVANVKPPASRSDSSEKFVVATGFRG

SEQ ID NO: 9233 - protein, 191 aa, Methanococcoides burtonii
MRNAKITRKTKETDIQMELELDGTGSSNIDTGIGFFDHMLTSFAKHGNLDLIIEATGDLIVDEHHLIEDTAIVLGQALSEALGDKDGIARFGDARIPMDEALADVVLDLGGRTYLVMKAEFEAPRVGEMNTQLVRHFFESLTDNSKMNLHIAVTGYNDHHKIEALFKAFAYALRRAVKIEGEGIKSTKGVL

SEQ ID NO: 9234 - protein, 154 aa, Triticum aestivum
  misc_feature (104)..(104): Xaa can be any naturally occurring amino acid
  misc_feature (116)..(116): Xaa can be any naturally occurring amino acid
  misc_feature (145)..(145): Xaa can be any naturally occurring amino acid
TWIIESHKTSANIILIQELFEGHYFCQGQRMDFSARAKPYKENPTMMRIAKLAKELDVVLPVSFFEETGNAHYNSVDLINADGTESWPTRKSHIPEGPGYQEKXYFSPGEPEFKVXKQFCTMGGGLGWDQGSQKPGGHVVTGAKXLFLPRAIGS

SEQ ID NO: 9235 - protein, 239 aa, Kluyveromyces lactis
MVSGDVGSASFLNKQMKMRGLQKLRFYCQICQKQCRDENGFKSHSKSPSHLQKLSKVTHKDIEEYTVQFEKDFLRLLRLMHGEKKVEANKFYNEFIQDKDHVHMNATRFTSLTRFIQHLSQGGKVRIHGIDELTSDTDPGRFMISYIDSSSPNMIRKKQIESLKQAERSDQEIKLRLLEKQIEKANAEEVKSGQKEEEEEEEEIKANIRDGPINLTVSTSKVTKKKPKKKLKNVFKPTK

SEQ ID NO: 9236 - protein, 556 aa, Saccharomyces bayanus
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVKQAKLT

SEQ ID NO: 9237 - protein, 557 aa, Ostreococcus tauri
MTTARARPWGCRRRYSGGGVRAGGGGARVDAHGAPARANAAYAKPERIAGVKGRDGGASRIGETLELRRLARSVRTPKGIAFIDLNDGSAMTGIQAVVSEGSGAWALANSGAPGGKQAAELAVDELEIIGGADPETYPLQKKRHTLEYLRSIAHLRPRTNTIGAVARVRNELAYATHNFFQQNGFLYVHTPIITASDCEGAGEQFQVTTLLSGLDAGSATTPGAVQAAEVAVKAQGDAVKAMKAGGDVNKETLLEEVEKLKALKAELEALSASTGIPTNKDGSVDYTQDFFGKRSYLTVSGQLNGEIMACAVNDVYTFGPTFRAENSNTSRHLAEFWMVEPELAFADLKDDMDCAEAYLKYCLNHVLEHCDEDLAFFEANISKDNLRERLRNVASQEFVRITYTEAVEHIQKATKKFEFPCEWGSDLQSEHERYISEEVFKDRPVIVRDYPKDIKAFYMRLNDDNKTVAAMDVLVPRVGELMGGSQREERLDVLERRIEENGLEKEAYWWYLDLRRYGSQPHAGFGLGFERLVQYVTGVENIRDAIPFPRYPGSAEF

SEQ ID NO: 9238 - protein, 241 aa, Erwinia carotovora
MATVSMRDMLKAGVHFGHQTRYWNPKMKPFIFGARNKVHIINLENTVPMFNDALAELGKIASRKGKILFVGTKRAASEAVKDSANNCDQFFVNHRWLGGMLTNWKTVRQSIKRLKDLEIQSQDGTFDKLTKKEALMRTRELDKLEKSLGGIKDMGGLPDALFVIDADHEHIAIKEANNLGIPVFAVVDTNSDPDGVDFIIPGNDDAIRAINLYLGAVATAVREGRSQDLAVQAEEGLVEAE

SEQ ID NO: 9239 - protein, 404 aa, Mycobacterium tuberculosis
MREVPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRFHIDSGAGATVAGIRVPRENATAFGCIDADDSGRIRSFVEKPLEPPGTPDDPDTTFVSMGNYIFTTKVLIDAIRADADDDHSDHDMGGDIVPRLVADGMAAVYDFSDNEVPGATDRDRAYWRDVGTLDAFYDAHMDLVSVHPVFNLYNKRWPIRGESENLAPAKFVNGGSAQESVVGAGSIISAASVRNSVLSSNVVVDDGAIVEGSVIMPGTRVGRGAVVRHAILDKNVVVGPGEMVGVDLEKDRERFAISAGGVVAVGKGVWI

SEQ ID NO: 9240 - protein, 214 aa, Unknown
  Synechocystis sp. PCC 6803
MGLAIAVGSFLISPFSKVIPDPVVDINPVSTTARGTEKAVFAGGCFWGLEAMFEEVRGVKDVQTGYSGGTEATANYARVSGGGTDHAESIEIVYDPAQVSYGELLKIFFSVGHDPTQVNRQGVDQGRQYRSAIFATTPEQKQVAQAYIDQLEESQAFDQAIATEVNDFDAFYPAEDYHQDFVQRNPAHPYVLVHDLPKLRKFRQQYSDKLKAQS

SEQ ID NO: 9241 - protein, 681 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENRIGGGSTTSSYLQNHHEILNWRRLSQTG

SEQ ID NO: 9242 - protein, 491 aa, Arabidopsis thaliana
MSDLQANKDETTVDRQSSSSVDLDGPSPLRKMISVASIAAGIQFGWALQLSLLTPYVQLLGVPHKWPSFIWLCGPVSGLLVQPSVGYFSDRCTSRFGRRRPFIATGALLVAVSVVLIGYAADFGHSMGDKIDKPVKMRAVVIFALGFWILDVANNTLQGPCRAFLGDLAAGDAQKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGALGLMLNSIVLGVMSLGIEGISRKMGGAKRLWGAVNIILAVCLAMTVLVTKKAEEHRRIAGPMALPTDGIRAGALTLFALLGIPLAITFSIPFALASIISSSSGAGQRLSLGVLNMAIVIPQMIVSFGVGPIDALFGDGNLPGFVVGAIAAAVSSIVAFTVLP

SEQ ID NO: 9243 - protein, 500 aa, Carboxydothermus hydrogenoformans
MPGFVYLVGAGPGDPDLITVKGLNLIKKADVIVYDRLVNPVLLTYARKDAELIYAGKAPERHEYLQEEINKLLVEKALAGKTVVRLKGGDPFVFGRGGEEALELTRHGIPFEVVPGITSAIAVPAYAGIPVTHREVAASFCVITGNEDPTKKESQINWEKVALAADTLVFLMGRKNLPQIVANLLKYGRSPQTPVAVIRLGTRAEQRTVTGCLQDIEEKVRKADLKHPVIIVVGETVKLREQLNWFETKRLMGKRILVTQSSNSGKLLACRLKELGAEVWHLPQVEYLKPESYREVDRELQRLNEYKYILFTSPNGVEFFLNRLKCLELSIDALPEIIAIGEKTKKALENSGINVAHKTDRFLPREVVKFIAGRLQDGEKILFPKSEKATILELKLREERLPVKYLPVYKAVRAKVEADHLFELIDGRKIDFITFVSPAAVNNFFESLTDEKRERLAEIKMVSMGLSTTAEIKKYGDFEILEAKRPGVDGILEKILEAAI

SEQ ID NO: 9244 - protein, 134 aa, Brassica napus
MEKQRITNTSSASWIPGSCIGRGCFGTVTKAVSKIDGGVFAVKSVDLSTCLPSQSESLENEISILRSLKSHPHIVRFLGDDVSKEGTTSFRNLHLEYLPEGDVSNGGIVVDETLLRRYVWCLVSALGHVHSNGI

SEQ ID NO: 9245 - protein, 438 aa, Hypocrea jecorina
MGQTLSEPVVEKTSEKGEDDRLIYGVSAMQGWRISMEDAHTAELNLPPPDNDTKTHPDRLSFFGVFDGHGGDKVALFAGENIHNIVFKQESFKSGDYAQGLKDGFLATDRAILNDPKYEEEVSGCTACVTLIAGNKLYVANAGDSRSVLGIKGRAKPLSNDHKPQLETEKNRITAAGGFVDFGRVNGNLALSRAIGDFEFKKSAELSPENQIVTAFPDVEVHELTEEDEFLVIACDGIWDCQSSQAVVEFVRRGIAAKQDLDKICENMMDNCLASNSETGGVGCDNMTMVIIGFLHGKTKEEWYDEIAKRVANGDGPCAPPEYAEFRGPGVHHNYEDSDSGYDVDADSGGKFSLAGSRGRIIFLGDGTEVLTGSDDTEMFDNADEDKDLASQVPKSSGKTDAKEETEAKPAPEAESSKPADGSEKKQDEKTPEESKKD

SEQ ID NO: 9246 - protein, 500 aa, Bacillus halodurans
MKSILFNMATRERRAAVVENGQVIELMIERPVEERIVGNVYRGRVVNVLPGMQACFVDIGREKNGFLYRDELLSFHLSNEEEDEKKKRNISDFVQEGEELLVQVTKEGFGTKGPRLTGVVAFPGRYVVYMPQAGYVGVSKKIFPEEERERWRSEWEQLLLNDEGLIIRTACKKEVRHEAEQEILFFRQMWEELQKRGKGAKAPSLLYQSSGLIERILRDFPLDEVGEIVVDDREEYHFIKQLLASYPNMESRVFLYKGKENVFSHLKVEKEIEKGLRRQVWLKNGGYLMMDHAEALTVIDVNSGKFIGKQDLQDTVVKVNIEAAKEIAHQLRLRDISGIIIIDFIDMKREEDQQLVLHTLEQALKTDRTKTNVIGMTGLGLVEMTRKKVRQSLQASLSKPCPTCRGTGQVLSDEAQAFKIERELWEYRGSDAEAIVLELPSHIAPVLFGQDGGHLKRLETAIGSRILAVPKKTLKEEQYEIRYIGSLEEATQFVERIKKR

SEQ ID NO: 9247 - protein, 379 aa, Alteromonadales bacterium
MSKRDYYEVLGVSKDASERDIKKAYKRLAMKYHPDRTAGDKELETKFKEVKEAYEILTDDQKRQMYDQYGHAAFEQGGGGGHGGFGGGHGDFGDVFGDVFGDIFGGGGGRRQSRQQRGSDLRYNMDLTLEEAVRGKEVEIKVPTWVSCDPCDGSGAKAGSKPKTCTTCHGAGQVQMRQGFFAVQQTCPTCQGQGQIISDPCNSCHGQGRVEKTKTLSVKIPAGVDTGDRIRLSGEGEAGVHGAPAGDLYVQVSVREHDIFVREGNNLYCEVPISFTTSGLGGEIQVPTLDGRAKLKIPSETQTGKMFRMRGKGVKSVRSGAQGDLICKVVIETPVNLNERQRELLKELEESMGTDSSKNRPKEQGFFDGVKKFFDDLTK

SEQ ID NO: 9248 - protein, 722 aa, Magnetospirillum magnetotacticum
MLGNIHLRRGAFAEAEAAFEGALRIDSANPEFRVNLATAQSRRGLFQEAAANTRLVLTRFAGHARALSVLGPALRNLKKYDEAVECGKATVAAVPQFAPAHAELGAALAGAERYEEALGCYERALALAPDFAEAWCAKGRVLFALKRESDAEKAMREALRCKPDLVPAHMGLGEFLAAMGRHDDAAAHFRRAVEIQPANADAACALGAELQAAFRIEAATEAYRHALAVDPDLVAALVGLGRVHLEAGRDHEAVPLLERAYRLSPDEGGILDMLVLARLQLCAWDGLEPLRAALLERIRADRMVVNPFVAILADADSAHQDLAARQWARIVTPADAPLFRHVPPEPEPGRRLRIGYMSSDLHDHPLAHLMVGIFENHDRARFEMRAYSLGYDDGSPMRRRIAACFDEVVQIDQMGGAEAARRIQTDGIDILVDLNGYTNHGNPAVLAYRPAPIQVNFQGYAATLGADFMDYIIGDPVTLPLSEQPHFAEAIVQMPYSYHPGTVTRSMAESVPKRSDFGLPEAGFVFCCFNNAGKFTPEVFAVWMRLLKAVPDSVLWLLDRNGTVKDNILAQVDAHGVDRGRVVLAPRVPLPLHLARQQLADLFLDTLPYNAHVTASDALWAGLPLLTCLGHAFAGRVAGSLLKVLELDELITTDLEQYEARALELARDRGRLDGLRARLMANKASSPLFDVALYTRHLEAAYASMWERWCAGRAPEPFVITP

SEQ ID NO: 9249 - protein, 231 aa, Arabidopsis thaliana
  misc_feature (75)..(75): Xaa can be any naturally occurring amino acid
  misc_feature (89)..(89): Xaa can be any naturally occurring amino acid
MASFTASASTVFAARPALLLKATVAISATVLALPSMGKKNGGARCSMETKQGNLSVMGAGASVVATPALTAVPSXPPMALARERTPTDXTGLPFGLSNNLFWLHPVCSPGPHPHSPPPHTLSLLGCPHYPAIPPPTQDITIYPIALPRPLRQPLITPPFSLLVPFNCPHPRSTPFYYFALTCPPPFYLSLFFYLLFLSAAPLYALLPFPIALPPPFFLSPLSSFPCPFPPL

SEQ ID NO: 9250 - protein, 269 aa, Chromobacterium violaceum
MKQKFVAAAVQMVSGCGLEANLARADQLLGEAAARGAGLAVLPEYFCLMGAKETDKVAIREPFGGGPIQQALSEMARRHGLWLLGGTVPLVCEEEGKVFNSSLLYNPQGEVAARYDKIHLFGFTGQGESYCESNTIRPGVTPTKAETPLGDIAFGICYDLRFPELFRMLAPVDLLILPAAFTATTGEAHWEPLLRARAIENQCYLIASAQGGRHENGRQTHGHSMIIDPWGRILAELPSGEGVITAEIDPEWTDSVRSRLPALAHRVIR

SEQ ID NO: 9251 - protein, 599 aa, Streptococcus agalactiae
MLYPLLTKTRNTYDLGGIWNFKLGEHNPNELLPSDEVMVIPTSFNDLMVSKEKRDYIGDFWYEKVIEVPKVSEGEEMVLRFGSVTHQAKIYVDGILVGEHKGGFTPFEVLVPECKYNNEKIKVSICANNVLDYTTLPVGNYSEIIQEDGSIKKKVRENFDFFNYAGVHRPLKLMIRPKNHISDITITSRLSDDLQSADLHFLVETNQKVDEVRISVFDEDNKLVGETKDSRLFLSDVHLWEVLNAYLYTARVEIFVDNQLQDVYEENFGLREIEETNGQFLLNRKPIYFKGFGKHEDTFINGRGLNEAANLMDLNLLKDIGANSFRTSHYPYSEEMMRLADRMGVLVIDEVPAVGLFQNFNASLDLSPKDNGTWSLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGLRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 9252 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVTAGDIMSYHLEEYDILHQRSLFNEARIAVTLIRGNHYFKASKTMNQQGEPYNVFTSFYKKWRPYLRHRDVYHYDLKSFENFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKPKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQMVDHQEKRTQVLATFKALD

SEQ ID NO: 9253 - protein, 236 aa, Zea mays
MTRRYWNINLKEMIEAGVHFGHGIKKWNPKMAPYISAKRKGTHITNLARTARFLSEACDLVFDAASQGKSFLIVGTKKRAADLVASAAIRSRCHYVNKKWFSGMLTNWSITKTRLSQFRDLRAEEKMGKFHHLPKRDAAILKRKLSTLQRYLGGIKYMTRLPDIVIVLDQQKEYIALQECAILGIPTISLVDTNCDPDLANISIPANDDTMTSIRLILNKLVFAISEGRSLYIRNR

SEQ ID NO: 9254 - protein, 565 aa, Francisella tularensis
MKKYITGEKLFDTSKHATNVAEYIVARLVDLGITHSFCIPGDFSFALDCALINNPKLNNIVNANELNASYAADGYARVKGAAILSTTYAVGELSALNGVMGSKAENLVVFHLVGSPGDGAVGKKRQVYHTLGDGVFGNFFDLSASAACVSAVITPENARREMNRVIAEAFKYRKPAYISVSLDSGNRPVTDITPDDIDCSYLKSESHQLELATNLVLEHLSKAKKVVAIPAIKLDRFGVTEKAINLIEKLNIPFSIMPHDKSVISETHPNYVGFYAGLLSDTNTAEIVEGSDLIINLGDALWSDFNTAGFTNNLDLNKVLNLGPLFVEDNKTYLADVYLSELLDALLEKVESINYRPNYSRMKIQDTTITKEKLTLRALYTQVLKFLENTDSLVVETGSSSLNMPKLPLPEGVKYFNQTLWGSIGWATPAALGVALANPDSRTILITGEGSHQLTLNELGVMGRYKINPIILYINNDGYMIERALELDPNPSYDDIAQLNYTKLPEAFGCNDWLAIRVKTSEELAEALKKAREHQSGVYIEVITGKYDYGNALDFFNNHLKEMYS

SEQ ID NO: 9255 - protein, 542 aa, Aspergillus fumigatus
MIEAKMTPFEFNQHVNADRLARKLSARQVQMIAIGGTIGTGLFLGTGKALATGGPASMLISYAICGGIVFVTMLSLGEMAAFIPIAGSFCTFAGRFVDDALGFALTWNYWFNDAVSTAADVIALQLLLQYWTDNFPGWAISLIFLIFVILLNVMSVRIYGEIEYWLSLLKVITIIIFIILGIVVNCGGNKDHKYIGDKYFYVGDAPFVGGIGGFASVFVTASFAYGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCFGASYIGAGQLWTWLQNETSIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 9256 - protein, 686 aa, Glycine max
  misc_feature (449)..(449): Xaa can be any naturally occurring amino acid
SGRFFFFFFFFFECFVKREKMKSMENDDNADLNNQNNWLGFSLSPQMHNIGVSSHSQPSSAAEVVPTSFYHHTAPLSSYGFYYGLEAENVGLYSALPIMPLKSDGSLYGLETLSRSQAQAMATTSTPKLENFLGGEAMGTPHHYECSATETMPLSLDSVFYIQPSRRDPNNNQTYQNHVQHISTNQQQQQQELQAYYSTLRNHDMILEGSKQSQTSDNNNLHVQNMGGDDAVPVPGLKSWEVRNFQASHAHESKMIVPHVEENAGESGSIGSMAYGDLQSLSLSMSPSSQSSSVTSSHRASPAVVDSVAMDTKKRGPEKVDQKQIVHRKSIDTFGQRTSQYRGVTRHRWTGRYEAHLWDNSCKKEGQGRKGRQVYLGGYDMEEKAARAYDMAALKYWGPSSHINFPLENYQNELEEMKNMTRQEYVAHLRRKSSGFSRGASMYRGVTRXHHQHGRWQARIGRVAGNKDLYLGTFSTQEEAAEAYDIAAIKFRGANAVTNFDITRYDVEKIMASSNLLSSELARRNRETDNETQCIDQNHNKPSAYEDTQEAILMHQKSCESENDQWKMVLYQSSQQLEQNPPTIESDRTNQSFAVALDNMFHQEVEESSKARTHVSNPSSLATSLSSSREGSPDRTSLPMLSGMPSTASKLLATNPNNVNSWDPSPHLRPALTLPQMPVFAAWTDA

SEQ ID NO: 9257 - protein, 336 aa, Oryza sativa
MSSIKANTTTSPPSASTIALTATTGCHLLKVKGYSSYARLLRGKRFMSPKFSAAGHTWRIAFYPSDGNLVSFYLHLVDGRFSKDVTAEVQFSMLHRCNSADDEMPKNPYNHRKIIRHTFRSASCNVSSCGISRFVNAKEKKTVDMPLYKYTNEDDDSIVVRCDIKVMNKPAIHGDTLENLGLICHCKDDTCKHLHDTWPAMSAQPVVIEGWGLACSCRWSEGYKYLLPTNCLIECRGGNRPFASALDNAPFFVTKLGIKTLPCVILFKKGIAVDRLVGFQDLGSKDDFSTRALENILKMKGIIDEKKKDEDDEDDETDMSMNRRIRSSTAQDSDSE

SEQ ID NO: 9258 - protein, 209 aa, Glycine max
MMKTTMNISNANHEKVEKAFAFLTGNHFINHHYGAILSKCLKGLPVRDFDAQEIIPGLYLGDVYAAHNTKELKSRNFTHIVTCTVGVVPPFPDAFKYMHLKILDFAGETIDVHFTSTTDFIGDAIANGGKVLVHCIRGVSRSATIVSAYLMKSMSLSAEDAVEHVRRVRAIARPNYGFMMQLQLYHKELNKGMMNVEISDEQNLPAAEW

SEQ ID NO: 9259 - protein, 408 aa, Burkholderia xenovorans
MIDTIAIIGAGLAGSTAARALRAQGYEGRIHLLGDESHQAYDRTTLSKTVLAGEQPEPPAILDSAWYASAHVDVQLGRRVSCLDLANRQIQFESGAPLAYDRLLLATGARARRMAIRGGDLAGIHTLRDLADSQALRQALQPGQSLVIVGGGLIGCEVATTARKLSVHVTILEAGDELLVRVLGHRTGAWCRAELERMGVRVERNAQAARFEGQGQVRAVICADGRRVPADVVLVSIGAEPADELARAAGIACARGVLVDATGATSCPEVFAAGDVAAWPLRQGGQRSLETYLNSQMEAEIAASAMLSQPVPAPQVPTSWTEIAGHRIQMIGDAEGPGEIVVRGDAQSGQPIVLLRLLDGCVEAATAINATREFSVATRLVGTRVSVSAEQLQDVGSNLRDLLKAKPN

SEQ ID NO: 9260 - protein, 176 aa, Coccidioides immitis
MSSATSFFDFATPDKKGEPFPLSSLQGKVILVVNTASKCGFTPQLQGLEALYKKISADYPDKFTVLGFPCNQFGSQDPGTNDEIQSFCQVNYGVTFPILGKVDVNGDKAAPVFEWMKKEMPGLMGLKRVKWNFEKFLISADGKVVGRWASITKPESLEAPILKEIEKMEKGGRTSL

SEQ ID NO: 9261 - protein, 957 aa, Escherichia coli
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLTRAEAAEINLRSDILNAVGITLDETTTRENVMQLFNVLLGDNHGLDIDTLDKDVAHDSRSIQPAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 9262 - protein, 341 aa, Mycobacterium tuberculosis
MAANKREPKVVVLGGGSWGTTVASICARRGPTLQWVRSAVTAQDINDNHRNSRYLGNDVVLSDTLRATTDFTEAANCADVVVMGVPSHGFRGVLVELSKELRPWVPVVSLVKGLEQGTNMRMSQIIEEVLPGHPAGILAGPNIAREVAEGYAAAAVLAMPDQHLATRLSAMFRTRRFRVYTTDDVVGVETAGALKNVFAIAVGMGYSLGIGENTRALVIARALREMTKLGVAMGGKSETFPGLAGLGDLIVTCTSQRSRNRHVGEQLGAGKPIDEIIASMSQVAEGVKAAGVVMEFANEFGLNMPIAREVDAVINHGSTVEQAYRGLIAEVPGHEVHGSGF

SEQ ID NO: 9263 - protein, 486 aa, Mycobacterium tuberculosis
MSVTPNAGCVDVVIVGAGISGLGAAYRIIERNPQLTYTILERRARIGGTWDLFRYPGVRSDSSIFTLSFPYEPWTREEGIADGAHIREYLTDMAHKYGIDRHIEFNSYVRAADWDSSTDTWTVTFEQNGVHKHYRSRFVFFGSGYYNYDEGYTPDFGGIEKFGGAVVHPQHWPEDLDYTGKKIVVIGSGATAVTLIPSLTDRAEKVTMLQRSPTYLISASKYSTFAAVVRKALPPKTSHLIVRMYNALLEAVFWFLSRKTPVFVKWLLRRTAIKNLPEGYDIETHFTPRYNPWDQRLCLIPDADLYNAITSGRAEVVTDHIDHFDATGIALKSGGHLDADIIVTATGLQLQALGGAAISLDGVEIDPRDRFVYKAHMLEDVPNLFWCVGYTNASWTLRADMTARATAKLLAHMAAHGHTRAAPHLGDEPMDEKPSWDIQAGYVKRAPYALPKSGTKRPWNVRQNYLADAIDYRFDRIEEAMVFGAA

SEQ ID NO: 9264 - protein, 243 aa, Unknown
  Pleurotus sp. 'Florida'
SDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKARSKTRK

SEQ ID NO: 9265 - protein, 279 aa, Pseudomonas aeruginosa
MNTTVIPPSLLDVDFPAGSVALVGAGPGDPGLLTLRAWALLQQAEVVVYDRLVARELIALLPESCQRIYVGKRCGHHSLPQEEINELLVRLARQQRRVVRLKGGDPFIFGRGAEELERLLEAGVDCQVVPGVTAASGCSTYAGIPLTHRDLAQSCTFVTGHLQNDGRLDLDWAGLARGKQTLVFYMGLGNLAEIAARLVEHGLASDTPAALVSQGTQAGQQVTRGALAELPALARRYQLKPPTLIVVGQVVALFAERAMAHPSYLGAGSPVSREAVACA

SEQ ID NO: 9266 - protein, 472 aa, Mycobacterium tuberculosis
MSGTSSMGLPPGPRLSGSVQAVLMLRHGLRFLTACQRRYGSVFTLHVAGFGHMVYLSDPAAIKTVFAGNPSVFHAGEANSMLAGLLGDSSLLLIDDDVHRDRRRLMSPPFHRDAVARQAGPIAEIAAANIAGWPMAKAFAVAPKMSEITLEVILRTVIGASDPVRLAALRKVMPRLLNVGPWATLALANPSLLNNRLWSRLRRRIEEADALLYAEIADRRADPDLAARTDTLAMLVRAADEDGRTMTERELRDQLITLLVAGHDTTATGLSWALERLTRHPVTLAKAVQAADASAAGDPAGDEYLDAVAKETLRIRPVVYDVGRVLTEAVEVAGYRLPAGVMVVPAIGLVHASAQLYPDPERFDPDRMVGATLSPTTWLPFGGGNRRCLGATFAMVEMRVVLREILRRVELSTTTTSGERPKLKHVIMVPHRGARIRVRATRDVSATSQATAQGAGCPAARGGGPSRAVGSQ

SEQ ID NO: 9267 - protein, 419 aa, Prochlorococcus marinus
MHTINSDLRNTDPDISFLINQELLRQQTHLELIASENFASEAVMEAQGSVLTNKYAEGLPNKRYYGGCEHIDAIEQLAITRAQTLFNAEWANVQPHSGAQANFAVFLALLNPGDTIMGMDLSHGGHLTHGSPVNVSGKWFNAIHYGVDQTTKVLNFEQIRQVALKNRPKLIICGFSAYPRTIDFKAFRSIADEIDAYLLADIAHIAGLVACGAHPNPVPYCDVVTTTTHKTLRGPRGGLILCRDKEFGKRFDKAVFPGNQGGPLEHVIAAKAVAFGEALKPEFKTYTFQVISNAKALAKRIQERGISIVSEGTDNHIVLLDLRSIEMTGKKADSLISEVNITANKNTVPFDPESPFVTSGLRLGTAALTTRGFTEKAFIEVADVIADCLLNPEDLSIKEQCKAKVIDLCNRFPLYNSNQ

SEQ ID NO: 9268 - protein, 594 aa, Kineococcus radiotolerans
MCGLCGEVRFDGRAADVAAVQRMSETMAARGPDGEGVWAQGRVAFGHRRLSVIDLSACGAQPMQDPELGLTAVFNGCIYNYPELRAELAGHGYRFTSTSDTEVIVKGYHRWGVDVVDHLVGMFAVVLHERDSGRVVLMRDRLGIKPLYLAETPGRLRFASTLPALLAGGDVDTTIDPVALHHYLSWHAVVPAPRTVLQGVRKLPPATVRVLEADGTSREHRYWAPDHVRREEFAGFSERDWEDAVLESLRTAVRRRTVSDVPVGVLLSGGLDSSLITALLAEQGQTDLATYSIGFESVGGRGGDEFEYSDVIAERFATDHHRIRVSGDELVGALGHAVGAMSEPMVSHDVAAFDLLSQQVSQSIKVVQSGQGADEVFGGYHWYPPLAGLTPQQGVDVYARAFFDRDHAGMAQVLDPRWLTATDVSREFLAEHFARPGADTAVDAALRLDTEVMLVDDPVKRVDNTTMAWGLEARVPFLDHELVELAAAVPPELQLSGGGKGILKRVGYRVIPREVIDRPKGYFPVPAITHLEGKVLGTVKDALTSRAAQDRGLFRPEYVQGLLRDPNGELTPLRGNKLWQLGLLEMWLQQHGIG

SEQ ID NO: 9269 - protein, 406 aa, Arabidopsis thaliana
MFGPTGGLGMNPSMDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQDRGYIGLLLASELKLVAMAWCTLHDLYLQI

SEQ ID NO: 9270 - protein, 334 aa, Pseudomonas fluorescens
MSTQPIKQQLQRFNRLDLLGQPTPLEKLERLSTWLGRDVYIKRDDLTPLAMGGNKLRKLEYLAADAIAQGADTLITAGALQSNHVRQTAALAAKLGLGCVALLENPLGTDDSNYTGNGNRLLLDLFDTKVELVDNLDNADEQLAALAVRLRSNGKKPYLVPIGGSNAIGALGYVRAGLELAEQIKDTGLQFSAVVLASGSAGTHSGLALALSEALPQLPVIGVTVSRSEEDQRPKVQGLAERTADLLGVALPDSFKVELWDEYFGPRYGEPNAGTLSAVKLLASQDAVLLDPVYTGKAMAGLLDGIGRGRFDDGPIIFLHTGGAPALFAYKDFL

SEQ ID NO: 9271 - protein, 948 aa, Unknown
  Mycobacterium sp. JLS
MLDSHQPRFADRHIGPDSDAVAVMLDTIGVATLDDLAAKALPANILDALSADGVAPGLELLPAPASETEALAELRALAESNTVAVSMIGQGYFDTLTPPVLRRNILENPAWYTAYTPYQPEISQGRLEALLNFQTMVSDLTGLEVANASMLDEATAAAEAMTLMQRAGRSKSNRLAVDADLYRQTAAVLATRARPLGIEIVTADLRQGLPEGDFFGVIVQLPGASGALVDWAPLVADAHDRGALVAVGADLLALTLVTPPGEFGADVSFGSTQRFGVPMGFGGPHAGYLAVHTKHARQLPGRLVGVSVDADGSPAYRLALQTREQHIRRDKATSNICTAQVLLAVIAAMYASYHGAEGLTSIARRVHGHARAVATGLAEAGVDVVHDAFFDTVLVNVPGRAAEIRDAAKSHGINIWLVDADHVSVSCDEATTADHVAAVLSAFGATRGGKPFAGPEIATRTSEFLTHPAFTRYRTETEMMRYLRSLADKDIALDRSMIPLGSCTMKLNAAAEMEPITWPEFARQHPFGPESDAPGLRRLIADLQTWLTGITGYDEISLQPNAGSQGEYAGLLAIKAFHDANGAPERDVCLIPSSAHGTNAASAALAGMRVVVVGCRPNGDVDLDDLRAKVTENAERLAALMITYPSTHGVYEHDVAEICAAVHDAGGQVYVDGANLNALVGLARPGRFGGDVSHLNLHKTFCIPHGGGGPGVGPVAVRAHLAPYLPGHPLADELGDDYTVSAAPYGSASILPITWMYIRMMGAPGLRAASLTAIASANYVARRLDEYYPVLYTGENGMVAHECILDLRTITKQTGVTVDDVAKRLADFGFHAPTMSFPVAGTLMVEPTESESLSEVDAFCEAMIAIRAEIDQVGSGAWPVDDNPLRGAPHTAESLLVTEWEHPYTREQAAYPLGKGFRPKVWPPVRRIDGAYGDRNLMCSCPPVEAFA

SEQ ID NO: 9272 - protein, 235 aa, Triticum aestivum
  misc_feature (11)..(11): Xaa can be any naturally occurring amino acid
  misc_feature (17)..(17): Xaa can be any naturally occurring amino acid
LQVIIAHDGFXLCDLVXYNLKHNDANGEGGRDGCNDNFSWNCGVEGETNDSNVLALRSRQMKNFHVALMISQGTPMMLMGDEYGHTRYGNNNSYGHDTCINNFQWGQLAERRYGHFRFFSEMIKFRQNHPILKRDRFLSKNDVTWHEDCWDNLESKFLAFTIHDHNSGGDIYLAFNAHDYSVDAVIPPAPQHKHWNRVVDTNLESPNDIAPEGVPLTGSGYRIAPFSSILLKASP

SEQ ID NO: 9273 - protein, 216 aa, Triticum aestivum
  misc_feature (27)..(27): Xaa can be any naturally occurring amino acid
  misc_feature (40)..(40): Xaa can be any naturally occurring amino acid
MERQHPAVPLLPILLLLALLSPAARGXESPQYATVHAESXDFEVRRYRDTVWMSAPSDDISFHVATKLGFHRLFQYLMGANLNSSRISMTTPILTSIVPSAGPLHSSAYFVRLYLPLEFQASPPVPLPELNLHPDRWPGHCVAVRSFSGYARDHNVVEEAEKLAVSLSRTPWVNSTDHPSKNAYSIAQYNSPFRIIGRVNEVWFDVDCRSAGVEAY

SEQ ID NO: 9274 - protein, 389 aa, Ostreococcus tauri
MKRPTPRVGGRMSTVTRAGRDYYDVLGVSRSADSKELKRAYRQLARKFHPDVNKDPGAEDKFKEISNAYEVLSDDQKKAIYDRFGEDGLKGGMGGMGGMGGMGGMGGMSDPFDLFESLFGGGGMGGMGGMGGMGGMGGRSQARNRPTQGDDERYDLEIDFLEAVFGVEKELDTMRLENCDKCSGSGVKAGTKPTTCGTCGGQGQVVATVRTPLGNFQQVTGCQACGGTGQSSTPCPSCGGDGRVRRSKKIQLRVPPGVDKGSRLRVRGEGNAGRRGGPPGDLYVFINVRDDPELKRFDNVNISSTVTVPYTKAILGSTVKVRTVDGPVDLKIPAGVQPQATLLMAKRGVPRLGNDSARGDHYVTVKVTIPSKLSDEERAMIEKLDEKQK

SEQ ID NO: 9275 - protein, 339 aa, Salmonella enterica
MNQSNASMTVIGAGSYGTALAITLARNGHQVVLWGHDPKHIATLEHDRCNVAFLPDVPFPDTLHLESDLATALAASRNILVVVPSHVFSDVLRQIKPLMRPDARLVWATKGLEAETGRLLQDVAREALGDQIPLAVISGPTFAKELAAGLPTAISLASTDETFADDLQQLLHCGKSFRVYINADFIGVQLGGAVKNVIAIGAGMSDGIGFGANARTALITRGLTEMSRLGAALGADPATFMGMAGLGDLVLTCTDNQSRNRRFGMMLGQGMDVKGAQDKIGQVVEGYRNTKEVRELAHRFGVEMPITEEIYQVLYCGKNAREAALTLLGRARKEELSRH

SEQ ID NO: 9276 - protein, 310 aa, Arabidopsis thaliana
  misc_feature (58)..(58): Xaa can be any naturally occurring amino acid
MGKASRDKRDIYYRKAKEEGWRARSAFKLLQIDEEFNIFEGVKRVVDLCAAPGSWSQXVLSRQLYLPAKSSAESKDGDLPLIVAIDLQPMAPIEGVIQVQGDITNARTAEVVIRHFDGCKADLVVCDGAPDVTGLHDMDEFVQSQLILAGLTIVTHILKEGGKFIAKIFRGKDTSLLYCQLKLFFPTVTFAKPKSSRNSSIEAFAVCENYSPPEGFNPRDLHRLLEKVGSPSGGSDLDCSSGWLEGPNKVYIPFLACGDLTGYDSDRSYPLPREADGSSYQSLDPIQPPIAPPYKRALELKKASAQSFNS

SEQ ID NO: 9277 - protein, 268 aa, Oryza sativa
MAVAAVARGDMSADRTECADQLVGLAPCLQYVQGEAKAPAPDCCGGLRQVLGKSPKCLCVLVKDKDDPNLGIKINATLALALPCACGATHANVSHCPQLLHIPPNSKDAAIFSPGGDKGSPAAPDHVVLQITDHDPYYIVEFTAVTNLPIETKNTGLDGARSISGRLYWTMPATFMLPRKRSKDIEKKEGVRGFGELNSKPHLMDTQVKLAVVVKVMGRTGSRGQVTQVRVKFLDDQNRLIMRNVKGPVREGDILTLLESEREARRLR

SEQ ID NO: 9278 - protein, 842 aa, Arabidopsis thaliana
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 9279 - protein, 484 aa, Oryza sativa
  misc_feature (464)..(464): Xaa can be any naturally occurring amino acid
MVSYCVHLHTTNQLVLIGSIFCSCSSSKVYYSEQQREGMEQTLDVPRSLRLPTPKAQQQMDEFWRDRQKEIETTKDFSEHAIPMARLKKIASSQKGNMMMSFDMPAFLSKMCELFVQELAVRAWASAQSHNRCIILDTDIAEAIASTESYDFLVDILHNHRVKHKSTPCSTLTTKRCRLVDQPSTSHMPYQHQLPLFAPTYTPAIPITPSLMPPISHYIPFQYPSLSQEVSPMMASAPIVNRSMLLIHNIARGLGLQGNNISTFANNNIPDNIIGCSSPAVLASMMSPALLDVAGASLNPPNSHSICTMNMINSSDPSGSSIGDINVANQASLAPSEHFNPAILQESSCPSFLYNNNNDTIVVVPEGVDISGTMDVASDVAAIVINGQEEEHERKTNVEHHQQNEIYESIDIGIINASVADGNKCSIRWDELGTADDSLLDKFLEEFQARNDGVLHSGIVLHEXPFLGDVILANPSSSNANISN

SEQ ID NO: 9280 - protein, 247 aa, Pseudomonas syringae
MSQVNMRDMLKAGCHFGHQTRYWNPKMGKYIFGARNKIHIINLEKTLPMFNEALTFVERLASGKNKILFVGTKRSAGKIVAEEAARCGSPYVDHRWLGGMLTNFKTIRQSIKRLRELEVQAEDGTFAKLTKKEALMRTRDLEKLDRSLGGIKDMGGLPDALFVIDVDHERIAITEANKLGIPVIGVVDTNSSPEGVDYIIPGNDDAIRAIQLYMGSMADAVIRGRNNVAGGTDVFVEEAPAAAAVEG

SEQ ID NO: 9281 - protein, 383 aa, Francisella tularensis
MGASQKNQELIGGLILFSAALLAIVVNNSPLASYYAMLETINVKLGIENLVIDKNLMHWINDGLMAIYFLYIGLEIKREIIVGTLSKPSNIITPAIAAFAGLAMPSLIYLSINHDIKVINGWAIPSATDIAFTLGILALLGTRVPAKLKLLVITIAIFDDIAAIAIIAIFYTKSLSLLSLSLGTLFILAMIICNRIFKINRSSVYVVLGFFAWFCTIKSGVHATLAGFTTALCIPFRENDKDSPANFMEDSLHPWIIYFILPVFAFANAGISFSGISFSILFEPITLGIIWGLFVGKQLGIFSILAVFKKLKWFKLGESFSNLQLYGISLLCGIGFTMSLFIGVLAFNDTHLLNAIKIGVVVGSVLSGFFGYIVLRFIVTNPS

SEQ ID NO: 9282 - protein, 103 aa, Elaeis guineensis
MSGRGKGGKGLGKGGAKRPRKVLRDNIQGITKPAIRRLARRGGVKRISGLIYEETRGVLKIFLENVIRDAVTYTEHARRKTVTAMDVVYALKRQGRTLYGFGG

SEQ ID NO: 9283 - protein, 588 aa, Ustilago maydis
MASQEDTDDLYADLYGAATSEAGDEAFPRGEGGDDKAHAGDEQDLTGYEDSNNKNGNSSEKAEEKPTVAASTGSFIPPASSAPAQQSDTGLQIKGSFIPPPVVNSPAAHSQSDVRDLTPASHNDASSNQQSLSHQTQVADDRGEGQNAGTERQGLDNRSAMPHEMPEEGKMFIGGLNWDTTEDSLRRYFSQFGEVGNCAIMRDNMTGRSRGFAFLNFVDPKAVNTVMVREHYLDGKVIDPKRAIPRPQHNQQGGGHHNNYNNGGGGGGGGGSYSASSQKLFVGGLPPSVTPATFRTFFEQFGTLSDCTCMMDRETGKPRGFGFLTYADDSSLNHVLNTRPIVFDGKEVDVKRAQSKNDPQSLQIRRQQRMDNPEMAYGMQQGGAGARFNNYNTGASGGGGGMGGNAWQMNPMMMGMMGQGGDMSQMYQNMGWGNQNWNPQMAWQQMMASMAGNTGGGMDMGAMMNNMGMMGSMGGTMGSMGGMGSMSPPSMKQSMSPTVNAASAVPTGASAGGDDRTERSGSASAPSSSRQQRGGSVHNGASRPPPMGPRHDRERSPGRGGDGGYRRERSPDRRDDNRRYDSGQRNRY

SEQ ID NO: 9284 - protein, 72 aa, Spiroplasma kunkelii
MAKTDLLEVQGTILEVLPNTMFKVQLKNGATILAHVSGKIRMNYIRILPGDTVVVEMSPYDLERGRIVFRHK

SEQ ID NO: 9285 - protein, 829 aa, Pseudomonas aeruginosa
MNSPRPTPPPFAAAAAGLPILVRASNLVTEADVTSLVWNKAPCRFCGTGCSVMVATRDGQVVATHGDIKAEVNRGINCVKGYFLSKIMYGSDRLTRPLLRMKDGKFDKQGEFQPISWEQAFDIMAEKFKAALKAKGPESVGMFGSGQWTVWEGYAANKLFKAGLRSNNIDPNARHCMASAVMGFMRSFGMDEPMGCYDDIEATDSFVLWGSNMAEMHPVLWSRVTDRRLSAPQVKVAVLSTFEHRSFELADLPMVFKPQTDLIILNYIANHIIESGAVNRDFVERHVRFAHGAEDIGYGLRPDDPLEKKAKNADKANTWSDIDFKAFAEFVKPYTLERTARESGVPAERLKALAELYADPKRKVVSFWTMGFNQHTRGVWANNLIYNIHLLTGKISEPGNSPFSLTGQPSACGTAREVGTFSHRLPADLVVTNPKHRETAEKIWKVPAGTIQEKVGFHAVQQSRMLKDGVLNVYWTQVSNNMQAGPNVMQEVLPGWRNPDNFVIVSDVYPTVSAQAADLILPSAMWVEKEGAFGNAERRTQFWHQLVKAPGEAKSDLWQLVEFSKRFTTDEVWPAELLAKAPELKGKTLYDVLFRNGQVDRFPASDLAKGYANDEVDAFGFYIQKGLFEEYAAFGRGHGHDLAPFDAYHEARGLRWPVVDGKETRWRYREGYDPYVSKGSGVQFYGYPDKKAIVFALPYEPPAEAPDQDYPFWLATGRVLEHWHTGSMTARVPELYKAVPDALVYMHPEDARQLKLRRGSEVKVVSRRGEIRARVETRGRNKPPQGLVFVPFFDANKLINKVTLDATDPISKQTDYKKCAVRIELLNLA

SEQ ID NO: 9286 - protein, 474 aa, Ostreococcus tauri
MATNGKEVLEVLRGRPKGVAAAAEDVSVDMILLDVLMPALDGEVELVEVCKSNEALRGVPIVIMSTVDERKACGTRYEHSGAAGFLTKPVNRTELKESLSHTRMLKSHESGSAENDGSGNDPNVGSAKSSLTKLTNGEKAAGGSGDGGSGGAIMFDCITKVTRNRDVARLRRWIDGPVERAVPETAALEDPVKAPEAVAVRTRARFRGLSVQLIKAHGGATTMLELSLPEHSSEHVVVRRSNSRSAFKGFQTYLKSEKKESSVQMMSLDLTQQQHQSFYEASSMMPPADFARFYGPIMPAGMPPPPMDLPLPPPPYIDMNQFTAAAFTSASIRPDMMDSTANPFWSVLQTAADHTQQTSSSQAAEHRAAAIRRFLKKRKERNFDKKVRYASRQQLAASRPRLRGQFVRNAEETTTENGSNGSDGKKSNEFNASAAKGEVQGREEQYVDRHGSNTGTSNEGSKEGSRSSSRDGSK

SEQ ID NO: 9287 - protein, 119 aa, Leptospira interrogans
MSLICIVGKKEKESKMALAEVNDTNFKSETSGGLVLIDCWAEWCGPCRMVAPVLEELSGELDGLVKIKKLNVDDNQDTAQSLGISSIPTLLLYKDGQLVDKVIGALPKAQIKNFIERHK

SEQ ID NO: 9288 - protein, 218 aa, Brucella suis
MSFFDSYRKKMQMPSKEEVLPGRVQPIPTAAAHFVSGHPLKGPWPDGMKQVLFGMGCFWGAERLFWQVPGVYVTAVGYAGGITPNPTYEETCTGLTGHAEVVLVVYDPKVVTLNELLALFWEEHDPTQGMRQGNDIGTTYRSVIYTFNAVDRAVAEKSRDAYSQALASRGLGPVTTQIADAPDFYYAEDYHQQYLAKNPDGYCGLRGTDVSCPIPLAH

SEQ ID NO: 9289 - protein, 142 aa, Coffea canephora
RRHNSATPEEQIKMVENCGFPSLDSLIDATVPKSIRLDGMTFSKFDEGLTEAQMIDHMEKLASKNKVFKSYIGMGYYNTFVPPVILRNLLENPAWYTQYTPYQAEISQGRLESLLNYQTMIADLTGLPMSNASLLDEGTAAA

SEQ ID NO: 9290 - protein, 1165 aa, Streptococcus pyogenes
MKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 9291 - protein, 475 aa, Gloeobacter violaceus
MEVKERTNPAWAGAIAQPGREFAPAPLAVLEGSLPVGLRGSLYRNGPGRLERGGVRVGHWFDGDGAILAVHFGGGEAQGVYRYVQTAGLQAEERAGRYLYPNYGMSAPGAIWERWGKPVKNAANTSVLALPDRLLALWEGGLPHALDLHTLQTRGLDALGGLGPSGSYSAHPKRDPRTGEIYNFGVGIGPAAVLHLYRSDATGRVIQKGKIALEGIPLVHDFVLAGRYLVFCVPPVRINPLPVLLGLASFSEAMAWQPDKGTAIYIVDRETLQLVGRAEAPAWFQWHFANGHEAGGELVIALCRYADFATNRYLQEFAGGRTQTASPSQLWQLRLDAATGRVRGFEPLLERPCEFPTVDPRSVGLQSRHIYLGLHRVGSQVGSDFFQVLARFDCDSGQAVETQLGDGRYPSEPLFVADADEPERGWVLSVIYDAGLHRSELWIFDADALDAPPVCRLALPEVIPHSFHGTWRPVP

SEQ ID NO: 9292 - protein, 537 aa, Streptococcus pyogenes
MNNHWWHKATIYQIYPRSFKDTSGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDYYIWRDEPNNLMSIFSGSAWELDEASGQYYLHLFSKKQPDLNWENAQLRQKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAKELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSEAKETWLPVNPNYQDINVADALADPDSIFYTYQKLIALRKEQDWLVEADYHLLPTADKVFAYQRQLGEETYVIVVNVSDEEQVFATDLAGAQVIIANTDVDTVLETKHLQPWDAFCLKLKA

SEQ ID NO: 9293 - protein, 171 aa, Oryza sativa
  misc_feature (55)..(55): Xaa can be any naturally occurring amino acid
  misc_feature (96)..(96): Xaa can be any naturally occurring amino acid
  misc_feature (118)..(118): Xaa can be any naturally occurring amino acid
MALVEGNNGVSGGAVSFSEEQEALVLKSWAIMKKDSANIGLRFFLKIFEVAPSAXQMFSFLRNSDVPLEKNPKLKTHAMSVFVMTCEAAAQLRKAXGKVTVRDTTLKRLGATHFKYGXVGDAHFEVTRFALLETIKEAVPVDMWSPAMKSAWSEAYNQLVAAIKQEMKPAE

SEQ ID NO: 9294 - protein, 639 aa, Unknown
  Chrysanthemum x morifolium
MDSCDCFETQWPADELLVKYQYISDFFIAFAYFSIPLELIYFVQKSAFFPYRWVLMQFGAFIVLCGATHFINLWTFSSHSKTVAIVMTVAKLSTAFVSCVTALMLVHIIPDLLSVKTRELFLKQRAEDLDREMGLIIKQEETGRHVRMLTHEIRSTLDRHTILKTTLIELGRTLDLEECVLWMPSTKGMILEVSHSLHNLIPFRSTVPINLPIITEVFNSAEAIRIPHNCPLARIRTPVGSYIPPEVVAVRVPLLHLSNFEIDNWPDNSAKSYAVMVLILPMNGVRKWRDHEMELVTVVADQVAVALSHAAILEESMRARDQLMEQNFALNLARQEAEMAIHARNDFLAVMNHEMRTPMHAIIALSSLLLETELTPDQRAMIETILKSSNLLAALVNDVLDLSRLEDGSLELESEVFNLHGLFKEVVTLINPIASVKNTSMALNCDLDLPAFGIGDEKRLMQIILNVVGNAVKFTKGGHVSIQASILSPEYLQEWRTPEFCPTLTEGLFYLLAQVKDSGSGIKQQDIPHIFTKFSEPRSASNRSGGAGLGLAICKRFVNLMGGHIWIESGGLGKGTTVAFLVKLGLCNYPNDPTMQRLVPRTVPKARPHQGSGELIQHRQLDREGYQGAASFPLYNRSM

SEQ ID NO: 9295 - protein, 235 aa, Nephroselmis olivacea
MKNTKKNQEIFVESIKHIDSFFKLSAHIGNKKWHPTMSSNLIASRNAVYILDISKTIKGLFNALDVISSIVSQKGHILFINSNPLYNKLLQKTCELTEQSYVNNRWVGGTLTNWPIISKEIETYKKVVTQLHLYTSLFYVSTPRYEKMKKSFQGFQTPISKPDLLIVLNPSKNKEAINEAWVLNIPVIAIVDSDTNLSKITYPIPGNNSSYEFIYYCLNIIVKTITNKYNTSVRD

SEQ ID NO: 9296 - protein, 174 aa, Triticum aestivum
  misc_feature (166)..(166): Xaa can be any naturally occurring amino acid
MSNPESSPQAAASSTSPPSHAGHIHTPLCRSCGAPAAAPAPAPWTGDSPPPAYRPIRMPAINAPTNTAAIVLSPVPQPLPVPPALPPFAFQAPAKRIASPDDIARFKDSTHGRHFLGFVASLSASVHGRKLPDPLPSPPSPAVSALLDLISALSAFVASTPPFPHXLRYGNPAF

SEQ ID NO: 9297 - protein, 639 aa, Unknown
  Chrysanthemum x morifolium
MDSCDCFETQWPADELLVKYQYISDFFIAFAYFSIPLELIYFVQKSAFFPYRWVLMQFGAFIVLCGATHFINLWTFSSHSKTVAIVMTVAKLSTAFVSCVTALMLVHIIPDLLSVKTRELFLKQRAEDLDREMGLIIKQEETGRHVRMLTHEIRSTLDRHTILKTTLIELGRTLDLEECVLWMPSTKGMILEVSHSLHNLIPFRSTVPINLPIITEVFNSAEAIRIPHNCPLARIRTPVGSYIPPEVVAVRVPLLHLSNFEIDNWPDNSAKSYAVMVLILPMNGVRKWRDHEMELVTVVADQVAVALSHAAILEESMRARDQLMEQNFALNLARQEAEMAIHARNDFLAVMNHEMRTPMHAIIALSSLLLETELTPDQRAMIETILKSSNLLAALVNDVLDLSRLEDGSLELESEVFNLHGLFKEVVTLINPIASVKNTSMALNCDLDLPAFGIGDEKRLMQIILNVVGNAVKFTKGGHVSIQASILSPEYLQEWRTPEFCPTLTEGLFYLLVQVKDSGSGIKQQDIPHIFTKFSEPRSASNRSGGAGLGLAICKRFVNLMGGHIWIESGGLGKGTTVAFLVKLGLCNYPNDPTMQQLVPRTVPKARPHQGSGELIQHRQLDREGYQGAASFPLYNRSM

SEQ ID NO: 9298 - protein, 417 aa, Xylella fastidiosa
MFPRDARLDMYDPELAKAIAAEVMRQEDHVELIASENYCSTLVMQVQGSQLTNKYAEGYSGKRYYGGCECVDIAEQLAIERAKQLFGADYANVQPHSGSQANQAVYFALLQPGDTILGMSLAHGGHLTHGANVNVSGKLFNAVQYGVNGQGLIDYEAVESLALEHRPKMVVAGFSAYSQKIDWARFRAIADQVGAYLLVDMAHVAGLVAACVYPNPLPHAHVVTSTTHKTLRGPRGGIIVAQAPQEALVKKLQSIVFPGIQGGPLMHVIAAKAVAFKEALEPAFKVYQQQVVKNAKAMAETLMLRGYKIVSGGTENHLMLVDMIGRDVSGKDAEGALGQAHITVNKNAVPDDPRSPFVTSGLRLGTPAVTTRGYQEQDCVDLAHWIADVLDAPADATVIAAVREKVAAQCRKYPVYR

SEQ ID NO: 9299 - protein, 271 aa, Onion yellows
MAVVTTKQLLESGVYFGHATRKWNPKMKPYIFTSRNGIHIINLKKTSEEIEKAYQELLNIITSGGKALFLGTKKQIQSAIREEAQRSQQYYVDHRWLGGTLTNFKTILKRIELLHLLHKQEEEGLWKKLPKKEVVQLKRKRDKLEKFLGGIKDMKDLPQAIFVVDPEKESIAVAEARKLGIKVFGIVDTNCDPDLVDYIIPANDDAIRGVKLIIWLMANACVEGTGGVAEKAETFDAKNPLKPQNYNAPNKRPYQDSPRKPSYQNQNQNQI

SEQ ID NO: 9300 - protein, 534 aa, Unknown
  Candidatus Desulfococcus oleovorans Hxd3
MSFFKSNIFKLCIALSMGVIVLVLPRPEGTRFKISGDPDQRVLQSVESAFTLVAEKSSKTAYVVEARNPGTPEATAGFLRAAVDGLAVAGVADAEAPAMTVDYVDGLSPKAKRFLAMLAVLVFLFIVEPVPLEITAICIGVFLVIAGVSDVKDAWAPYMHPVVLFIMCCLIFAISLDKAGITRRMGYFIIKRAGTSVTKFTFIIATGLGLASGVMHDAAACAIGIVTMIPMMKAAGIEPHSNTAKFMMISLPFACSAGGMSTLIGGGRCMVSAAFLKEYTGIEITFFEWIKYCLPAGIITVPIAVLIVYFVFRPNPKYKLPQLEKAIGPLTPLEIKTLVIIGLTFATWLTKGLHGIDYSITGMLGVSALVVAGILKWEDIHENLEWGTALFIFGGGISLGLAMGYSGAADYFANLFFPLVEGKGWFVLFAGVAVFGALVTNVMANVAAAALILPIVIPMALMEGVDPTVLALCLGTATSFALLLVIGCPPNAIAYSYRYFKSSDLTKVGLVATPILLAALILVAATWWKILGLV

SEQ ID NO: 9301 - protein, 721 aa, Unknown
  Synechococcus sp. WH 7805
MQGQTQSISFDGREIRLTTGRYAPQAGGSVMIECGDTSVLVTATRSSGREGIDFLPLICDYEERLYAAGRIPGSFMRREGRPPERATLISRLIDRPMRPLFPSWLRDDLQIVATCMSLDERVPADVLSVTGASMATLLAGIPFYGPMAAVRVGLLGDDFVLNPSYREIERGDLDLVVAGTPEGIVMVEAGANQLPEQDVIEAIDFGYEAVCELIKAQESILKDAGIEQVKPEAPDADTTLPLYLEKACSKSIGEVLGQFAQSKADRDSKLDAIRSNTAEAIEGLKDTDPVRQLVSSNSKALPTSFKALTKKLMRQQIVKDGKRVDGRTLDEVRPISAAAGVLPKRVHGSGLFQRGLTQVLSTATLGTPSDAQEMDDLNPNTEKTYLHHYNFPPYSVGETKPMRSPGRREIGHGALAERAIIPVLPAKDTFPYVVRVVSEVLSSNGSTSMGSVCGSTLALMDAGVPLKAPVSGAAMGLIKEGDEVRILTDIQGIEDFLGDMDFKVAGTDKGITALQMDMKITGLAMNTIAEAINKARPARLHILEKMMEAIDTPRDGLSPHAPRLLSFRIDPELIGTVIGPGGRTIKGITERTNTKIDIEDSGIVTIASHDGAAADEAQKIIEGLTRKVNEGEVFSGAITRIIPIGAFVEILPGKEGMIHISQLSEARVEKVEDVVKVGDEVTVRVREIDNRGRINLTLRGVPQNGEGTEPAPVPTPVAPLS

SEQ ID NO: 9302 - protein, 484 aa, Legionella pneumophila
MLIFELSKTGRQAKAQIPRAVSKNYSIPEEFQRKSPPRLPACSELQVVRHFTCLSQKNFSIDTNFYPLGSCTMKYNPRGVHKAASLPGFINRHPLAMDNESQGFLETLYKLQNYISEITGMPGVSLTPMAGSQGEFAGVAMIKAYHQSRGDTARDEILIPDAAHGTNPASAVMCGFKVVEIATAPDGDIDLDELKRKVGPRTAGIMLTNPSTLGLFMRQIKEIANLVHQAGGLLYYDGANLNAILGKVRPGDMGFDVMHLNLHKTFATPHGGGGPGAGPVAVGKRLIPYMPLPVVKKTDSGYHWATRQDYPQSIGRLSCFMGNAGILLRAYFYMLVLGKEGLLRVSEFATLNANYLLKELTKVGYTAAYPGRRASHEFILTLNSEKKNYDVTAMDFAKRLLDYGVHAPTTYFPLLVPECLLIEPPETESKEELDAFVAVMKTIREEAIKQPDILKAAPHTLPVKRLDDVKAARELDLNYFATHE

SEQ ID NO: 9303 - protein, 598 aa, Neurospora crassa
MDNTNRPHLNLGTNDTRMAPNDRTYPTTPSTFPQPVFPGQQAGGSQQYNQAYAQSGNYYQQNHNDPNTGLAHQFAHQNIGSAGRASPYGSRGPSPAQRPRTSGNSGQQQTYGNYLSAPMPSNTQTEFAPAPERNPDKYGPNANNNQKKCSQLASDFFKDSVKRARERNQRQSEMEQKLGETNDARRRESIWSTAGRKEGQYLRFLRTKDKPENYQTIKIIGKGAFGEVKLVQKKADGKVYAMKSLIKTEMFKKDQLAHVRAERDILAESDSPWVVKLYTTFQDANFLYMLMEFLPGGDLMTMLIKYEIFSEDITRFYIAEIVLAIDAVHKLGFIHRDIKPDNILLDRGGHVKLTDFGLSTGFHKLHDNNYYTQLLQGKSNKPRDNRNSVAIDQINLTVSNRAQINDWRRSRRLMAYSTVGTPDYIAPEIFTGHGYSFDCDWWSLGTIMFECLVGWPPFCAEDSHDTYRKIVNWRHSLYFPDDITLGVDAENLIRSLICNTENRLGRGGAHEIKSHAFFRGVEFDSLRRIRAPFEPRLTSAIDTTYFPTDEIDQTDNATLLKAQQAARGAAAPAQQEESPELSLPFIGYTFKRFDNNFR

SEQ ID NO: 9304 - protein, 352 aa, Escherichia coli
MLYYLHIRWITSMCKKTSGNRFHFAFQSSEVVMIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIELLLAGYGGRCVGIQNEQLVHHDIIDAIENMKRPFKGDWLDCAKKLY

SEQ ID NO: 9305 - protein, 378 aa, Schizosaccharomyces pombe
MSPTLVVDQENSEEFNTSSFEGPEKLLELWFSAPIKTNLSAGEKANLGLKAVSRNDWDDMLAQAQCKVLSVVNSEEIDAYLLSESSMFVFAHKIILKTCGTTTLLASLPRLLEIASSVGFDRPLRIFYSRKNFLYPERQLAPHTSWEEEVRYLQLFFPSGCSYVVGPTNKNHWHLFSDLADDYSLLEDSLDPEDETLEVLMTDMSPERSLQFYAPSLDVVRSARGDDYVREKNNLSGGHILGSYVADESGVRDLCSTSDKKAVLDAFQFEPIGFSSNMIYKDRYATIHVTPQEHCSYASFETNVSQFQFGRSISETIEKTVKTFGANKFCLTLFQAKGASQEKHFSAKLKSFSSYKREEFIVYDFPGYDLIFASFTAV

SEQ ID NO: 9306 - protein, 142 aa, Coffea congensis
RRDNSATPEEQIKMVENCGFPSLDSLIDATVPKSIRLDGMTFSKFDEGLTEAQMIDHMEKLASKNKVFKSYIGMGYYNTFVPPVILRNLLENPAWYTQYTPYQAEISQGRLESLLNYQTMIADLTGLPMSNASLLDEGTAAA

SEQ ID NO: 9307 - protein, 451 aa, Aspergillus fumigatus
MMACSPKCRAKSRPIHILQNQIVLDVNIYMMPSHATMSSPPAGTKLDLSKKLSELRASRRSHSGPSPREPTPVTPPLPSPPDLSTHTYTRPVRRILSRKDHETFLASSTYTLVVSFTFSLSDSVRGRAVTDNKDQPASPNISRILSVIDTIRQLVDKHPSIDQGGSRFGNPAFRDLFDDVAAQNATWHREIIGLQNADAIEEVSSYLVHSLGSRDRLDYGSGHELNFMMWLLCLRQMQMISTADFPMIVFRVYLEYMRLMRQVQMTYYLEPAGSHGVWGLDDYHFLPFLFGAAQLVDHPYITPLAIHNTAVLDEEGDKYIYLDQVRWVDSVKTVKGLRWHSPMLDDISGAKNWLKIEGGMKKMFIKEVLGKLPIMQHFLFGSLLPADPSMGERSDDAQEDDLHDHGNGNPHARHTDHFGDCCGIKVPSTVAAGAEMRKRIGGTGLRPIPFD

SEQ ID NO: 9308 - protein, 335 aa, Bdellovibrio bacteriovorus
MKAPVRVAVTGAAGQIGYALLFRIASGAMLGADQPVILQLLEIPDEKAQKALKGVMMELEDCAFPLLHSMIATGDPAVAFKDADVALLVGARPRGPGMERKDLLTANGQIFTVQGEAIGKYANPNVKVLVVGNPANTNAYIAMKSAMKHGRVKAKNFTAMLRLDHNRALSQLATKTGKPVASFKKVAVWGNHSPTMYPDVRFATADGAKVPELLKLGTAEGDAWNKDTFIPTVGKRGAAIIEARGLSSAASAASAAVDHIRDWWLGTNGEWVTMGIPSDGSYDIPEGIMYGFPVTCKNGEYEIVKGLEIDAFSREKMNNTLKELNEEKDAVASML

SEQ ID NO: 9309 - protein, 385 aa, Caulobacter crescentus
MRDYYEILGVTRTIDEAGLKSAFRKLAMEHHPDRNGGCENAAGRFKEINEAYSVLSDPQKRAAYDRFGHAGVNGPQGGPGGFGGQGFDASDIFNDVFGDVFGEMFGGGRRQSNAPQRGQDLRYDLEITLEQAYAGAEVEITVPAAMTCEVCEGSGAKPGTSPSVCGTCGGAGRVRATQGFFAVERGCPRCGGSGRLVLDPCSNCHGHGQVRRERILSVRIPAGVDDGARIRLAGEGDAGARGGPRGDLYIFLSVTPHELFERDGLDLLCTVPVPMTTAALGGEIDAPCLLGGESCDGECKVKVHVPEGAQTGKTVRLKGKGMPSLRSRQRGDLVVELFVETPTHLSARQKELMRELAGLCGEKQNPKSANFVGKAKRFWEEVTGS

SEQ ID NO: 9310 - protein, 361 aa, Unknown
  Synechocystis sp. PCC 6803
MGEIKRIGILTSGGDCAGLNAVIRSVVHHAIGTYGWEVIGIQEATQGLMENPSKAIALHRDNIDHLLMMGGTFLGTTNKGNPFAFPMADGTVRDRTEDIIAGYRQLGLDALIGIGGDGSLAILRRIAQQGGINLVGIPKTIDNDVGATEISIGFDTATNIATEALDRLHFTAASHNRVMVLEVMGRDAGHIALAAGIGGGADIILIPEIPYRIQSVCNKIRQRQAEGKNFCLVMVSEAVRTELGDQVKQIQQFGEDRYGGIGKYIAEQIAQRTGAETRVTVLGHIQRGGIPSPFDRLLGSVFGVAAVDLIAEGKFDHMVAWRNRQTISVPIEEAIQTYQTVQLDGTLVKTARGLGICLGND

SEQ ID NO: 9311 - protein, 281 aa, Arabidopsis thaliana
MTTFNYYLAEHPTIVNFRWSPTQSYASTWSFLFTAVSSYIIAAVTLHLLLLITLSLSNRRRGFSLGPIPALHSLTISIISAVIFVGILLSAAAEIRDTRWLWRRTRTTALQWFLCFPVGTRASGRVFFWSYAFYLSRFLHLFRTFFSVIRRRKLSFFQLINQSSLLCISFLWLEYSQSFQVVAILLTTVSYAVVYGYRFWTEIGLRGACFPFVGNCQAILLGCMTVCHVGVLCIHLVKRGGCNGIGAWLFNSVLNAVITLLYLKFYCKTRSMMTKANHNTT

SEQ ID NO: 9312 - protein, 100 aa, Magnaporthe grisea
MPTQPARGGPRSSMGGSAPTANMGPRIGTSGKVSGKKLLHGAGGKRHRRLARRGGVKRLSGMIYDETRGAMKQYLERILRDCVAYCDYRRAKTVTVHDVR

SEQ ID NO: 9313 - protein, 328 aa, Xanthobacter autotrophicus
MAGPAAKIVPAAQPRPGRGRVYDSITETIGNTPLVRLKRLAELRGAKAEILAKLEFFNPISSVKDRIGVAMIEAMEAAGVLDQDTVLVEPTSGNTGIALAFVAAARGYRLILVMPESMSVERRKMLAILGAELVLTPANLGMKGAVARAEQLIAELPKAAMPQQFKNKANPDIHRRTTAEEIWNDTDGKVDAVVAGVGTGGTITGIGQVLKPRKASLKMIAVEPEDSPVLSGGSPGPHKIQGIGAGFVPDVLDRSIIDEVVTVGNQTAFDTARALARYEGIPGGISSGAAVAAALEIAVRDDMAGKSIVVIVPSFAERYLSTALFEGL

SEQ ID NO: 9314 - protein, 539 aa, Bacillus halodurans
MNEAMIKFNELQIGEEIKKAIIEMGFEEPSPIQAKAIPAILAGGDVIGQAQTGTGKTAAFGIPVVEKVSTGRHVQALILTPTRELAIQVSGEIQKLSKHKKIRTLPIYGGQSIVHQIKALKQGVQVVIGTPGRIIDHLRRKTLILDHVNTVILDEADEMLDMGFIDDIESILRQVKNERQTLLFSATMPPAIKKLSRKYMNDPQTVSINRREVTAPSIDQFYYKVLERNKLDSLCRIIDSEQIDLGILFCRTKKGVAELTEALQARGYIADGLHGDLTQSQRDAVMRKFRDSSIEFLIATDVAARGIDVGNVSHVINYDIPQDPESYVHRIGRTGRAGRKGLALTLVTPREMKHLRSIEQEIKMSIPSQEVPTIEDVVEKQKESWKKQIAHRIEKGSNQKHLFEQMTEELMAEYDSKEVISALLQLNYAMDTAPEDAGYSFGETGGAKGMVRFFINVGRNVNMSPKILVEEIAELVGIPGKAIGRIDIFEKFTFVEVPEEVAPFVYEALRYSRINGARVNLEPAKPRPKRESQRRTFQK

SEQ ID NO: 9315 - protein, 331 aa, Clostridium perfringens
MSKVAFLGAGSFGTSLGILLGNKGVTVSLWDRDENVINDINVNRKNDKYIKDLTIPTNVTAYKDLDEALNGAEYVVLAVPSHVIRTACKNLKGKINDDVIIINIAKGIEEGTNLRLSQVINQELPNNKVVVLSGPSHAEEVSKGIPTTLVASSECMECAEKVQDLFMDKNFRIYTNDDIIGVEIGGAVKNIIALAAGVCDGIGYGDNSKAALMTRGMAEIARIGIKMGGKAETFFGLTGMGDLIVTCTSMHSRNRRAGILIGQGKTAEEAIKEVGMVVEGIKACKAFYELKEKEGVTMPITDIAYKVLFEGAKAENAVSLLMERDKKKEEI

SEQ ID NO: 9316 - protein, 462 aa, Lactobacillus johnsonii
MQQFGVIGLSVMGKNLALNVKNHGYSVSGFSIDKPEVDALAKYEDKNLKPTYTWEEFVNSLEKPRKILIQIMAGKPVDETLQKLLPLLDKGDILIDGGNSNFHDTNRRYKEMEKHGIHFIGMGVSGGEEGALNGPALMPGGDEKAYEEVAPILEAMAAKTPTGQPCVGYIGPAGSGHYVKMVHNGIEYGIMQIISEVYDVLRTVGHYSNNEMSEIFKNWDKGGLQAYLIEITSKVLKQKDNLTDDHIIDHILNEASYKGTGNWMLEDAIRLGAPITVIAEAVLARFMSKATLRNDPEPKIDPEKAPKDLVDQLAKALYLAMAVSYGQGFEQLTMAAKAYNWRLHYSTIAQNWEAGCIIRSQMLHDIKFAYNADKDLPNLFKAPFFDKVKKENIGALRDVVKIAADAGVPTPTLSAALNYLESIFNPRLPQNIIQGQRDYFGAHTYQRNDRPGTFHTEWYEEK

SEQ ID NO: 9317 - protein, 496 aa, Prochlorococcus marinus
MDNSKKTPEIERYSGQFDQTDWSSAYCNVEKECTNIKLKLISGQVPPRLKGSFYRNGPGKLERNGQWVHHPFDGDGMITLMRFNNGEVTFSNRFVKTQAWEEEEKADKFLYRGVFGTKKTGLAISNFGDVRLKNIANTHVVKLGNKLLALWEAAGPHALDPETLETHGLSSLNGALSPKEAFSAHPRFDPGHHKDPRMVTFGVSTGPKSTIRLMEFATKGSNAGNLISDRKDSFNGFAFLHDFAITPNWAIFLQNAMDFNPLPFIIGQKGAAQCLSSKSDGKGKFWLIPRHSGSFSNQPAKIIDAPDGFVFHHLNAWEENQSVIIESIFYKDFPTIGPNEDFRNIDFNQLPAGILKRCRINLLTNETEQETLSTQCCEFAMVNPYFQGLSAKYCWMATAAKNIGNGPLQAIKKLNLINKGSCEWSSSPRGFVSEPLMVPEDSTGNEDDGWILVMTWNGKFQTNELVILNANNLSHQATLEVPIKIPYGLHGSWSDS

SEQ ID NO: 9318 - protein, 722 aa, Chromobacterium violaceum
MNQDRETLVFNKITKTFQFGRQTVTLETGEIARQASGSVVVSVDDTVVMVSVVGGKNVKPGQDFFPLTVDYLERTYAAGKIPGGFFKREGKQSEKEVLTSRLIDRPIRPLFPEGFYHDVQIVATVLSLNPEVDSDIPAMIGASAALAISGLPFAGPIGAARVGYANGEYILNPTKTELQTSQMDLVVAGTSRAVLMVESEAKELPEAVMLGAVVFGHEQMQAAIKAINELADEVNPVMFDWAAPAKDEALIAQIRGIAGEKLAEAFRLRQKQARTVAINEAWDAVKAGLINEETDTLKANEIKGIFKSLEAEIVRGQILAGEARIDGRDTRTVRPISIRNNVLPRTHGSALFTRGETQALVVATLGTKQDEQIIDALAGEYTERFMLHYNFPPYSTGEAGRMGPPKRREIGHGRLAKRALVAVLPPEDEFGYSMRVVSEITESNGSSSMASVCGGCLSLLSAGVPLKAHVAGIAMGLILEGNRFAVLTDILGDEDHLGDMDFKVAGTAAGVTALQMDIKIQGITKEIMQVALEQAKEGRLHILGLMKEAVDGPQELSAHAPRLYVMKINPEKIREVIGKGGETIRSITKDTGCEINIEEDGTITIASVSSEGAEAAKKRIEEITVEVEVGKVYEGTVVKILDNNVGAIVSILPGKDGLVHISQIANERIKNVSDYLKEGQVVKVKAIEMDDRGRIRLSIKALLEEEAKTAQATADAFGLKTQ

SEQ ID NO: 9319 - protein, 945 aa, Flavobacteria bacterium
MNTDRFALRHIGPRKADLAPMLEKIGVESIDQLVYETIPENIRLQQDLQLDTAMSEYEFLSHIKKLGDKNKQFRSYIGLGYNAPITPAVIQRNILENPGWYTAYTPYQAEIAQGRLEALLNFQTMITDLTGMELANASLLDESTAAAEAMTLLFSVRERAQKKENVVKFFVDHDTLPQTKELLKTRATPLGIELVEGNPQDMDMSDGYYAILLQYPGASGNVVDYTAFAQKCHDNNIRIAVAADILSLVLLEAPGHWNADVVVGTTQRFGIPLGYGGPHAAYFATREEYKRQIPGRIIGVTKDTDGKRALRMALQTREQHIKRDKATSNICTAQVLLAVMAGMYGVYHGPRGLKFIANKLHAQTATLADAVEKLGIYQTNENFFDTLCFKVNAEAVKKEALALEINFYYPDADTVQVSLNETTSLTDLNDIVSAFAKAVNKDFSPITALLDSTHLGTGRQTEFMTYDVFNSYHSETELMRYIKKLERKDLALNHSMIALGSCTMKLNAAAEMLPLSNPQWGNIHPFVPVDQAQGYQEMLQKLELQLNEATGFAGTSLQPNSGAQGEFAGLMAIRAYHQSRGDHHRNICLIPSSAHGTNPASAVMAGMKVIVTKALENGNIDVDDLREKAEKHKDNLSALMVTYPSTHGVYESAIKEITGIIHENGGQVYMDGANMNAQVGLTNPGNIGADVCHLNLHKTFAIPHGGGGPGVGPICVAPQLVPFLPSNPIIKTGGDQAITPISAAPYGSASVCLISYGYICMLGAEGLKRSTEYAIINANYIKERLKGSYECLYTGEKGRAAHEMIIDCRPFKQHGIEVVDIAKRLMDYGFHAPTVSFPVNGTMMIEPTESESKEEMDRFCDAMISIRKEIADCSSDDPNNVLKNSPHTLEMITNDEWELPYTRKQAAYPLEYIADNKFWPTVRRADDAYGDRNLMCTCAPMEEYM

SEQ ID NO: 9320 - protein, 164 aa, Rubrobacter xylanophilus
MERDTHSRESILEAMRHLTHGVYVLGTRRGRQSNAMTASWVMQTSERPPAVAVAIRHDRYTHDMVMESGTFALSILRDGQVNLAHHFSETSGEYHDKLQGVPYGLTPGGSPYLLDCLAYLDCRVMDTARAGDHTLVVGEVTAGETLANDYPLIYDPSEYEGALS

SEQ ID NO: 9321 - protein, 210 aa, Prochlorococcus marinus
MNLQRQAEIHRVTNETEVSVRLGLDGSGRCKVSSGIAFLDHMLHQLSSHGLLDLELVAKGDTHIDDHHTNEDVGIALGQALSKALGNRKGIYRFGQFTAPLDEALVQVILDCSGRPHINYELEIPTQKIGTYDTELVREFFVALANNSGLTLHIRQLNGSNSHHIVEACFKAFAKSLRMAIEADPRRGGSIPSSKGVLEQAGDNNTEKSK

SEQ ID NO: 9322 - protein, 281 aa, Porphyromonas gingivalis
MSRISFDQLLEAGAHFGHLKRKWNPAMAPYIFMERNDIHIIDLHKTVAKVDEAAEVIKGMAKNGKKILFVATKKQAKEPIAELAKSVGMPYVVERWPGGMLTNFPTIRKAVKKMTQIDKMTADGTFDNLSKREKLQITRQRAKLEKTLGSIADMNRLPSALFVVDVMKEHIAVREANRLGIPVFAMVDTNSDPSLIDYVIPSNDDALKAIELIVGTMCQAINEGLMERKAEKPEEEETEEAAPRRERRARSGARRSRQNENEATAEAATEVAEAPEAEEAE

SEQ ID NO: 9323 - protein, 239 aa, Prochlorococcus marinus
MTNKEQDNYSNATLDFIKTFVDSNQRKRINLLTQIESEVENIFKIGPTLFEIFDSDGDDWAAGWLLQVLKKYKPNFFENTKFNNWFNTYSDVDINYEYLQLMLVEQKFEEADRLTSSYLRQLAGKLAEKRGYVFYSEVKNMSGKDLKTIDRLWTIYSTGRFGFSIQAKILKSVGIKYELLWPKIGWKKEGLWTRYPKSFCWSLKAPDGHMPLINQLRGVRLMDSILRHPAIAERHNNIL

SEQ ID NO: 9324 - protein, 177 aa, Gloeobacter violaceus
MVKVLYSEEQIAKQVQLLAGQISVHYAPLVSISYPLVVLPVLKGAFVFSSDLLRRLTVPLRVEFLRASSYRGGTVSGGLELDIPETAFLSGHHLLLLEDIIDTGKTASQILAALKSCGPASLQVCALLDKPARRVAPVEVGFRGFTAPDRFVIGYGMDLAERYRELPYVGELEECTF

SEQ ID NO: 9325 - protein, 227 aa, Nostoc punctiforme
MSSVQLYFAKASTFSQRTRVVLLEKGIDFSSTEIDLQNKPDGYTQISRYGKVPAIKHGDIEIYESAIINEYLDEVFPEPPLLPRDPGAKAIARIWIDYANTRFVPAFNKFLRGKDAQEQGQGQREFLEALLYIEQEGLGKLSGNGPYWLGEQLSLVDISFYPWFERLPLLEHFRNFTLPTETPRLQKWWNTVRDRESIRAVENPTSFYLERFAKILGAPTPVASAQK

SEQ ID NO: 9326 - protein, 456 aa, Legionella pneumophila
MPYIPHTPNDTKEMLTAVGAQDIQDLFDEIPASLQYAGFQSIPAGINEMEMLKEAQNQAQKNRNGICFIGAGCYEHHIPAAVWDIASRGEFLTAYTPYQAEASQGTLQLLYEYQTMICELTGMEVSNASMYDGATALAEAVLMAVRLNKHSKTNRVLITGTVHPFYRETIETIVRNQHIEVITLPFDEQQGITDFGSLNQYTGEDITALVIAQPNFFGCLEQVDKMTSWAHHNKTISVACVNPTSLALLKPPCSWGEHGVEIVCGEGQPLGSPMASGGPYFGFLSTRMAHVRQMPGRIIGRTVDKDGKTGFSLTLQAREQHIRRAKATSNICTNQGLLVTAATIYMSLLGPEGLSQVATQCHQNTHELITALTQIEGVELAFKAPFFHEALIKLNQPVQSVLQQLADAGIAGGYAPEQHYPQLANTLLVCATEVRSAEDIAKYAKTLKTIMSKRGA

SEQ ID NO: 9327 - protein, 164 aa, Zygosaccharomyces pseudorouxii
NGVATQATSAQTIDIHTGIGFLDHMIHALAKHSGWSLIVECIGDLHIDDHHTTEDCGIALGDAFKQALGQVRGVKRFGFGFAPLDEALSRAVVDLSNRPCSVIELGLKREKIGDLSCEMIPHFLESFTEAARLTVHVDCLRGFNDHHRSESAFKALAVALREAT

SEQ ID NO: 9328 - protein, 126 aa, Unknown
  Fragaria x ananassa
VEKIDICEIDKMVVDVSKQFFPRVAVGYEDPRVTLHIGDGVAFLKAVPAGTYDAVIVDSSDPIGPAQELFEKPFFQSVANALLPGGVVCTQAESIWLHMHIIEDIVSNCHQIFKGSVDYAWTTVPT

SEQ ID NO: 9329 - protein, 266 aa, Rhodopirellula baltica
MKRILITGATDGIGLETAKALVSRGHHVLIHGRNADKLKQVEQSLNSLSSEASIESHLADLSDINEVESLAGSVAAKHDHLDALINNAGVLSTSDPMTPDGLDVRFVVNTIAPYVLAKRLRSRMDSSGRIVNVSSAAQKPVDMAAFRGELQLDDLEAYSQSKLALTMWSRGLADKLGTDGPAIIAVNPGSLLSSKMVHQAFGVPGKDITIGANILVRAALDEEFADASGQYFNNDAGEFGTPHADALDAEKNAAIIDHLESVLATV

SEQ ID NO: 9330 - protein, 429 aa, Bordetella pertussis
MSQAPAHSLPSYLDAEHLGPWGIYLQQVDRVTPYLGPLARWVETLKRPKRALIVDVPIEMDNGSIAHFEGYRVQHNTSRGPGKGGVRFHQDVTLSEVMALAAWMSIKNAAVNLPYGGAKGGVRVDPRTLSHSELERMTRRYTSEIGVIIGPSKDIPAPDVNTNAQTMAWMMDTYSMNEGATATGVVTGKPIALGGSLGRVEATGRGVFVVGCEAARDLNLDVSKARIVVQGFGNVGGTAARLFHEAGAKVIAVQDHTGTIHNDGGLDVHKLLAHVGNQGGVAGFTGAQQLADDDFWGLETDFLIPAALEGQINENNAARVRAKVVVEGANGPTTPEADDILRENGVYVVPDVLANAGGVTVSYFEWVQDFSSFFWSEEEINQRLERLMREAYSAVSQVAKEHKVTLRTAAFIVACTRILQARQVRGLYP

SEQ ID NO: 9331 - protein, 416 aa, Onion yellows
MNQKLGLKDQDQEIFDLIEQEKIRQKENILLIASENFVSQAVLDAQGSILTNKYAEGYPQARYYNGCKNVDQIEKIAIQRATKLFGAKYANVQPHSGSQANMGAFQALLKPGDKILGLSLMDGGHLTHGHKLSFSGGFYEAHFYNVHPQTEMLDYDEIRKVALKVKPKLIIAGYSAYSKTINFKKFRQIADEVNAYLMADIAHIAGLVACGLHPCPFEANADVVTSTMHKTLRGPRGGLILTNKEEVFKKINRGIFPGIQGGPCIHTIAAKAVAFQEAMMPSFKEYQKQVIKNANTFAKAFQQKGYRIVSGGTDNHLFLIDVKHKNPEFTGSKIANMLEKINIVVNKNTIPFDQEKPFVTSGIRIGTPAMTTVGFRENDFILVADLMDKAINHLDDESYLAQIKQQVLALLSKFNK

SEQ ID NO: 9332 - protein, 476 aa, Oceanicola granulosus
MQHFPIFLDLSGQRVVLAGGGETALAKLRLLLKTEANLAVYADRPAPEIEAWAAEGKLTLVRRPLAHGDAICARLVYAATDDAAEDARVAAIGHAAGALVNIVDNLFDSDFITPAIVDRDPVTVAIGTEGAAPVLARAIKADLEARLPATLGPLARIGKAFRHAADALPFGRKRRDFWSAYYFGAGPRAIEAGEDAVRAALENLLAEHLAADAAPGRVDFVGAGPGDPELLTLKARKALDAADVVIHDRLVTPEILELARREAVLVSAGKEGFGPSVSQDDINAAIVAHARAGHHVVRLKSGDPTVFGRLDEEIEAVDAAGIDWRVVPGITAASAAVASIGQSLTRRGRNSAVRLLTGHDLAGFAEHDWAGLARDGEVAAIYMGKRSARFVQGRLLMHGAAAATPVTVIENASRPDQRVLATTLAQLEPTLTEAGLDGPALILYGLAPRAALAAAPDLVADLPSDLPAALTTEIAR

SEQ ID NO: 9333 - protein, 448 aa, Psychrobacter arcticus
MSISQAIEKIEARYAHQPEFIQAVKEVAITIAPLYDSHPEYDTFKVFERLVEPDRVIAFRINWENDKGEVQVNRGWRVQFSNALGPYKGGIRFHPTVNQSVLKFLGFEQIFKNALTGLPMGGAKGGSDFDPKGKSDNEIRRFCYAFMRELHPYINKDTDVPAGDIGVGGREISYMFAMYKNLTREYGGVLTGKGVGFGGSLMRTEATGYGAVYFLENMLTAQNEHIAGKRVLISGAGNVSLHAAEKVHMLGGVVVTVSDSQGTLYDEKGLNQEKINWLKEQKAKSQPLADYVAVYGGEWFAGQKPWHIKGDIAIPSATQNEVNEGDAKLMVENGIKYVVEGANMPLTAEAIDHIRLHRVHYAPGKAANAGGVAVSGLEMSQNSVRQYKSFEQIDARLKCIMKNIHDSAAEASGKYHQTDKGYIDYMTGANIVGFERVADALVAYGILN

SEQ ID NO: 9334 - protein, 505 aa, Burkholderia vietnamiensis
MTRSDLPHEARPVVVWFRDDQRLADNPALTHALDTGHPVVCVYVHDAAPKHGRAMGGAQRWWLHESLSKLDDALAAHGGSLILLRGNEHEAITGFAAAIGAAMVVWNRRYAKAQTGTDASIKRDLIDRGIAVSTFNGHLLREPWTVTTREGLPFQVFSAYWRAARRDDFFPPVPLPAPSHIRFFPVPAHATPHVCTLRELELQPSAPDWAGGLRETWQCGEQAASDQLEAFLENSLSDYPTLRDFPAARATSRLSPYLRFGNISVRQVWYATLSAADAMRSARIVRGVDSKDGPLSKFLSEIGWREFSYHLLYHFAPLHQVNFRRQFDSMPWRDDAKSLRKWQTGRTGYPLVDAGMRELWHTGWMHNRVRMVAASFLSKHLLIDWRQGEAWFWDTLVDADEASNPASWQWVSGSGADAAPYFRIFNPVLQAQKFDPHGDYTRRWVPELAQLSADTVHAPWAASREQLQRASVTLGRSYPMPIVDHQCARARALESVKRLDSESHA

SEQ ID NO: 9335 - protein, 187 aa, Oryza sativa
  misc_feature (25)..(25): Xaa can be any naturally occurring amino acid
  misc_feature (163)..(163): Xaa can be any naturally occurring amino acid
KDCNLNANYMTKRLEKHYPVLFRGXVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYCREYAAFPAAWLRGAKFWPTTCRVDNVXGDRNLICTLQQGSQVAEEAAAATA

SEQ ID NO: 9336 - protein, 191 aa, Methanosarcina acetivorans
MRTGRISRKTKETDIQLELNLDGKGVADISTGLGFFDHMLASFSRHSEFDLKVRAEGDLYVDEHHLVEDVGIVLGRALAEVLGDMSGIARFGEARIPMDEALAEVALDVGGRNYLVLKAEFASPQVGQFSTQLVRHFFETLASNAKITMHASVYGDNDHHKIEALFKAFAYAMKRAVKIEGKEVKSTKGTL

SEQ ID NO: 9337 - protein, 262 aa, Pyrobaculum aerophilum
MAGKVVFIGAGPGDPELLTVKAVKYLSQAEVVVYAGSLVNAEVLKYARQDAEVYNSASMVTEEIVKLMIQKAREGKLVARLKSGDPSIYGALWEEIIPLQLAGIEYEIVPGVTAALAAAAQLRIELTVPKRVQHVVITRASHRVPMRGSLKDVADFILKTGAVAVIYTGVHVIDKVVKELEEGGLSPGTPVAVVYKATWPDQKIIQGTLRDIAEKVKAERIVRDAVIIVGESVQPPEIPRSAVYNPDHAHSYRPRRELREDA

SEQ ID NO: 9338 - protein, 297 aa, Bacillus cereus
MQVGLIGLGKMGLNLGKNLMDHKHEVAAFDLNASAVEEMKEYGATGASSLNELVQSLQSPRVLWVMVPHAVVDSVIDEVTPLLSKGDILIEAGNSHYKESIRRYEQLKKDGIHFMDAGTSGGMEGARNGACYMIGGDQEAWDIVEPIFRDTAVENGYLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 9339 - protein, 547 aa, Oryza sativa
MNFDRYSTPTRPRRSSTPTASASSSPPAPGTASNLSQLAPIREAIKAPAPIALSSPGDKVPCQLIDKKELSRDVRLFRFALPSFDQVLGLPVGKHIFICASIEGKLCMRAYTPTSMVDEVGHFDLFIKVYFKNEHPKFPNGGLMTQYLDLLPVGAYIDVKGPLDHVEYTGRGSDFLVQEQEDQGGNQTIRMQPQQGRFFGREEMSNGVEYDAAYAATVAAVAYAIAAKEEEKQATEETRVKKKLTSEKKPVANDEPSTTPTLKLPPNRQGILKRPRQTEGSRITRRFSGKEIVPDEEDDGLEANVSVRRPVRTAQKIPEGGISGQNMVGKVLDSVPSIRKAPSFAKPLPEKKGSMKFEQEQAIPTVPPNVRPTALFPREKKESKKFDQDQAIPRVPPDVRPTASFSREKKESKKFEQDKANQMPSLASAPTSSYSSEAEAMADTWEKEKMAKIKKQYNMTMDTIVEWEAEKKAKAKRQMELKEGDNSERKREKALEEYNDEITRINKVAAASRLTAEEKRRSAERKVREKAERIRVTGKLPGACGCF

SEQ ID NO: 9340 - protein, 402 aa, Bacteroides fragilis
MEKNIFKLDNEQLKGIAHAFREKVEEGLNKNNAEIQCIPTFILPKATDVKGKALVLDLGGTNYRVAIVDFSTEKPIIYPNNGWKKDMSIMKSPGYTREELFKELADLIVEIKREEEMPIGYCFSYPTESIPGGDARLLRWTKGVDIREMVGQFVGKPLLDYLNEKNKIRFTGVKVLNDTIASLFAGLTDKSYDAYIGLIVGTGTNMATFIPSDKITKLDPECHVQGLIPVNLESGNFYPPFLTAVDDTVDATSDSLGKQRFEKAVSGMYLGDILKAAFPLEEFEEKFDARKLTAMMNYPDIHKDIYVQVAHWIYNRSAQLVAASLAGLIALLKSYNRDIHRVCLIAEGSLFWSESRKDKNYNILVMEKLQELLRELELEDVEVHINSMDNANLIGTGIAALS

SEQ ID NO: 9341 - protein, 489 aa, Clostridium perfringens
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGLFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 9342 - protein, 231 aa, Hordeum vulgare
RIQAYRFRTRVPPSPAASGSPRSTRRDVAVQAKGSWLPGLQSPAYLDGSLEGDNGFDPLALAEDPEDLRWFVQADVVNGRWAMLGVAGMLIPEVLTKAGLMNAPEWLRLPGKETYFASSSTALRVHMSSTYVEIRRWQDIKNPGSVNQDPIFKSYSLPPHECGYPGRVFNPLNFAPLENKEKELANGRLAMLAFLGFLVQHNVHGKGPFENLQQHLADPWHNTIIQTISGQ

SEQ ID NO: 9343 - protein, 112 aa, Unknown
  Azoarcus sp. BH72
MKFITAIIKPFKLDEVREALSAIGVQGITVTEVKGFGRQKGHTELYRGAEYVVDFLPKVKIEAAIRDELLDQAIEAIEKSASTGKIGDGKIFVFDLEQAIRIRTGETGADAL

SEQ ID NO: 9344 - protein, 470 aa, Synechococcus elongatus
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRTIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLRWRRVIAIRQNEEFRFRFQCFPGLLRQLPARSLPQNLTQAQRDYFGAHTYERTDRSGSFHAQWF

SEQ ID NO: 9345 - protein, 248 aa, Zea mays
MEPSPQPMGVAAGGSQVYPASAYPPAATVAPASVVSAGLQSGQPFPANPGHMSAQHQIVYQQAQQFHQQLQQQQQQQLQQFWVERMTEIEATTDFKNHNLPLARIKKIMKADEDVRMISAEAPVVFAKACEIFILELTLRSWMHTEENKRRTLQKNDIAAAITRTDIYDFLVDIVPRDEMKEDGIGLPRAGLPPMGAPADAYPYYYMPQQQVPGSGMVYGAQQGHPVTYLWQEPQQQQEQAPEEQQSA

SEQ ID NO: 9346 - protein, 110 aa, Zea mays
  misc_feature (61)..(61): Xaa can be any naturally occurring amino acid
  misc_feature (93)..(93): Xaa can be any naturally occurring amino acid
KGSTTCFQSYARQVDNCECFIVLNDLNISPYCITLAFYDNDNVYSQTFDADLISCDTCMTXSATKDALHLRIRVHPFHVLRINKMLSCAGADXLHTGMMGAFGKPYGTCS

SEQ ID NO: 9347 - protein, 260 aa, Unknown
  Mycobacterium sp. JLS
MTAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDLNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPEEIAAPAVFLASPEASYITGAVLPVDGGMTAGVTFRAFEAV

SEQ ID NO: 9348 - protein, 631 aa, Olimarabidopsis pumila
MTAVLFLCFILFCFSFTPSLQNVRESEPLLRFKTSVNITKGDLNSWRTGTNPCNGKWFGIYCQKGQTVSGIHVTRLGLSGTINVEDLKDLPNLRTIRLDNNLLSGPLPPFFKLPGLKSLLLSNNSFSGEIADDFFKETPQLKRVFLDNNRLSGKIPSSLMQLSGLEELHMQGNQFSGEIPPLTDGNKVIKSLDLSNNNLEGEIPKSIAERKNLEMKFEGNQKLCGPPLNTICEETPTSFGEKKEVTGKAIFMVIFFLLLFLIIVAIITRWKKKRQPEFRMLGKDHLSDHESVEVRVPDSIKKPIESSKKRSNADGSSKKGSAHGKGGGGGPGGGGMGDIIMVNSEKGSFGLPDLMKAAAEVLGNGSLGSAYKAVMANGLSVVVKRIRDMNKLARDAFDIEMQRFGKLRHPNVLTPLAYHYRREEKLVVSEYMPKSSLLYVLHGDRGVYHSELTWATRLKIIQGVARGMDFLHEEFASYDLPHGNLKSSNVLLSETYEPLISDYAFLPLLQPNNASQALFAFKSPEFVQNQQVSPKSDVYCLGIIILEVMTGKFPSQYLNTGKGGTDIVEWVQSSIAQHKEEELIDPEIASNTDSIQQMIELVRIGAACIASNPNERQNMKEIVRRIERVTL

SEQ ID NO: 9349 - protein, 408 aa, Deinococcus radiodurans
MTTADQPQAVRDDAVFDLIAQEAERQRTGLELIASENFTSAAVREAQGSVLTNKYAEGYPGKRWYGGCEVVDQVEQLAIDRVKQLFNAEWANVQPHSGSSANLAVYNALIQPGDTVLGMDLSHGGHLTHGNKANFSGMRYQMVAYQLDRETERIDMEEVRRLAHEHKPKMIIAGASAYSRVIDFAAFREIADEVGALLFADIAHIAGLIAAGEHPNALPHAHVVASTTHKTLRGPRGGIILANDPEIAKQLDRTVFPGYQGGPLEHVIAAKAVAFGEALRPEFKDYARQIIKNAQALAGEFQQKGYRVVSGGTDNHLFLLDLRPQGLNGTKATRLLDANHITISKSTLPYDTEKILHGGGIRIGTPAVTTRGMTEAHMTQVADLIDRALKGEDVQAKVHDFAGGFPLP

SEQ ID NO: 9350 - protein, 395 aa, Clostridium tetani
MSFKVTNKVTWVGKIDWELRRFHGDEYSTHRGTSYNSYLIKDKKIVLIDTVWEPFSKEFVENLKKEVDLNKIDYIIMNHNEIDHSGALPLLMKEIPNTPIYCTADGAKILKAHYHKDWNFVEVKTGDTLDIGESKLTFVEAKMLHWPDSMFTYMSGENILFSNDAFGQHYASDLMYNDLVDQAELYQESMKYYANILTPFNSFVIKKIEEVLALNLPLNIIATSHGVIWRDNPAQIIEQYIKWANGYEENQITVLYDTMWNGTRRMAEGIAEGIKSVNKDITVKLFNAAHSDKNDVITEIFKSKVLLVGSATVNKSIMSATAGILDMIRGLGLKNKKAAAFGAYGWSGEAVKILEEKLKNGKFEILESGIKELWNPDKDAMNRCRQFGKNIVEKL

SEQ ID NO: 9351 - protein, 417 aa, Shigella flexneri
MLEQMGIAAKQASYKLAQLSSREKNRVLEKIADELEAQSEIILNANAQDVADARANGLSEAMLDRLALTPARLKGIADDVRQVCNLADPVGQVIDGGVLDSGLRLERRRVPLGVIGVIYEARPNVTVDVASLCLKTGNAVILRGGKETCRTNAATVAVIQDALKSCGLPAGAVQAIDNPDRALVSEMLRMDKYIDMLIPRGGAGLHKLCREQSTIPVITGGIGVCHIYVDESAEIAEALKVIVNAKTQRPSTCNTVETLLVNKNIADSFLPALSKQMAESGVTLHADAAALTQLQAGPAKVVAVKAEEYDDEFLSLDLNVKIVSDLDDAIAHIREHGTQHSDAILTRDMRNAQRFVNEVDSSAVYVNASTRFTDGGQFGLGAEVAVSTQKLHARGPMGLEALTTYKWIGIGDYTIRA

SEQ ID NO: 9352 - protein, 264 aa, Fagus crenata
MAASTMALSSPSLAGKAVKLAPSTPELNVGRVSMRKSASRNVSSGSPWYGPDRVKYLGPFSGEPPSYLTGEFPGDYGWDTAGLSADPETFAKNRELEVIHSRWAMLGALGCVFPELLARNGVKFGEAVWFKAGAQIFSEGGLDYLGNPSLIHAQSILAIWATQVILMGAVEGYRIAGGPLGEVTDPLYPGGSFDPLGLADDPEAFAELKVKELKNGRLAMFSMFGFFVQAIVTGKGPIENLADHLADPVTNNAWAYATNFVPGK

SEQ ID NO: 9353 - protein, 490 aa, Sphingomonas paucimobilis
MAHFPDTSGMTGVLRPLRIEGDILDLEVEGEIPAQLDGTFHRVHPDAQFPPRFEDDQFFNGDGMVSLFRFHDGKIDFRQRYAQTDKWKVERKAGKSLFGAYRNPLTDDASVQGMIRGTANTNVMVHAGKLYAMKEDSPCLIMDPLTLETEGYTNFDGKLKNQTFSAHAKIDPVTGNFCNFGYAATGLLTTDCSYFEIDPAGNLLFETEFQVPYYCMMHDYGLTEHYAIFHIVPCSPNWDRLKAGLPHFGFDTTLPVWLGVVPRGPGVTNKDVRWFKAPKTIFASHVMNAFEEGSKIHFDTPQAENNAFPFFPDIHGAPFDPVAARPYLHRWTVDLGSNSEDFAEVRQLTSWIDEFPRVDARYVGQPYRHGWGLVMDPEMEMEFARGRASGFKMNRIGHWDHATGKEDSWWCGPQSIIQEPCFVPRMADSAEGDGYIIALVDNLITNYSDLVVLDALNLKDGPIGRAKLPIRLRSGLHGNWADASKLPIAA

SEQ ID NO: 9354 - protein, 537 aa, Nicotiana tabacum
GASSLHKKKNACEEESSGNLISSYKQNLLKVKYENDMSFLKDLAETLSSIFSDTPSSSSPQNDRNLNSADRTMDGVATGNERAAYKLKGYFDLAKEEIDKAVRAEEWGLADDAISHYQNAQKILAEGISTPVPSYITSSEQEKVKSYRQKLTKWKSQVSERLQTLSRRAGGTSAVKISAPQTQRLAVSQSSSSARKGESRTAPSSGRGSSVMRVPNSGKDSSVARVPINSISSHKPSQESANGYDPKLVDMINSVIVDRSPSVKWEDIAGLEKAKQALLEMVILPTKRKDLFTGLRRPARGLLLFGPPGTGKTMLAKAVASESEATFFNVSASSLTSKWVGEGEKLVKTLFMVAISRKPSVIFMDEIDSVMSTRTTNENEASRRLKSEFLVQFDGVTSNSDDLVIVIGATNKPQELDDAVLRRLVKRIYIPLPDANVRRQLLKHRLKGKAFSLPGGDLDRLVRDTEGYSGSDLQALCEEAAMMPIRELGANILRVDADQVRGLRYGDFQKAMTVIRPSLQKSKWEELERWNQEFGAN

SEQ ID NO: 9355 - protein, 357 aa, Arabidopsis thaliana
MVRIIPMAASSIRPSLACFSDSPRFPISLLSRNLSRTLHVPQSQLFGLTSHKLLRRSVNCLGVAESGKAAQATTQDDLLTWVKNDKRRMLHVVYRVGDMDRTIKYFTLAFLFYTECLGMKLLRKRDIPEEKYTNAFLGYGPEDSHFVIELTYNYGVDKYDIGAGFGHFGIAVDDVAKTVELVKAKGGKVSREPGPVKGGKTVIAFIEDPDGYKFELLERGPTPEPLCQVMLRVGDLDRAIKFYEKAFGMELLRTRDNPEYKYTIAMMGYGPEDKFPVLELTYNYGVTEYDKGNAYAQIAIGTDDVYKTAEAIKLFGGKITREPGPLPGISTKITACLDPDGWKSVFVDNIDFLKELE

SEQ ID NO: 9356 - protein, 477 aa, Oryza sativa
MVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSCAW

SEQ ID NO: 9357 - protein, 229 aa, Francisella tularensis
MIKKIIYSLSILSCSLGFSADSDTKYEKAIFAGGGFWCLESDFEYMQKHQDLSHNGIIKVISGYDGGLQKDPTYKTVSAGITNYKESVEVIYDPTKISYQELVEYFYRRIDPTDFKGQFCDKGKQYQSAIYYNNDKQKQVAEEVTKKLKEEFKKHNQSVYTQILPSTHFYKAESYHQDYHHKNPKRYCYYRTGCGRDLTINKVWQNIDWKYSNVVPFDIPSSYAECLIR

SEQ ID NO: 9358 - protein, 434 aa, Candida glabrata
MFGNAFHLRNRIHKRSSSSDRLDQDESSDDGDNAPNIVEQKTKDIKLVKPLKRPRLSNCCSPTTPMANRLQTMAVAWHISSFVLFSIFSLLIISNPFTWIVVIPYLIYFFNDRSPANGDVVYRYSPWVRSLKIWKYYCDYFPIELVKTVDLEPTFTPCNEEEEKENKKLQEYYTLRLWPSDYEIRLFKKNTVYSHGYKRTGPKYIFGYHPHGIGALGSFGAFATEGRGWSNKFPGIPVSLLTLVTQFHIPFYRDYLLSVGISSVSRKNALKVLDNNQSICIVVGGARESLISIPGTSGLILNKRKGFIKLAIQAGNVSLVPVYTFGENDCYNILATDETSIIRKLQLWVKENFGFTIPIFYARGLFNYDFGLLPFRAPLHVVVGRPIHVKEQQENPEQSLVDHYHELYVEELKRIYLENRDRYGYGAADFEILG

SEQ ID NO: 9359 - protein, 282 aa, Caulobacter crescentus
MVIAGSGEAAEAKARLFDGSPATLVRLDGHAAYLPGSYSGAAFAFIASSDEVFVQAAAGAARAARVLVNVVDRPELCDFNTPAVIDRGQVVAAVGTGGGAPVLATMLRNDIEAQVPEGTGRVAALLAKFQTEVRKTLPALHERRAFLRDAVMGEAAAAAREGDMDRAGQLFREALAKGGARKGVVRFIAGKGPADLLTLRALRALGSADVLVLDGDVEPEVLKMARRDAERLDADGADAPHLIQLAREGRQIVRLITHPVDPALVHALTQAEVAVEVLPVAT

SEQ ID NO: 9360 - protein, 164 aa, Glycine max
  misc_feature (45)..(45): Xaa can be any naturally occurring amino acid
  misc_feature (107)..(107): Xaa can be any naturally occurring amino acid
  misc_feature (152)..(152): Xaa can be any naturally occurring amino acid
MKCFRQKSCFFDKILCTHFCSNAGLQHTQDFLKKIGLGKENYYFXKQIGKALLCTYAVIGAVWVYNETSPLGWWTLKPKPKEELELAHLYKRQQFPYPDDEEAMQCXEFIARGGMIGTTIGPKGVFEDDKDKSDYKKELKDKKFGQEAQKLXMRMRSEVTAEIQ

SEQ ID NO: 9361 - protein, 372 aa, Pseudomonas syringae
MRSKVTGAQRWVVKIGSALLTADGKGLDRNAMGVWVEQMVALHEAGVELVLVSSGAVAAGMSRLGWTARPSAMHELQAAAAIGQMGLVQAWESSFAEHGRHTAQILLTHDDLSDRKRYLNARSTLRTLVELGVVPVINENDTVVTDEIRFGDNDTLAALVANLVEADLLVILTDRDGMFDADPRNNPEAQLIYEARADDPALDAVAGGTGGALGRGGMQTKLRAARLAARSGAHTVIVGGRIERVLARLKGGERLGTLLSPERGMLAARKQWLAGHLQTRGTLVLDDGAVAALARDQKSLLPVGVKLVQGSFRRGEMVVCVAQDGREIARGLSNYSAIEAQKIIGHSSESIVRELGYMAEPELIHRDNLILV

SEQ ID NO: 9362 - protein, 418 aa, Saccharomyces cerevisiae
MSGTFNDIRRRKKEEGSPTAGITERHENKSLSSIDKREQTLKPQLESCCPLATPFERRLQTLAVAWHTSSFVLFSIFTLFAISTPALWVLAIPYMIYFFFDRSPATGEVVNRYSLRFRSLPIWKWYCDYFPISLIKTVNLKPTFTLSKNKRVNEKNYKIRLWPTKYSINLKSNSTIDYRNQECTGPTYLFGYHPHGIGALGAFGAFATEGCNYSKIFPGIPISLMTLVTQFHIPLYRDYLLALGISSVSRKNALRTLSKNQSICIVVGGARESLLSSTNGTQLILNKRKGFIKLAIQTGNINLVPVFAFGEVDCYNVLSTKKDSVLGKMQLWFKENFGFTIPIFYARGLFNYDFGLLPFRAPINVVVGRPIYVEKKITNPPDDVVNHFHDLYIAELKRLYYENREKYGVPDAELKIVG

SEQ ID NO: 9363 - protein, 300 aa, Oryza sativa
MTTARFVSPSLSRVSPSPAGRVSGSSWLSRAGVALPARPHGLSLHLRPPAMASAAAAGNGSPSAPEDSTALSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPSSKDCNIQRKQMEWPLQLLESYLPWESPLVAITEHEAIAN

SEQ ID NO: 9364 - protein, 544 aa, Sinorhizobium meliloti; identical to SEQ ID NO: 442

SEQ ID NO: 9365 - protein, 255 aa, Staphylococcus aureus
MAVISMKQLLEAGVHFGHQTRRWNPKMKKYIFTERNGIYIIDLQKTVKKVDEAYNFLKQVSEDGGQVLFVGTKKQAQESVKSEAERAGQFYINQRWLGGLLTNYKTISKRIKRISEIEKMEEDGLFEVLPKKEVVELKKEYDRLIKFLGGIRDMKSMPQALFVVDPRKERNAIAEARKLNIPIVGIVDTNCDPDEIDYVIPANDDAIRAVKLLTAKMADAILEGQQGVSNEEVAAEQNIDLDEKEKSEETEATEE

SEQ ID NO: 9366 - protein, 473 aa, Bacillus thuringiensis
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 9367 - protein, 554 aa, Kluyveromyces lactis
MSVYVNEFSGVDESTVAGTEQQPFKTAAFALYSKAESEPKEIYVFKKEDDGAEGAYVEISASALKKAKKGVEGLKKKAAKQKELEQKQQEQEAKNAAKKLEAMNITIEEDLSLPKAERRKIRSAYDAVDKRVKVSGWVHRLRNNKSVVFIILRDGTGFLQTVLTGDLARSYQIVNLTLETTITLYGTIKVVPESKSAPGGVELFVDYFEIVGPAPSGENAFTNRVQENADPSILLDQRHLMLRGETLSAVMKVRAALMKSIRRVYDEEGLTEVNPPCMVQTQVEGGSTLFKLDYYGEEAFLTQSSQLYLETCLAALGDVYCIQESFRAEKSHTRRHLSEYTHIEAELCFLDFDDLLSHIERVITKTIQYVLEDPVAGPLVKKLNPNFQAPQLPFKRMEYKDAIEWLKEHGIKNEEDKEFQFGDDIAEAAERKMTDTIGVPILLTRFPLEIKSFYMKRCDDDKRVTESVDVLMPTVGEITGGSMRIDDTEELMAGFKREGIDPAPYYWFIDQRKYGTCPHGGYGLGTERILAWLCDRFTVRDCSLYPRFSGRCKP

SEQ ID NO: 9368 - protein, 298 aa, Mortierella alpina
MTLSNPAIAAASGVILAGAYLIDPSALPFVAAGVAATWARVLFKKTAVKTPPMDPKEYRKFKLVDKVHCSPNTAMYKFALPHEDDLLNLPIGQHISIMANINGKDISRSYTPTSSSDDVGHFVLCIKSYPQGNISKMFSELSIGDSINARGPKGQFSYTPNMCRAIGMIAGGTGLTPMLQIIRAIVKNPEDKTQVNFIFANVTEEDIILKAELDLLSQKHPQFKVYYVLNNAPEGWTGGVGFVNADMIKEHMPAPAADIKVLLCGPPPMVSAMSKITQDLGYDKVNAVSKLPDQVFKF

SEQ ID NO: 9369 - protein, 561 aa, Unknown
  Acidovorax sp. JS42
MSESFAALFEESLTRTEMRPGEVITAEVVRVEHNFVVVNAGLKSEAYVPIDEFKNDQGEIEVQVGDFVSVAIGSIENGYGDTILSRDTAKRLASWLSLEKALESGEFVTGTTSGKVKGGLTVLVNGIRAFLPGSLIDTRPVKDLTPYENKTLEFKVIKLDRKRNNVVLSRRAVVEASMGEDRAKLMETLKEGAIVNGVVKNITEYGAFVDLGGIDGLLHITDMAWRRVRHPSEVVTAGQEITAKILKFDTEKNRVSLGLKQMGDDPWLGVSRRYPSGTRLFGKVTNIADYGAFVELEPGIEGLVHVSEMDWTNKNVAPSKLVSLGDEVEVMVLEIDEDKRRISLGMKQCKANPWQEFAQDTKRGDRVKGPIKSITDFGVFVGLAAGIDGLVHLSDLSWNEPGESAVRNYKKGQEVEAIVLAVDVDRERISLGIKQLDGDPFTTFVTVNDKGQTVTGKVKTVDARGAEIDLGEDIVGYLRASEISRDRVEDARNVLKEGDEVTAVVVNVDRKTRNIQLSIKQKDMVDQQEAMAHLSAQSAKENAGTTSLGALLRAKLDNSDK

SEQ ID NO: 9370 - protein, 658 aa, Arabidopsis thaliana
  misc_feature (431)..(431): Xaa can be any naturally occurring amino acid
MSYYSSFFFLFLFSFLTSFRVSAQDPTYVYHTCQNTANYTSNSTYNNNLKTLLASLSSRNASYSTGFQNATVGQAPDRVTGLFNCRGDVSTEVCRRCVSFAVNDTLTRCPNQKEATLYYDECVLRYSNQNILSTLITTGGVILVNTRNVTSNQLDLLSDLVLPTLNQAATVALNSSKKFGTRKNNFTALQSFYGLVQCTPDLTRQDCSRCLQLVINQIPTDRIGARIINPSCTSRYEIYAFYTESAVPPPPPPPSISTPPVSAPPRSEKEGNSKVLVIAIVVPIIVAVRLFIAGYCFLTRRARKSYSTPSAFAGDDITTADSLQLDYRTIQTATDDFVESNKIGQGGFGEVYKGTLSDGTEVAVKRLSKSSGQGEVEFKNEVVLVAKLQHRNLVRLLGFCLDGEERVLVYEYVPNKSLDYFLFDPAKKGQXDWTRRYKIIGGVARGILYLHQDSRLTIIHRDLKASTILLDADMNPKIADFGMARIFGLDQTEENTSRIVGTYGYMSPEYAMHGQYSMKSDVYSFGVLVLEIISGKKNSSFYQTDGAHDLVSYAWGLWSNGRPLELVDPAIVENCQRNEVVRCVHIGLLCVQEDPAERPTLSTIVLMLTSNTVTLPVPRQPGLFFQSRIGKDPLDTDTTSKSLLGSVDDASITDIHPR

SEQ ID NO: 9371 - protein, 604 aa, Triticum aestivum
MAALVTSQLATSGTVLSVTDRFRRPGFQGLRPRNPADAALGMRTVGASAAPKQSRKPHRFDRRCLSMVVRATGSGGMNLVFVGAEMAPWSKTGGLGDVLGGLPAAMAANGHRVMVISPRYDQYKDAWDTSVISEIKVVDRYERVRYFHCYKRGVDRVFVDHPCFLEKVRGKTKEKIYGPDAGTDYEDNQQRFSLLCQAALEVPRILDLNNNPHFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEIVKEEDVQIVLLGTGKKKFERLLKSVEEKFPTKVWAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGIVGEEIAPLALENVAAP

SEQ ID NO: 9372 - protein, 139 aa, Triticum aestivum
VLSLCSPCLMGEGDLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGINAKLLGCHGPPANRAP

SEQ ID NO: 9373 - protein, 605 aa, Triticum aestivum
MAALVTSQLATSGTVLGITDRFRRAGFQGVRPRSPADAPLGMRTTGASAAPKQQSRKAHRGTRRCLSMVVRATGSAGMNLVFVGAEMAPWSKTGGLGDVLGGLPPAMAANGHRVMVISPRYDQYKDAWDTSVVSEIKVADEYERVRYFHCYKRGVDRVFVDHPCFLEKVRGKTKEKIYGPDAGTDYEDNQLRFSLLCQAALEAPRILDLNNNPYFSGPYGEDVVFVCNDWHTGLLACYLKSNYQSSGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPAKDKFLAANYDVTTALEGKALNKEALQAEVGLPVDRKVPLVAFIGRLEEQKGPDVMIAAIPEILKEEDVQIVLLGTGKKKFERLLKSVEEKFPSKVRAVVRFNAPLAHQMMAGADVLAVTSRFEPCGLIQLQGMRYGTPCACASTGGLVDTIMEGKTGFHMGRLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 9374 - protein, 349 aa, Clostridium tetani
MILQEQELKWSLEKGKSNMTIKGITFIGGGSFGTALGIMLAKKGYNINIWDRKPHVIADINEKKENIKYLPNVVIPSNVKAYKGMKEALVGIKYVVISVPSHAIREICRNMKDYLKEDAIIISVAKGIEEHSGKRLSQIIKEELPKNPVVILSGPSHAEEVAQDIPTTVVVTSEDVKASLEVQNLFSTNKFRVYTNDDIIGVEIGGAVKNIIALAAGISDGIGYGDNTKAALMTRGINEIIRIGEKLGGQRETFWGLTGMGDMIVTCTSMHSRNRRAGLLIGKGLSMEEAIEEVGMVVEGIKACKAFYELKEKLKVSMPITDALYRVLFQGEDAKYCVYELMTRDKKDE

SEQ ID NO: 9375 - protein, 391 aa, Arabidopsis thaliana
MDDDKLVFETTDGIEPITSFNDMGIKEDVLRGVYEYGFEKPSAIQQRAVMPILQGRDVIAQAQSGTGKTSMIALSVCQVVDTSSREVQALILSPTRELATQTEKTIQAIGLHANIQAHACIGGNSVGEDIRKLEHGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWKFDTLCDLYDTLTITQAVIFCNTKRKVDYLSEKMRSHNFTVSSMHGDMPQKERDAIMNEFRSGDSRVLITTDVWARGIDVQQVSLVINYDLPNNRELYIHRIGRSGRFGRKGVAINFVKSDDIKILRDIEQYYSTQIDEMPMNVADLI

SEQ ID NO: 9376 - protein, 996 aa, Thermoplasma acidophilum
MIIRNDYIVIISLDHCMSEKAFSISIDGRSYDANDGETVLQVMMRNRLDISHICYHPSLGPIQTCDTCLVEADGKIVRSCATQVHENMNVVYSEDRVKDLRKEAVQRILANHNLYCTVCDNNNGDCELHNAVLDLKIDKQKYPFSRKPYDVDDSNPFYVYDPSQCILCGRCVEACQDVQVNETLHIDWSLERPRVVWDDGSKINESSCVSCGHCVTVCPVNALMEKTMIGNAGYLTDLDTETKNTMIDLVKAFEPIITMRPVMAISNIESKMRETRIRKTKTVCTYCGVGCSFEMWTVGRKILKVQPKPESPANGISTCVKGKFGWDFVNSPDRLTEPLIRDGDRFRMASWDEALDLIASRLREIKEKYGPDAIEFIASSKGTNEEAYLVQKLARQVFGTNNVDNSSRFCQAPATTGLWRTVGYGGDAGSISDLYVSDLILAVGTNTAESHPVIATRIKRAHKLNGQKIIVADLRMHEMARRADVFIHPRPGTDLVWINAVAKYIVDQGWQAREFIEKRVNFYDEYVKSLEPFTLEFAEKVSGVSADDIRKIATMIHEAKSMAVIWAMGVTQHQAGSDTSTALSNLLLLTGNYGRPGTGGYPLRGHNNVQGASDFGAMSAYLPGYQSVSDEKARKKIEEYWKCQIPDKPGYDNNTCLEAINSDRIRAMYVVGEELVETGSDSEYIRKQLEKLDFLVVEDMFLSETAKYADVVLPAAASVEKEGTFVNTERRIQRIYRVMEPLGNSRPDWQIIQDVANRLGAGWNYRHPSEIMQEVSKIAPIFAGVSYERLEGFGSLQWPVSDGGKDTPLLYTDRFNFPDGKARFYPLKYSPPLTVDQEFDLHLNNGRILEHFHEGNETYRSPGLKEKVPGTFVEVSPELAAERGLKDGDLVRITSKWGSIKVRVLVTDRVSGKELYMPMNSGGDSAVNNLTSRLMDPTAHTPAYKELPVKMEKIEGGHGESPMPRTNPRYGKPHPQRGVMVEEKWKRSDYIKLTGD

SEQ ID NO: 9377 - protein, 522 aa, Triticum aestivum
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAANRGGGQGLCTGVLNIAIVIPQVIIAVGAGPWDELFGKGNIPAFGVASAFALIGGIVGIFLLPKISRRQFRAVSGGGH

SEQ ID NO: 9378 - protein, 356 aa, Ostreococcus tauri
  misc_feature (1)..(2): Xaa can be any naturally occurring amino acid
XXASGAQKPKGAASDADGELAKMKGQLGGAIVTEKPNVKWDDVAGLQGAKDALKEAVILPVKFPQFFTGKRKAWSGFLLYGPPGTGKSYLAKAVATEADSTFFSISSSDLVSKWMGESEKLVSQLFALAREQAPSIIFIDEIDALCGARGENGESEASRRIKTEILVQMQGVGSSAGKVLVLAATNTPYSLDQAVRRRFDKRIYIPLPDEAARAHIFRVHVGETPSDLTDEDYQMLGAQSEGFSGSDIDHVVKDVLYEPVRKVQEATHFITVKNPAHAPTGTDAQDEYYVPCSPGEPGSWPSSLEELARLGYAARVLPPPITANDFRKVLLRARPTVAPADLEIHERFTKEFGEEG

SEQ ID NO: 9379 - protein, 124 aa, Prochlorococcus marinus
MNKTFTVTIKNKETGKLYKEQVNCDEYILKEFEKKGFRLPFSCRNGCCTSCAVKIISGTLQQPEAMGVSQALKDKGYALLCVAKATTDLELETTYEDEVYDLQFGQYFGRGNTRVAPPWEFEED

SEQ ID NO: 9380 - protein, 602 aa, Cryptococcus neoformans
MIPPLDDSSLVKAADKAWWKSATVYQVYPASFCDHADAGHGTLLGILTKVDYLQSLGVDIVWLSPIYESPQADMGYDISNYRQIDKRYGSLEDWDRLLAALHQRGMKLVMDLVVNHTSDQHPWFKESRSSRDNPKRDWYIWRPPRYNEKNERIPPNNWKGTFGQGSAWEFDETTNEYYLHLFLKEQPDLNWENPQVRAEVYDLMHWWLKRGADGFRMDVINFIAKAPGLPDAPVIDPGRTYQSFGMMSINRPEVHGWLKEMNRAVLSHYDCFAVGECPGDEAVVSYAPYSVPHNKELQMVFHFHHQSFDRAAGGLGRVHNPDWKLSELKRVFNTWQIEMAREGGWNSNYLENHDQPRIISRMASDHPSDRARCAKLLAMFHCSLGGTIYVYQGQELGMINVPRGWGLVEYKDVETIQNSEAEVQHRQVICGHANPDISDLLESNRITARDNGRTPMQWDSSLNAGFSKGEPWMRIHDDYREGWNAAAQVNDPDSAWSFWKQMLRLRKKYDAMIYGDFIALDESNEETYAYIREHPPSGQKLLVVLNLSRGNDGRGAPSTFVLPCGLDTSGSKLLISNGEVQEGQRIEGNILLGPWEGRIYLL

SEQ ID NO: 9381 - protein, 210 aa, Xanthomonas campestris
MPSRSKSSQRWLKEHFADPFVKKAQAEGMRSRAAYKLEELLQRDRLLKPGMVVVDLGAAPGGWSQQVRKSMGASGRVVALDILEMPPLAGVEFLHGDFREQAVLSEFEAMLGDVPVDLVLSDMAPNKSGMDAVDQPRMMHLAELAMEFADTHLKVGGAFLIKLFQGVGSDDYIRELRRRYEKVTIRKPAASRKRSAEVYVLGQGKRAQIK

SEQ ID NO: 9382 - protein, 498 aa, Francisella tularensis
MSFNTEIFLNINKYEQRIAIKENNILKEILIERDNQKRIVGNIYKGKIIRVLPGMQAAFVDIGLEKAGFLHLSEVIPLEKEDDDSDENFKLKKLNTEDINKWLREGQEVLVQVVKESIGNKGVKLTSHLSVSSRFLVFLPDLDHIGVSLKITNEQEKQRLLESIKKITQSENPRGYILRTAAEGASYEELENDIKFLNNLWQDILDISSTIIKPGVVYEDFSLIIKTINIFANDNLDKILVDNIDSYKEICHFADKYIPGLREKIELYQKHNIFEEYDIENEINKALDKTVYLKSGGYLVIEQTEAMITIDINTGGFIGTKNLEETIFKTNLEATKEIARQLRLRNLGGIIIIDFIDMMDQSHRIQVLEALKKELELDKAKTSVSDISELGLVEMTRKRVHESLLRTLCQPCEHCSGKGSVKTLQTICYDIFREIKSESKNYPSYNDFLLISSEKIIDYIEKEESIWLAELELEIQKNIHLKVENSHIYNQYDIIPLN

SEQ ID NO: 9383 - protein, 481 aa, Silicibacter pomeroyi
MSETRAIIYWLRRDLRLADHPGLAAAAASGRPVVPVFIHDESVAALGAAPAFRLGLGLERFGATLGDMGSRLILRRGSAPAVLQALIAETGAGAVWWTREYTPQAITRDSALKTALQQAGIEARSFGGALLFEPWTVETGAGGFYKVYTPFWRAVSQREVSAPDPAPARVRPPEAWPGSEALSDWGLGAPMRRGAAVVATHQAPGEAAALERLDRFIATGIGQYDACRDLPAGDGTSTLSDALSLGEIGPRTLWHRAGEAAHKGAQGAETFLKQLVWRDFAYHLMYHTPHLLSENWRPGWEVFPWATDPADPGFVAWTRGRTGVPLVDAAMREMYVTGRMHNRARMIAASYLTKHLMVHWKLGMDWFADCLTDWDPAANAMGWQWVAGCGPDAAPYFRIFNPETQAKKFDPKGRYRNHWIAEGQAEPPRAALSYFDAVPRSWNLRPDASYPPPIMALDQGRRRALSAYASAFSQGSDGKLA

SEQ ID NO: 9384 - protein, 720 aa, Arabidopsis thaliana
MKSLHVAANAGDLAEDCGILGGDADDTVLMDGIDEVGREIWLDDHGGDNNHVHGHQDDDLIVHHDPSIFYGDLPTLPDFPCMSSSSSSSTSPAPVNAIVPSASSSSAASSSTSSAASWAILRSDGEDPTPNQNQYASGNCDDSSGALQSTASMEIPLDSSQGFGCGEGGGDCIDMMETFGYMDLLDSNEFFDTSAIFSQDDDTQNPNLMDQTLERQEDQVVVPMMENNSGGDMQMMNSSLEQDDDLAAVFLEWLKNNKETVSAEDLRKVKIKKATIESAARRLGGGKEAMKQLLKLILEWVQTNHLQRRRTTTTTTNLSYQQSFQQDPFQNPNPNNNNLIPPSVQTCFSPSTWVPPPPQQQAFVSDPGFGYMPAPNYPPQPEFLPLLESPPSWPPPPQSGPMPHQQFPMPPTSQYNQFGDPTGFNGYNMNPYQYPYVPAGQMRDQRLLRLCSSATKEARKKRMARQRRFLSHHHRHNNNNNNNNNNQQNQTQIGETCAAVAPQLNPVATTATGGTWMYWPNVPAVPPQLPPVMETQLPTMDRAGSASAMPRQQVVPDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKCGKYLIRGVKVRQPSGQKPEAPPSSAATKRQNKSQRNINNNSPSANVVVASPTSQTVK

SEQ ID NO: 9385 - protein, 581 aa, Silene latifolia
MDRLLKAARTSGSLNLSNRSLRDVPIEVYKNFDGAPEGENWWETVDLQKLILAHNNIEVLKEDLKNLPLLTVLNVSHNKLTQLPAAIGELPSLKSLDVSFNLLTNIPAEIGSATSLVKMDCSNNQLKELPSSLGQCLDLAELKASNNLIGSLPDDLAYCTKLLKVDIEGNKLTTLLDPVVGSWSMLSELNASKNLLTGLPETIGTLVRLIRLDLHQNRIKSIPSSIKGCSSLVEFFIGSNLLSSLPSELGELSQLSVLDLRSNQLTEYPAEACKLRLSVLDLSNNSLSGLPAEIGLMTSLRKLVLIGNPMRTIRSTLVTGPTAALLKYLRGRLPSAEEAQVMTPSKDNMVAMASRLSITTKELSLVGMGLIAVPPEVCESNEITKVDLSKNSIQELPVTLSACSSLEVLILSRNKIKDWPEDALKSLPNLTCLRLDNNPLNKVPLNGFDAVPRLQILDLSGCVSSLVDNPAFASLQHLVELYLRRVKLQEVPSDILMLRKLQILDLSQNSLHSIPQGFQNLTSLTELDLSDNSIGTLPPELGLLEPSLQALRLDGNPLRSIRRTILDRGTKAVLQYLKDKI

SEQ ID NO: 9386 - protein, 330 aa, Saccharomyces cerevisiae
MLDPRILPYYDPAVERKIAVVTGGNTGIGWYTVLHLYLHGFVVYICGRNSHKISKAIQEILAEAKKRCHEDDDGSSPGAGPGPSIQRLGSLHYIHLDLTDLKCVERAALKILKLEDHIDVLVNNAGIMAVPLEMTKDGFEVQLQTNYISHFIFTMRLLPLLRHCRGRIISLSSIGHHLEFMYWKLSKTWDYKPNMLFTWFRYAMSKTALIQCTKMLAIKYPDVLCLSVHPGLVMNTNLFSYWTRLPIVGIFFWLLFQVVGFFFGVSNEQGSLASLKCALDPNLSVEKDNGKYFTTGGKESKSSYVSNNVDEAASTWIWTVHQLRDRGFDI

SEQ ID NO: 9387 - protein, 447 aa, Streptococcus pneumoniae
MTKRVTIIDVKDYVGQEVTIGAWVANKSGKGKIAFLQLRDGTAFFQGVAFKPNFVEKFGEEVGLEKFDVIKRLSQETSVYVTGIVKEDERSKFGYELDITDIEVIGESQDYPITPKEHGTDFLMDNRHLWLRSRKQVAVLQIRNAIIYATYEFFDKNGFMKFDSPILSGNAAEDSTELFETDYFGTPAYLSQSGQLYLEAGAMALGRVFDFGPVFRAEKSKTRRHLTEFWMMDAEYSYLTHDESLDLQEAYVKALLQGVLDRAPQALETLERDTELLKRYIAEPFKRITYDQAIDLLQEHENDEDADYEHLEHGDDFGSPHETWISNHFGVPTFVMNYPAAIKAFYMKPVPGNPERVLCADLLAPEGYGEIIGGSMREEDYDALVAKMDELGMDRTEYEFYLDLRKYGTVPHGGFGIGIERMVTFAAGTKHIREAIPFPRMLHRIKP

SEQ ID NO: 9388 - protein, 265 aa, Methanococcoides burtonii
MDNNNWPESGDFVVCTVKNVVDFGAYTTLEEYGGKEGFIHISEVKAGWVKYVRDYVREGQKIVCKVLNVDPNRRHIDLSLKDVNEHQKRAKIQDWKNEQKATKWLQFVAEDMGTSPEEMGAVTATLSNEFGSCYIAFEEAAINGEDAFEDIVISKELAEKIASIAQENIKLPFVDIAGYVDLTSNLPDGIELIKKALKAAAKVKIDDVRIDVTYTGAPRYRIKVIAPEYKTAEAALKKASEKAIETIEKKGGKGIFHRHIETAKA

SEQ ID NO: 9389 - protein, 72 aa, Unknown
  Candidatus Protochlamydia amoebophila UWE25
MAKEDTIKIEGSVEELLPNMHFRVSLQNGLNVIAHLCGKMRMKNIRVLVGDVVTVEMSPYDLSKARIIFRQR

SEQ ID NO: 9390 - protein, 167 aa, Ostreococcus tauri
MTPCFRTHRLTGARGETLDSIARRRHNSTVNMARTKQTARKSTGGKAPRKQLATKAARKSAPATGGVKKPHRYRPGTVALREIRKYQKSTELLIRKLPFQRLVREIAQDFKTDLRFQSSAVLALQEASEAYLVGLFEDTNLCAIHAKRVTIMPKDVQLARRIRGERA

SEQ ID NO: 9391 - protein, 188 aa, Brassica napus
  misc_feature (4)..(4): Xaa can be any naturally occurring amino acid
  misc_feature (14)..(14): Xaa can be any naturally occurring amino acid
  misc_feature (24)..(24): Xaa can be any naturally occurring amino acid
IIFXEWWKDKVRFXLNGPIAIAKXQESNNMVCESNEEGNNIANQLSQKLLRDLQDPTLGWLLSALMPHCDPPQRRFPFEKRVRPPWWPTGEEYWWPKDQGPAPPYKKPHDLKKSWKIGVLTSVIKHLSPICRNRNGLFASSKFHVMPMHDRNINGNQSCLVEGNQSVNLQPEAQNHQEHWHFGRTEGN

SEQ ID NO: 9392 - protein, 712 aa, Caulobacter crescentus
MFDIKRKTIEWGGKTLVLETGRIARQADGAVLATMGETVVLATAVFAKSQKPGQDFFPLTVNYQEKTFAAGKIPGGFFKREGRPSEKETLVSRLIDRPIRPLFVKGFKNEVQVVVTVLQHDLENDPDILGMVAASAALCLSGAPFMGPIGAARVGWVDGAYVLNPTLDEMKESKMDLVVAGTADAVMMVESEIQELSEEIVLGGVNFAHQQMQAVIDAIIDLAEHAAKEPFAFEPEDTDAIKAKMKDLVGADIAAAYKIQKKQDRYEAVGAAKKKAIAALGLSDENPTGYDPLKLGAIFKELEADVVRRGILDTGLRIDGRDVKTVRPILGEVGILPRTHGSALFTRGETQAIVVATLGTGDDEQFIDALEGTYKESFLLHYNFPPYSVGETGRMGSPGRREIGHGKLAWRALRPMLPTKEDFPYTIRLVSEITESNGSSSMATVCGSSLAMMDAGVPLVRPVSGIAMGLILEQDGFAVLSDILGDEDHLGDMDFKVAGTSEGLTSLQMDIKIAGITPAIMEQALAQAKEGRAHILGEMNKAMDAPRADVGDFAPKIETINIPTDKIREVIGSGGKVIREIVATTGAKVDINDDGVVKVSASDGAKIKAAIDWIKSITDEAEVGKIYDGKVVKVVDFGAFVNFFGAKDGLVHVSQISNERVAKPSDVLKEGQMVKVKLLGFDDRGKTKLSMKVVDQETGEDLSKKEAAAEEA

SEQ ID NO: 9393 - protein, 305 aa, Ostreococcus tauri
MPEFQIQPGRPQDPQRARVLAVAHQELGERENVSRVAIAQRARLIGVKHRAGDGTVRGVELRGLSGLDEGVVDARHHARGDLSRRRNVRLSRTHGRQGTRLPGDSIERVSRARVVAVASSVTRPRERIDDVRRENHQFRATTDIDAIAPLSPTQGRLRNPIVANELLMLIPKQNRNETYKALFSEGVIWAKKDYNLPKHPEVGQSGENPIDVPNLHVIKLMQSFKSKGFVNEIFSWRHYYWYLTDEGIEYLREYLNLGPDVVPNTLKKAARAPTREPEAPRGGRGGRGGFGGHRGGYRSERPPRQ

SEQ ID NO: 9394 - protein, 600 aa, Sinorhizobium meliloti
MLEESPGTRVDTVLAKLGKALEQGDIDAAVNLFQADCYWRDLVAFTWNLKTMEGQDQIRDMLTTQLAAIKPARLRQDEKEPASAGAGVTEGWFEFETEVARGHGHIRLRNGLIWTLLTTMTELKGHEEPKGLRRPLGAEHGHDPDRKTWKEKREAEAAELGYTTQPYAVIIGGGQGGIALGARLRQLGVPTIIIEKNERPGDSWRKRYKSLCLHDPVWYDHLPYIPFPENWPVFAPKDKIGDWLEMYTRVMELNYWSSTLCKSARYDEATEEWTVIVERNGEEVVLRPKQLVLATGMSGKPNVPKLEGQDIFKGEQQHSSQHPGPDAYRGKKVVVIGSNNSAHDICAALWEGGADVTMVQRSSTHIVRSDTLMEIGLGDLYSERALAAGVTTRKADLIFASLPYRIMHEFQIPLYEKMRERDAKFYADLEKAGFMLDWGADGSGLFMKYLRRGSGYYIDVGACDLVIDGSIKLKSGSDVSHLTEDAVVLKDGTVLPADLVVYATGYGSMNGWAADLISKDVADKVGKVWGLGSDTPKDPGPWEGEQRNMWKPTQQEALWFHGGNLHQSRHYSQYLSLQLKARCEGISTPVYGLQERHHLS

SEQ ID NO: 9395 - protein, 334 aa, Kluyveromyces lactis
MYSHHSHSGDYVAHGVDPLEDIITEVKRRKFHTWCMTEHMPRLELELLYPEEKTNESSTEEDLKILVKKFEAYMIHAKRIKDRETASENGLHILIGFEIEGCDLEHMRYANELLRRNNNVLQFMVGSVHHVHNIPIDFNQEKWNEALKVSGNNLRQLLYDYFTIQRKMLETTQPLVVGHFDLIRLFLPDDMRVDLESGQVLSEGGTLVKDLESVMTQWSDVKQLIVESLKYVVSYGGVVEINSAGLRKGKVDPYPHRDIVNLSKEVTPSIRYVTSDDAHGVSQIAVCYDEMLNYIENVVQLKQISYLEEQDDGNIQIKDIFVEEVKRSEFWSIK

SEQ ID NO: 9396 - protein, 357 aa, Phytophthora infestans
MSQLDRAVYDQYMSLDVSESVTLAEYVWIGGSGQDLRCKTKTLTKPVKSVADLPIWNFDGSSTGQAPGEDSEVLLRPVAIFKDPFRRGQHILVLCDCLKPDMTPIANNTRADAARVMKAAEGEEPWFGIEQEYTLFEKDGVTPYGWPKGGFPGPQGPYYCGAGAHSVFGRIIVDAHYRASLYAGINISGINAEVMPGQWEYQVGPCTGIESGDHLWMSRYILLRVCEDFGVNVSWDPKPIPGDWNGAGCHTNYSTKAMREEGGMAKIIEAIEKMKLKHKEHIAAYGTGNERRLTGRHETASMDTFSYGVANRGASIRIPRVAEAEGKGYFEDRRPASNMDPYVVTGRIIKTTILNEA

SEQ ID NO: 9397 - protein, 705 aa, Yersinia pestis
MLTPIIRKFQYGQHTVTIETGMMARQATAAVMVSMDDTAVFVTVVGQKKAKPGQSFFPLTVNYQERTYAAGRIPGSFFRREGRPSEGETLTSRLIDRPIRPLFPDSFLNEVQVIATVVSVNPQINPDIVALIGASAALSLSGIPFNGPIGAARVGFINDQYVLNPTTDELKESRLDLVVAGTAGAVLMVESEADILSEEQMLGAVVFGHEQQQVVIENINALVAEAGKPKWDWQAEPVNEALHARVAELAEARLGDAYRITEKQERYTQVDAIKADVTEALLAQDDTLDAAEIQDILASVEKNVVRSRVLRGEPRIDGREKDMIRGLDVRTGILPRTHGSALFTRGETQALVTATLGTARDAQNIDELMGERTDSFLLHYNFPPYCVGETGMVGSPKRREIGHGRLAKRGVLAVMPSASEFPYTIRVVSEITESNGSSSMASVCGASLALMDAGVPIKAAVAGIAMGLVKEGDNFVVLSDILGDEDHLGDMDFKVAGSRDGVTALQMDIKIEGITREIMQVALNQAKGARLHILGVMEQAISTPRGDISEFAPRIYTMKINPEKIKDVIGKGGSVIRALTDETGTTIEIEDDGTIKIAATDGDKAKHAIRRIEEITAEIEVGRIYAGKVTRIVDFGAFVAIGGGKEGLVHISQIADKRVEKVTDYLQMGQDVPVKVMEVDRQGRIRLSIKEATTPDAEAPEAAAE

SEQ ID NO: 9398 - protein, 371 aa, Candida albicans
MNRSSYSSQSDNRYSRNPAVLCSFYSKIGACRHGEKCSKKHLKPISSRTILLANLYQNPTLNDDDYGHANGIGSETSQIIDNESVIKNSDTVGTVSQIDDSPHSNSGEVTKDETVETQEVETENSENIAETGDVKIDHNEDQKQIEDVKESDKVESSEEVQQDDKLHKEDTLEKESEDNIKQDENIEDAKLEDTEKDKLPEFTISQSQKDFDQFFQDIFVHISKLGQIRDIAVCENENNHLAGNVYVMFESAEDAYNANLQLNQEWFNGKPVYSDLSPVNDFNDACCEEYRDYHDCQRGAMCNYMHVRLPSSDIEESLYESQAKSYMLKQLEELKKELPGDIRSSSSTNDDETNGNENGISSTMAVLEQLS

SEQ ID NO: 9399 - protein, 704 aa, Bacillus halodurans
MEQERHEFSIDWAGRKLTVETGQLAKQANGAVLVRYGDTAVLSTATASKEPKDLPFFPLTVNYEERLYAAGKIPGGFIKREGRPSEKAILASRLIDRPIRPLFPEGFRNEVQVISIVMSVDQDCSSEMAAMVGSSLALSISDIPFEGPIAGVTVGRIDGQFVINPTQDQLEKSDIHLVVAGTKDAINMVEAGAEEVPEDVMLEAIMFGHNEIKRLIEFQEKIAAEVGKSKTDVVLKQVDPMLEQEVRVKAEEDLKQAVQVPEKHARQDAIEAVMDKVLETYEDNEDVPLSEVNEILHKIVKEEVRRLITVEKIRPDGREIDEIRPLSSQVGILPRTHGSGLFTRGQTQALSICTLGALGDVQILDGLGIEESKRFMHHYNFPQFSVGETGPIRGPGRREIGHGALGERALEPVIPSEQDFPYTIRLVSEVLESNGSTSQASICASTLAMMDAGVPIKAPVAGIAMGLVKQDEHVSVLTDIQGMEDALGDMDFKVAGTRKGVTALQMDIKISGIDRAILEQALEQARKGRMIILDNMLEAISESRSELSPYAPKILTMTINPDKIRDVIGPSGKMINKIIEDTGVKIDIEQDGTIYISSADTNMNNKAREIIEDIVREVEVGQMYLGTVKRIEKFGAFVELFKGKDGLVHISQLAEERVNKVEDVVKIGDEILVKVMEIDNQGRVNLSRKAVLKEQKKAEEQNQK

SEQ ID NO: 9400 - protein, 382 aa, Pseudomonas putida
MTSPVVIIGTGLAGYNLAREFRKLDAQTPLLLITADDGRSYSKPMLSMGFAKQKDADGLCMAEAGAMAEQLNAEIRTHTRISGIDPGHKRLWIGEEAVEYRDLVLAWGAQTVQVPIEGDGGHLVFPINDLEDYARFRAAAAGKQRVLILGAGLIGCEFANDMSLGGFKVDVVAPCEQIMPTLLHPAAAAAVQGGLEGLGVRFHLGPVLTRLQQVTQGLEAHLSDGSVIACDLVVSAIGLRPRTDLAAAAGLQTNRGVSVDRELRTSHANIFALGDCAEVDGINLLYVMPLMSCARALAQTLAGKPTAVSYGPMPITVKTPACPVVVSPAPQGCEGIWQVEGQGSDLKVLCLDADGKLLGYALTGAAVMEKLALNRQLPPVMA

SEQ ID NO: 9401 - protein, 864 aa, Penicillium chrysogenum
MASITTQTITQPETISFKNAQITVEDIIPTPGEPDIPLPPPSKNPVDILDVDKGTPDNHVPRDPRLIRLTGVHPFNVEPPLTALYKEGFLTSPELFYVRNHGPVPRVRDEDIPNWEISIEGLVEKPLVLNFREVLQKYDQITAPITLVCAGNRRKEQNTVRKSKGFSWGAAGLSTALFTGPMMADILRSAKPLRQAKYVCMEGADKLPNGFYGTSVKLNWAMDPNRGIMLAHKMNGEDLRPDHGSPLRAVVPGQIGGRSVKWLKKLILTDAPSDNWYHINDNRVLPTMVTPEMSAENRKWWTDERYAIYELNVNSVAVYPQHEEEIDLSTAGPTYTVKGYAYAGGGRRITKVEVSLDRGKSWHLSEIEYAEDKYRDFDGELFGGKVDMWWREASFCWSFWSLDVPVADLETSDAILVRAVDEALSAIPRDMYWSVLGMMNNPWFRVAITKQGNTLKFEHPTHPAKAGGWMERVKKTGGDLLNGNWGERVEGEEPIEPEPVKEINMKKDGLNRQIDLQELKANSSSEKPWFVVNGEVYDGTAFLEGHPGGAISVTSSAGLDVSEDFLAIHSETAKAMMPDYHIGTLDKASLEALKGDSTAGSDVPQAVFLQSGKWTKATLTEKKDVSWDTRLFVFDLEHEKQTLGLPIGQHLMIKVQDPSNNEAIIRSYTPMSDTNLIGKMELLVKIYFPTESIPGGKMTMALDKLPLGSKIDCKGPTGRFEYLGNGRVSISGKERHVRSFKMICGGTGITPVFQVLRAVMQDTQDPTTCVVLDGNRQEEDILCRSDLDAYVETDSQKCTVVHTLTKGSDTWTGHRGRISEELLAEYAAPEEQSMVLVCGPGPMEKSAREILLAQGWAESDLHFF

SEQ ID NO: 9402 - protein, 851 aa, Magnetospirillum magnetotacticum
MPEIIRTTCPYCGVGCGVIAARLDQSAPWTVKGDPEHPANYGKLCVKGSALAETLDLDGRLLHPLISGNRASWDEALDLVAETFSTAVREHGPDSVAFYVSGQLLTEDYYAANKLMKGFIGSGNIDTNSRLCMSSTVAGHVRAFGSDTVPGCYEDLDLADLVVLVGSNAAWCHPVAFQRTLAAKARRPEMRIVVVDPRRTATAECADLHLAIRPGSDAILFNGLLAHLKGEETQLDVGVPLDQIVQFFSWFADTEKTVTVWSQGINQSSSGTDKVDAIINCHLQTGRIGRPGMGPFSLTGQPNAMGGREVGGLANMLAAHMGFDEASIDRVGRFWNATQMAGKPGLKAVDMFKAVAEGKIKALWIMCTNPAVSMPEADLVKSAIAACPFVVISECEANTDTARLAHVKLPALTWGEKDGTVTNSERRISRQRPFLPAPGEAKGDWWIITQVARRMGFGPAFAWNGPGEIFDEFCRLTAFENASTRDLDLSGLVGADYAAIEPIQWPVRAPGQGTARLFADGRFYHADGKARMLDITPRPPARAADLAFPLILNTGRMRDQWHTMTRTGRAARLAAHAPEPVLLVHPKDALRFRLSDGGLARVSGNRTSVVLRVALDPGQRIGEVFAPIHWNDQTASSAVIGSLIDAATDPHSGQPELKQAPVLVEPLEAAWHGVLLSRNPVDLPRSFYWAKASGAAHSIWRLAGEAGEDWPITAKQWLGTDGEWIEFLDPNRGHYRGARLVEGRLDAVLFVFPWAMDFSPDWVAAAFGRAAIAGDERATLVAGAPPGGDRGRDKTVCACFNVGLSAIRAAIRDHRLSSAAEVGAMLKAGTNCGSCVPEIRAILTEAAPKVA

SEQ ID NO: 9403 - protein, 492 aa, Clostridium perfringens
MSKKAYIIGAGPGDEELLTLKAINALQKCTAVLYDRLVGNNILNYLNDDCEIYYCGKEPGCHYKTQEEINESIVELAKKGHIVGRVKGGDPYVFGRGGEEVLALVEENIPFEVIPGVTSPISVLNYAGIPITHRGLAQSFHIVTGMSARTLNVNWKALSKENGTLVFMMGLSNLETIVEKLLENGKDIETPCGVVMRGTTSKQRKVIGTLENICKKVREAKLESPCIIVVGDVVSLNEKLSWYEKLPLFGANICLTRSKEQSKEIKWKLKELGAEVTEINSIKIKETSENLDEYINTLEKYDHIVFTSVNAVNVFFDYLVKKRVDIRKIKADFAVLGKATKKALIARGIVPSIMAHSFTAEGLFEVLKDNIKEGEEVLIPCSSLSREYLFDNLASLGAKCHRVNIYDTICGDVKNPRAFKEVDMVLYTSPSTVKNMIDMIGLESLKEKVSIAIGPITLKALNESGIEGKMCKTHCGDGFLSEIEGIWQEVKK

SEQ ID NO: 9404 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9405 - protein, 248 aa, Zea mays
  misc_feature (210)..(210): Xaa can be any naturally occurring amino acid
MQEEPGRRPVPPFAGVDLRRPKGYPVPVAKEERPAPGGDPCPRCGSRDTKFCYYNNYNTSQPRHLCKSCRRYWTKGGSLRNVPVGGGTRKSSSSSSSSSAAAAATTTTTSTSPGAAPKATKRSKNSKRRRVAPAPDPAAPGTDASTADVASTAPSAATVAASEKPSATEHAAAAVATEKPPAAPPVSVGAFADTSPAPDAGSGGVRELLXPHPSRFEWPSGCDLGPPYWGWGTSVFADTDPALFLNLP

SEQ ID NO: 9406 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLEGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 9407 - protein, 437 aa, Bacteroides fragilis
MTVLRSMKDFSSMNITASILLFVTAIAAAVIANSPAASVYQEFLSHELHFRIGGFNLLSHAGHNLTMIEFINDGLMTIFFLMVGLEIKRELLVGELSSFRKAALPFIAACGGMVVPVVIYSMVCAPGTEGGQGLAIPMATDIAFSLGVLSLLGKRVPLSLKIFLTAFAVVDDIGGILVIAIFYSSHVAYEYLLWAALLYVLLYFIGKKGATNKIFFLVVGVVIWYLFLQSGIHSTISGVILAFVIPAKPQLNVGTYIERIRRIISTFPEMGANNIVLTNQQIAKLKEVESASDRVISPLQSLEDNLHGAVNYLVLPLFAFVNAGVMFSGEGEVIGGVTLAVALGLLAGKFLGIYSFTWLAVKSGLTPMPLGMNWKNISGVALLGGIGFTVSLFIANLSFGSAHPVLLNQAKLGVLSGTVMAGILGYLVLHWVLPKRR

SEQ ID NO: 9408 - protein, 668 aa, Zea mays
MTASQSSMSGGGEPGVRTVVWFRRDLRVEDNPALAAAARTAGEVVPAYVWSPEEDGPYYPGRVSRWWLSQSLKHLDASLRRLGACRLVTRRSSDAVVALIDLVRSTGATHLFFNRLYDPLSLVRDHRVKEQLSAEGITVQSFNADLLYEPWEVLDDDGFPFTMFAPFWNRCLCMPDPAAPLLPPKRINSGDLSRCPWDELIFEDESEKGSNALLARAWSPGWQNADKALTAFLDGPLVDYSANHKKADSASTSLLSPYLHFGELSVRKVFHQVRMKQLMWSNDGDRAGEESCTLFLRAIGPAGVLEVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQGALSEMWELEAASCAAIENGMEEGLGDSTDEPPIDFPQELRMEVDRQPAQPAIIHTPVVAGWRREDQRVPSMTSSLIRAETELTADFGNTSEDSRPEVPSNIHLQARAEREETVDGATGNTVRVNGNQQQQNLQNNMHRVLGIAPSISEASSSWTGREGGLVPVWSPPAASVHSDPYTADEADISSRSYLDRHQQSNTMMNWSQLSQSL

SEQ ID NO: 9409 - protein, 527 aa, Prochlorococcus marinus
MNEELNSWDKFCNYLWFDKKLNIWLDISKIIFTNDDIVTLEEKFTDVLSSIKELENGAISNIDENRQVGHYWLRNPSISPSSNIGEEISADINEISEFGKQILNGNIKNKNNQKYTDVLWIGIGGSGLGPLLITESLQKCSKGLNFSYIDNVDPFLISEKLEELAEKLSTTLFVVVSKSGGTPEPRIAMEIIKSHCENNSLEWNSNAIAITMKDSKLFNKAISENWLKIFNLQDWVGGRTSITSSVGLLPLALINENIFEFIRGASLMDEATRTSDFKNNPAALLSSAWYLTGDGVGKRDMVVLPYRDRLQVFSKYLQQLVMESLGKKFNRNGEVVNQGISVFGNKGSTDQHAYVQQLRDGIDNFFCIFIELLDSPSTNIFDGKENPKEYLSGFLQGTRSALSSENRQSITITLEKLNCFSLGALIALFERSVSFYAELVNINAYDQPGVEAGKKAAANIIDYQQKVSNLLEKGGEYSINEITSLIDNSVSEPIFFILREMCFGNEDYLVKGDWSNPNSLVIQKRNS

SEQ ID NO: 9410 - protein, 363 aa, Glycine max
MALLHKLAPFTSLYTNTPHSPPPRRHVIISFSVSPFTEKHSTERYQRDQWVYQSTTQEGQPQTTPFPPLPCDSASLRDDDIALQLPELKKLLQVLREKRECINGEGCEPGNVFLVGTGPGDPELLTLKAVRVIKSADLLLYDRLVSNDVLDLVGPGARLLYVGKTAGYHSRTQEEIHELLLSFAEAGATVVRLKGGDPLVFGRGGEEMDFLQQQGIQVKVIPGITAASPRVGELGIPLTHRGIANSVRFLTGHSRKGGSDPLFVSENAADPDSTLVVYMGLATFPSLAQKLMHHGLSPQTPAAAIERGTTLHQRTVFAELKDLHEKITSAQLVSPTLIIIGKVVELSPFWPIPTKEESCLMQA

SEQ ID NO: 9411 - protein, 624 aa, Oryza sativa
MASISGAAALRPRRRRAGCGCGGTPPPPLPPPPPRPPLHRGPLPLLLVLVGAAALLYPGGAARLQAGAERQHPRRVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEASCKDPAEPLTLDQIAERCHCPEDIEMIYKIIQHMAANDRALIAEGSCGSPRSIKVYLGECNVDEDMLAA

SEQ ID NO: 9412 - protein, 267 aa, Physcomitrella patens
MAAATACASTALAGQALLQPANELVRKVGTSQARVTMRKTVSKSSGSDSIWYGADRPKFLGPFSGETPSYLNGEFAGDYGWDTAGLSSDPETFARNRELEVIHARWAMLGALGCLTPELLAKSGVKFGEAVWFKAGAQIFSEGGLDYLGNPSLVHAQSILAIWACQVILMGAVEGYRVAGGPLGDVTDPIYPGGSFDPLGLADDPDTFAELKVKEIKNGRLAMFSMFGFFVQAIVTGKGPLENLNDHLADPVANNAWAYATNFVPGN

SEQ ID NO: 9413 - protein, 267 aa, Physcomitrella patens
MAACTACASTALAGQSLLKPVNELSRKVGSSQARVTMRRTVNKSAGSDSIWYGADRPKYLGPFSGETPSYLNGEFAGDYGWDTAGLSSDPETFARNRELEVIHARWAMLGALGCVTPELLAKSGVKFGEAVWFKAGAQIFSEGGLDYLGNPSLVHAQSILAIWACQVILMGAVEGYRVAGGPLGEVTDPIYPGGSFDPLGLADDPDTFAELKVKEIKNGRLAMFSMFGFFVQAIVTGKGPLENLNDHLADPVANNAWAYATNFVPGN

SEQ ID NO: 9414 - protein, 291 aa, Oryza sativa
MLMQDSLWGMHRVDMCALNVFCFTGKTHLEIHGVFRIAPQGGQVDQQLDGQYCLYTEPSGTDSINCSSICNAVLPIDIHRLIDRDQKQKTLSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLAGKNSHHIIEATFKAFARALRQATEYDLRRRGTVPRLQYSKETNGMASTAPRFLLTLGISVGCDNRT

SEQ ID NO: 9415 - protein, 371 aa, Bacillus cereus
MSKRDYYEVLGLSKGASTDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLDFEEAIFGKELNVEIPVEDPCDTCKGSGAKPGTSKETCKHCSGSGQVSVEQNTPFGRIVNRQACGHCSGTGQIIKEKCTTCHGSSKVRKRKKINVKIPAGIDNGQQIRVSGKGEAGVNGGPARDLYVVVHVRNHEFFEREGDHIICEMPLTFAQMALGDEVEVPTVHGKVKLKIPAGTQTGTEFRLKGKGAPNVRGYGQGDQYVVVRVVVPTKLTSQQKDLLREFAGQEEQDDSLFGKLKRAFKGE

SEQ ID NO: 9416 - protein, 303 aa, Burkholderia vietnamiensis
MSGFTNADVPDQSGKTFIVTGANTGIGLEIASTLAARRARVLLARRDEAKAEAAISRIRLKTPEANLAFLPLDLADLTSVRNAAKLVEKEPRVDVLINNAGVQGPKLKRTVQGFELTFGVNHLGCFAFTVLMLPRLTETSGSRIVVTSSGLHKSAKIEWDDLNAEKSYKWMPRYAASKLANLLFVFELDRRLRAAGIAVTALACHPGLAGTNLARDSWWGNIAMSLIGLFFNTPAQGAWGALQAATGQIKSGGYYGPTKTSELRGPSGECTPSQDARNPELAKRLWDVSVQLTRIDVELPSNA

SEQ ID NO: 9417 - protein, 99 aa, Arabidopsis thaliana
IVTEDSEVAEIFLRQVDSAAVFHNASTRFSDGFRFGLGAEVGISTSRIHARGPVGVEGLLTTRWIMRGKGQVVDGDNGIVYTHKDLPVLQRTEAVENGI

SEQ ID NO: 9418 - protein, 282 aa, Brassica napus
MASLRFSVTFPALLSLLLLSLWVVEAYTSRKLISNNEQEGQNISHLFKDGEFEDPTMYMFFKISDLKLGTKLPIYFNKNDLRKVPPLLTRQEADLIPFSESNLDFLLNHFSISKDSPQGKAMKETLKRCDFKAIEGEYKFCGTSLESMLDLAKKTIASNADLKVMTTKVMVPDQNRISYALHNYTFAEVPKELDGIKVLGCHRMPYPYVVYYCHGHKSGTKVFEVNLMSDDGIQLVVGPAVCHMDTSMWNADHVAFKVLKIEPRSAPVCHFFPLDNIVWVSK

SEQ ID NO: 9419 - protein, 679 aa, Ostreococcus tauri
MRDDTVEKEGTWEELDDLRRRARDEDWLIDVEASCSFERSLGKGSSGEAFLARWRGARVVVKRIEALKTTLAKRAFARECAIMARVRHPNVLAFYGAALSESRCDVVVEHAAGGTLKAWLHESGRQKRSLSERLDVGMDVARAFAYLESRTPSVMHRDLKPSNVFVAADGRAMVADFGLSRFVAANGEELTGETGTYIYMAPEVIRSEHYDNRADVFSYGVLLHELVTGIEPYQPHNSTAIQIATAVADQGLRPNIPEDTHAGLAAIIEMCWQQNASDRPSFAVILESMETMVPDILKEQEAKAAARRENPSVQAKAFQNLSHTFATWSSKMAELGGVWNPHVWSTSCEHSPHYTSSSRDHVHFDDAVRIRCRVLSERSVRAGRPRPRGHTACWRTQSAGGSLSRRFRKCCSSNHRRTRGNEYFRCGGTLITDTHVLSAAHCFFDDAGVSNVDDYSAVHVRLGAQEDVYAGVTSYVTQINGHPQFDGSSFDNDVAVLTLASPVDVQMYVPVTLSWDPSDVVAEGQIMGKIVGWGTREDGRLSSQLIEGDVPIVSRAQCTSAGSYNPADILPSHICAGYVEGGIDSCQGDSGGPLSVNSKQVGIVSWGDGCALARKYGVYFHVAASEGFIGLATDSRVYEWSPTDGSIPSPPPTPSPPSTPPPLGLFPFPMLSLFSLFSF

SEQ ID NO: 9420 - protein, 385 aa, Ostreococcus tauri
MPRAVRDRSTEGYADAATAVNEGLRLFAGKEYEGATRAFGAALTMSPSEDEARAARYNRACGFVKLNEYDAARDDLIAAVNEHNLKFKVLMDDPDLDAFRSTTQYGEVAAAVKGGQGSNTMVNLRAEAQEPFRFFKLYLFGGLAAGAGLGLFIIGTRLVKALQGGEGAPDLTETVTNLGINTAGLIAFTLLLRGELKGREQIIKKVEREEELGRLGVTLGDGEKSVLFSRLRGSYRVFVVAGSEEHINKTLASLEKYKEKLTKSKVVVLPVSMDKTDAERGDLPFGQRSRRSKASKTTEMTAAAAAALLGDDKKLKLTPVDVGAWQKWIINQVELSGFDPTARDVFFGVAKNGTIWKSGAGIPNWAKMFEELPDEDSLQGKVTGV

SEQ ID NO: 9421 - protein, 541 aa, Rickettsiella grylli
MNGAPSRFTHSDEWKNLKQHASDLKKIPLTELFLNDPFRAKTFSLTEKPLTVDYSKNPILEKTLTLLIQLADRLHLKQKINDLFQGACVNTTQHLPALHTALRNPHKKGLLINGEDILVKIHTNLDKMQQFVDAIHQHRWRGWSGKKITDIIHLGIGGSDLGPRMVVHALKKTWKENSINLHFISPIDDSLSYLIKKINLETSLFIITSKSFRTHETLSSATQLFKHFQEKYGAQSTKRHFLAVTHHIEKAIAFGIDPAHIFPLWNWVGGRYSLWSAVGLPIALAVGMSNFRTLLQGAYTMDQHFLNQPWRTNLPVILGLLGVWQVNFFQTSAHAILPYDTRLHYLPAYLQQLEMESNGKSISIHGKPIDYATCPIIFGAHGLNAQHTFYQLFHQGTAHFSADFICTLRDPSMNINDHRQVISSVLSQSKVFMEGYVSDNGYQCLPGNHANTILALNELNPFSLGLLIALYEHKVFVQSVIWQINPFDQWGVEYGKQLNKTIYQQLNNTDTSLMTPLDSSTRAFIERFQTLNCSLKHTRKI

SEQ ID NO: 9422 - protein, 393 aa, Triticum aestivum
  misc_feature (76)..(76): Xaa can be any naturally occurring amino acid
  misc_feature (89)..(89): Xaa can be any naturally occurring amino acid
  misc_feature (153)..(153): Xaa can be any naturally occurring amino acid
  misc_feature (185)..(185): Xaa can be any naturally occurring amino acid
  misc_feature (194)..(194): Xaa can be any naturally occurring amino acid
  misc_feature (252)..(252): Xaa can be any naturally occurring amino acid
MALQLLPSTLSVPKKGSSMGAVAVKDTAAFLGVSSKAKKASLAVRTQVATAPSSVTTSPGSATAKPSGKKTLRQGXVVISGASSGLGLXAAAKALAETGKWHVVMACRDFLKASKAAKAAGMADGSYTVMHLDLASLDSVRQFVDAFRPRRDXPLDVLVCNAAIYRPTARTPTFTADGHEMSVGXVNHLGHFLXLARLLMEELQKSDYPSRRMVIVGSITGNSNTLAGNVPPKESLGDLRGLAGGLSGASGXSAMIDGDESFDGAKAYKDSKVCNMLTMQEFHRRYHEETGITFSSLYPGCIATTGLFREHIPLFRTLFPPFQKFITKGFVSEAESGKRLAQVVAEPSLTKSGVYWSWNKDSASFENQLSQEASDPEKARKVWELSEKLVGLA

SEQ ID NO: 9423 - protein, 80 aa, Arabidopsis thaliana
  misc_feature (34)..(34): Xaa can be any naturally occurring amino acid
  misc_feature (63)..(63): Xaa can be any naturally occurring amino acid
MGRKTGFNPGKRSPGTPRKDGRMVFCGPPTGEEXIKLAGKQLEQHRKAHLAIPVISEFEWTTXGETPRRSSRISQKVKVT

SEQ ID NO: 9424 - protein, 209 aa, Yersinia pestis
MSNKKRSASSSRWLQEHFSDKYVIQAQKKGLRSRAWFKLDEIQQSDKLFKQGMTVVDLGAAPGGWSQYAVTQIGSKGRVIACDLLPMDPIVGVDFLQGDFRDELVLKALLERVGDKKVQVVMCDMAPNMSGTPAVDIPKSMYLVELALDMCRDVLAPGGSFLVKVFQGDGFDEYLREIRSLFTKVKIRKPDASRARSREVYIVATGRKL

SEQ ID NO: 9425 - protein, 698 aa, Staphylococcus aureus
MSQEKKVFKTEWAGRSLTIETGQLAKQANGAVLVRYGDTVVLSTATASKEPRDGDFFPLTVNYEEKMYAAGKIPGGFKKREGRPGDDATLTARLIDRPIRPLFPKGYKHDVQIMNMVLSADPDCSPQMAAMIGSSMALSVSDIPFQGPIAGVNVGYIDGKYIINPTVEEKEVSRLDLEVAGHKDAVNMVEAGASEITEQEMLEAIFFGHEEIQRLVDFQQQIVDHIQPVKQEFIPAERDEALVERVKSLTEEKGLKETVLTFDKQQRDENLDNLKEEIVNEFIDEEDPENELLIKEVYAILNELVKEEVRRLIADEKIRPDGRKPDEIRPLDSEVGILPRTHGSGLFTRGQTQALSVLTLGALGDYQLIDGLGPEEEKRFMHHYNFPNFSVGETGPVRAPGRREIGHGALGERALKYIIPDTADFPYTIRIVSEVLESNGSSSQASICGSTLALMDAGVPIKAPVAGIAMGLVTREDSYTILTDIQGMEDALGDMDFKVAGTKEGITAIQMDIKIDGLTREIIEEALEQARRGRLEIMNHMLQTIDQPRTELSAYAPKVVTMTIKPDKIRDVIGPGGKKINEIIDETGVKLDIEQDGTIFIGAVDQAMINRAREIIEEITREAEVGQTYQATVKRIEKYGAFVGLFPGKDALLHISQISKNRIEKVEDVLKIGDTIEVKITEIDKQGRVNASHRALEE

SEQ ID NO: 9426 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELADTFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 9427 - protein, 491 aa, Bacteroides fragilis
MATQNKTDIGLIGLAVMGENLALNMESRGWSVSVYNRTVPGVEEGVVERFINGRAKGKHIEGFTDIEAFVESIALPRKIMMMVRAGSPVDELMEQLFPYLSPGDILIDGGNSNYEDTNRRVKLAESKGFLFVGAGVSGGEEGALNGASIMPGGSEKAWEEVKPILQSIAAQAPDGTPCCQWVGPAGSGHFVKMIHNGIEYGDMQLIAEAYWVMKELLDMTNEEMASVFTRWNEGKLRSYLIEITGNILRHKDKTGAYLIDKILDAAGQKGTGKWSVINAMELGMPLGLIATAVFERSLSARKELREAAARQYQCRHSMAVYNKQDTEKEIFSALYASKLVSYAQGFAVLQRASDTFGWNLDLASIARMWRGGCIIRSVFLNDIAAAFEAKEKPKHLLLAPYFEEEIKGLLSGWKNLVAQAMREELPVPAFSSALNYFYSLVSADLPANLVQAQRDYFGAHTFERKDELRGVFFHENWTGHGGDTKSGTYNV

SEQ ID NO: 9428 - protein, 445 aa, Citrobacter koseri
AVMGRNLALNIESRGYTVSVFNRSREKTEEGIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 9429 - protein, 153 aa, Bacillus cereus
MGYIEDMRNLVGNQPLILIGSHAIILNEKNQILMQLRTDFNRWGIIGGALEYNETLEDALKREVYEETGLNIKNPELFRTYSGPDFFQIYPNGDQVHGVLVVYICREFNGELVCDQTESKELRFFPLDELPSNLPPVIERIIQEFQQSNLYVK

SEQ ID NO: 9430 - protein, 465 aa, Unknown
  Frankia sp. EAN1pec
MTVPTRPGPELRVRLPQVAPSVREFLATEAGGAVLLVIAAAAALIWANSPVADSYHDLWETTATLGVGDAALSMTLHHWVNDGAMAIFFAVVGLEINREFTTGELRDRRTVAVPALAAVGGLTLPALIYFLFNSSGPAAAGWGIPMSTDTAFVVGILALFGPRCPDRLRLFLLTLAIVDDIGAISVVAIFYTDQVDAVWLGAAAAVLVVIGVMRWMGVWRLPPYVVAALVLWVAIYSSGVHGTLAGVIIGLVLPSAPPRREQIDEVPIYVRALREDSTASRAALAVSAAKSTVSTSERLQYTLHPLSAYLIVPIFGLANAGVHLDSHTLADASTSPVTIGVAVALLVGNGIGITATSLVAMRTGLGALPGGVRYGHLVGAAVLAGIGFTISLFVTELAFTDEALAEQAKIGILVGSFAAAVLGTFVLRYVGERWSLCSPGSDEAIPALPPRPWHSPTPAVIPVIR

SEQ ID NO: 9431 - protein, 247 aa, Thermus thermophilus
MRPVVHVVGGGPGDPELLTVKGARLLGEARFVLYTGSLFPEGALRELAPKAALLDSKGMTLEEIVLALAEEARKGGGVVRLHSGDPGLYGTLLEEKEALEALGVGVEVVPGVTAAFALAARAGLSLTAPGVAQAVAFTRLGVRTPVPEGQDPKSLARKGLTLAVYLSGMHPRRLSRELLEAGLPGDTPVLYGHKVAQPGEEVGLTDLKGLAHLPARDTTVYLVGEALRAKGVRSLLYDPSFKHRYRR

SEQ ID NO: 9432 - protein, 126 aa, Kineococcus radiotolerans
MRRRRLQRHDRSISPGARRPVSLTVGPPCLLPSASAGGDRADTEPTLDGKAEDMPKKDGVIEIEGTVIEALPNAMFRVELSNGHKVLAHISGKMRQHYIRILPEDRVVVELSPYDLSRGRIVYRYK

SEQ ID NO: 9433 - protein, 446 aa, Escherichia coli
AVMGRNLALNIESRGYTVSIFNRSREKTEEVVAENPGKKLVPYYTVQEFVESLETPRRILLMVKAGAGTDAAIDSLKPYLDKGDIIIDGGNTYYHDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYSLLKHGLNLSNPELAETFTEWNKGELSSYLIDITKDIFTKKDENGIYLVDVILDEAANKGTGKWTSQSSLDLGEPLSLITESVFARYISSLKEQRVAASKVLSGPEVKPFTGDKAEFVEKVRRALYLGKIVSYAQGFSQLRAASEENNWNLNYGEIAKIFRAGCIIRAQFLQKITDAYAENPSIANLLLAPYFKKAADDYQQALRDVVAYAVQNGISTPTFSAAIAYYDSYRAAVLPANLIQAQRDYFGAHTYKRT

SEQ ID NO: 9434 - protein, 264 aa, Triticum aestivum
IGLIEKKLKNNIRWKGIDDSRPGEVSDDMSILQGDIEALTLQEHSLDGQISEMRDKLRELTEDENNQKWLYVTEDDIKSLPCFQNQTLIAIKAPHGTTLEVPDPDEVNDYPQRRYRIVLRSTMGPIDVYLVSQFEEMSGMETPPRPAQTISMDYLENPRTPLATGSNKDVEMENVQQGLIMPPDAPTTQDIGGMMKIVPSELDTDADYWLLSDTGVSITDMWKTAPDVEWEGIDINAEDFLEVGTPRQQDQPPSEMVDHPSCIS

SEQ ID NO: 9435 - protein, 258 aa, Xanthomonas campestris
MTAHRWRLDGQTALITGASAGIGLAIARELLGFGADLLMVARDADALAQARDELAEEFPERELHGLAADVSDDEERRAILDWVEDHADGLHLLINNAGGNITRAAIDYTEDEWRGIFETNVFSAFELSRYAHPLLTRHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAGSYITGECIAVDGGFLRHGF

SEQ ID NO: 9436 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9437 - protein, 235 aa, Thermus thermophilus
MRGKVYLVGAGFGGPEHLTLKALRVLEVAEVVLHDRLVHPGVLALAKGELVPVGKEGYGGKTPQEAITARLIALAREGRVVARLKGGDPMVFGRGGEEALALRRAGIPFEVVPGVTSAVGALSALGLPLTHRGLARSFAVATGHDPALPLPRADTLVLLMPLHTLGGLKERLLERFPPETPLALLARVGWPGEAVRLGRVEDLPGLGEGLPSPALLVVGKVVGLYGELLPKDHGL

SEQ ID NO: 9438 - protein, 104 aa, Unknown
  uncultured Frankia sp.
IWIHGTEPDPLMRSKTRIVKDGKEPEIWGFDGSSTNQAPGSNSDCVLRPVFITPDPIRGGDNKLVLCEVELTDFTPHPTNTRAFARAVAEKYADMGPHFGIEQG

SEQ ID NO: 9439 - protein, 423 aa, Prochlorococcus marinus
MNILQNLKKSDPVISNFINSEKNRQETHLELIASENFASIAVMQAQGSVLTNKYAEGLPQKRYYGGCEFVDEIEELAIQRAKKLFNANWANVQPHSGAQANAAVFLSLLQPGDTIMGMDLSHGGHLTHGSPVNMSGKWFNAVHYGVNKETSELNFDEIREIALETKPKLIICGYSAYPRTIDFESFRNIADEVGAFLMADIAHIAGLVASKLHPNPLPYCDVVTTTTHKTLRGPRGGLILCKDGEFGKKFDKSVFPGTQGGPLEHIIAAKAVAFGEALQPDFVNYSQQVIKNAKVLASTLISRGIDIVSGGTDNHIVLLDLRSINMTGKIADLLVSAVNITANKNTVPFDPESPFVTSGLRLGTAALTTRGFNETAFAEVGEIIADRLLNPNDSVIESQCKDKVLALCNRFPLYEGKLEASIK

SEQ ID NO: 9440 - protein, 445 aa, Prochlorococcus marinus
MKDEVLAQLNDLKIGKDTSITSNSHNENSRKKESHAKAKEPSNQLKNGLLGWYAVCSKRELKEDTPYCLTMFNEPLVIYRDKESNLRCVKDLCPHRGASFIGGEVIDGELVCPYHGARFSSNGECTNLNRITCNHIVDDNYNNYASKIHLYQYICKEIGDYIYIYYTGNAKTSLKDFEVTDQLETRFVESYGFDISDYAYEEVIVDFKCDWARIVENHIDILHLFWVHGETIPDNDVNRKVITSFNQEITREKNQIESKYKYKDKGNKEFIRIKFLPPGRVVIYKGDPSDSRYIQILDHIPLSNNQARVIVRHYRKFMKNKFITELLLFKKLQHRVFYKVFAEDYMILRTQTYNNQMGFVEKDNIKLLGEDKMVQYYWDWFKSSNIKDNPWELFPTNTDTNTVHQDIAMLYPPANNTRVKENSRSLFINILIRILIPIGFLVVLI

SEQ ID NO: 9441 - protein, 146 aa, Pisum sativum
MGFTDKQEALVNSSWELFKQNPGYSVLFYNIILKKAPATKGMFSFLKDSAGVVDSPKLQAHAEKVFGMVHDSAVQLRVSGEVVLGDATLGAIHIQKGVVDSHFVVVKEALLETIKEASGEKWSEELSTAWEVAYEGLASAIKKAMS

SEQ ID NO: 9442 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVVGDATLGAIHIQKGVVDPHFVVVKEALLETIKEASGEKWSEELSTAWEVAYEGLASAIKKAMN

SEQ ID NO: 9443 - protein, 250 aa, Arabidopsis thaliana
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQG

SEQ ID NO: 9444 - protein, 151 aa, Cryptococcus neoformans
MSDIYSYSVEFPKSTLPLSDLKGKTLLFVNVASKCGLTPQYKDLQALHEKYGDKGLAIIGFPCNQFKAQEPGTDDEVLQFCQVNYGVTFPIAKKGDVNGENTQPIWKYLKENAEPPVSDIDWNFSKFLVKDGKITWFPARSTKVSDVEAAL

SEQ ID NO: 9445 - protein, 416 aa, Psychrobacter arcticus
MTHRLLVNDKLPAKVVGMAIVASSAFYVGCASTENTSTVKDIAIDNPYALTDPNLAVATVAGGCFWCVEAGYEKIPGVVEVVSGYTGGKSENPTYSTVSAGGTGHTEAAQVYYDPTKITYNGIVQALWRIADPTDDKGQFVDRGTQYRPAIFYSSEQEKQIAEAAKQSLQASGVYKKPVVIEIMPVSEFYPAEEYHQDYYKKNPLRYKAYTFNSGRYQFIESVYGKKYELDFSQFKPTATSAKSVMSNISSAAVKPATVKASTGFDPDTFIKPTQAALKKSLSDIQYNVTQKDSTERAFDNEYWDNKEPGLYVDVVSGEPLYSSRDQYNSGTGWPSFTRPLNTSLVVEKADRGIFGTRTEIRSRYADSHIGHVFDDGPAPTGKRYCMNSAAMRFIPLAQMEAAGYGKWINDVKSGS

SEQ ID NO: 9446 - protein, 88 aa, Glycine max
  misc_feature (47)..(48): Xaa can be any naturally occurring amino acid
MGRRPARCYRQIKNKPYPKSRFCRGVPDPKIRIYDVGMKKKGVDEFXXCVHLVSREKEIVLSEDLEAGRIACSMSLERYAGRDALSLQ

SEQ ID NO: 9447 - protein, 309 aa, Zea mays
LPQLEVDELVEEIKSNRQLTQYLKAHPEGPASSEFDWGTSDTPRRSARLSEKVKATESPEGEKTPKRARSSSKRGKKEEKVDAEDANEAGEDGASAEGKGPDVEMKDAENAEDEKKDVPSAGKTEEMKDAAEKTEEVDDKKEEAPAVYAAEKNEEGDDKKEEEPPAEKTVEKEVVPAVDAAENTEQSTGGQAQPNDVAAPESENKGDGKPAESESAPLAFVDDAAPLVIVGEEKTEDSQAAESAVPSLASSEGEKKENGGATEPAAPPPADAEKGAENSGQVNTAPQEPTAANCDKGQIQPGASAVRCT

SEQ ID NO: 9448 - protein, 255 aa, Unknown
  Synechococcus sp. WH 7805
MTTISIVGAGPGAPDLLTRRAEQRIQSADVLIWTDSLVSPQIAALASDHCEQIRTSTLTLEQVIPLMIDRSSQGSRVVRLHDGDPCLYSALNEQICALADAGITVEVVPGISAYQATAAAINAELTIPGVVQTIVLGRTGGRTGVPEREQLDHLARLQASLCLYLSARHVDEVQSTLLQHYPADTPVAIGYRVSWPDQSIDVVPLKAMADATRARKLIRTTLYVISPALRERNGSERSRLYSPEHDHLFRPRGGD

SEQ ID NO: 9449 - protein, 559 aa, Brassica napus
MESFCDNDDNNHGNTTNLLGFSLSSNMLKMGGGGGEEALYSSSSSAATSSSVPPQLVVGDNSNNYGVCYGSNSAAGGMYSQMSVMPLRSDGSLCLMEALNRSSHSNQHHHTQVSSPKMEDFFGTHHSNTSNKEAMDLSLDSLFYNTTHEPNNNTNFQEFFSFPQARNHHEEETRSYQNDPGLTHGGGSFNVGVYGEFQQSLSLSMSPGSQSSCITGTHHHQNQNNQAQNNHQISEALGVETSVGFETTTMAAAAKKKRGQEEVVVVGQKHIVHRKSIDTFGQRTSQYRGVTRHRWTGRYEAHLWDNSFKKEGHSRKGRQVYLGGYDMEEKAARAYDLAALKYWGPSTHTNFSVENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMASNTLLSGELARRNINSIVVRNNNNEENAVNAVVDGGLNKEVSSPERELSFPAIFTLPQVGQKMFGANMVGNMSSWTTNPSAELKAVSHTLPQMPVFAAWADS

SEQ ID NO: 9450 - protein, 291 aa, Candida albicans
MIRSYIRNIILAILSPLLTTPPPLILPPPYEKIIQEITTVLSINNYDDGSLAPIILRLAWHCCATYDVTTNTGGSNGATMRFVPEITDEGNYGLDIARAALEPIKQRYPAISYADLWTLAGKVAIEYMGGPTIIWKSGRVDYTNDRCTPSNGLLPFADKDANHIRKTFTRLGYNDQQTVALIGAHGVGRCHKRFSGWEGKWTRTPKTFSNQFYVVLLNETWSQGEVPETGKTQYFNADKSLIMLNTDMELIRDKSYLHWVEIYAKDEPKFFHDFSSAFAKLLELGIKRETL

SEQ ID NO: 9451 - protein, 244 aa, Bacillus halodurans
MAVISMKQLLEAGVHFGHQTRRWNPKMDRYIFTERNGIYIIDLQKTVKKVEEAYNFVRELAADGGKVLFVGTKKQAQDSVKEEAERCGMYYINQRWLGGTLTNFETIQKRIDRLKKLEKMEEDGTFDVLPKKEVILLKKEMERLEKFLGGIKDMNSLPDALFVIDPRKERIAIAEAHKLNIPIVAIVDTNCDPDEIDYVIPGNDDAIRAVKLLTGKMADAVVEATSGAGEEAEEVAEVTEETTA

SEQ ID NO: 9452 - protein, 463 aa, Bacillus thuringiensis
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQKRQKLSYKMPLYPLSSYFSLAFLVLVLGIMAYSEDTRIALIVGPIWLIGLAIVYYMKGFHKIDETPNSKIS

SEQ ID NO: 9453 - protein, 569 aa, Clarkia gracilis
MSTPALISETEAWKDLKAHLEDIKRTHLRELMGDTERCQSMMVEFDNIFLNYSRQQASPDTINKLYKLADAAHLNQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVILGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLILHKIFTGNRPSLSILLPTLDAYRIGQLLAIYEHRVAVQGFVWGINSFDQWGVELGKSLATQVRKQLHASRVKGEAVEEGFNFSTKTLLTRYLEATSDVPADPSTLLPKI

SEQ ID NO: 9454 - protein, 680 aa, Staphylococcus aureus
MEIFETILIFIAVVILSSFVHTFIPKVPLAFIQIFLGMLLFITPIPVQFNFDSELFMVTMIAPLLFVEGVNVSRVHLRKYIKPVMMMALGLVITTVIGVGLFIHWIWPDLPIGAAFAIAAILCPTDAVAVQAITKGKVLPKGAMTILEGESLLNDAAGIISFKIAVGVLVTGAFSLVDAVQLFLIASIGGAVVGLLIGMALVRFRLTLMRRGYENINMFTIIQLLTPFVTYLIAELFHASGIIAAVVAGLVHGFERDRIMQVRTQLQMSYNHTWNILGYVLNGFVFSILGFLVPEVIIKIIKTEPHNLIFLIGITIVVALAVYLFRFVWVYVLYPYFYLAISPFQKMMTKNDDDNPTTEKPPKRSLYALIMTLCGVHGTISLAIALTLPYFLAGHHAFTYRNDLLFIASGMVIISLVVAQVLLPLLTKPAPKTVIGNMSFKVARIYILEQVIDYLNQKSTFETSFKYGNVIKEYHDKLAFLKTVEKDDENSKELERLQKIAFNVETKTLESLVDEGQITNSVLENYMRYAERTQVYRQASLIRRMIVLLRGALLKRRVQTRVNSASSLSVTDNLMELNKINKLVHYNVVSRLSKETTKDNTLEIGMVCDGYLMRIENLTPSNFFNSASEDTITKIKLNALREQRRILRELIDTDEVSEGTALKLREAINYDEMVIVDSMT

SEQ ID NO: 9455 - protein, 713 aa, Kineococcus radiotolerans
MQIWPGRPYPLGATYDGAGTNFALFSEVAERVELCLIDDSGKEQRLDLPEVDGFVWHAYLPSVMPGQRYGYRVHGRFHPESGARCQPEKLLLDPYAKAIEGQVDGDESLFSYYFDRPDEVNVEDSLGHTMLSVVVNPFFDWGNDRRPGHEYHESVIYEAHVKGLTMQHPDVPEEIRGTYAAMAHPAVIEHLTSLGVTAVELMPVHQFVQDTHLVDKGLSNYWGYNTIGFFAPHNAYSSNGQRGQQVQEFKSMVLALHEANIEVILDVVYNHTAEGNHMGPTLCFRGIDNEAYYRLVDEDKKHYFDTTGTGNSLLMRHPHVLQLIMDSLRYWVTEMHVDGFRFDLAATLARQFHEVDRLSAFFDLVQQDPIVSQVKLIAEPWDIGEGGYQVGGFPPLWTEWNGKYRDTVRDFWRGEPKTLGEFASRISGSSDLYAHSGRKPIASINFVTAHDGFTMRDLVSYNDKHNDANGEGGNDGESHNRSWNCGVEGETDDAGIIALRARQHRNLLTTLLLSQGVPMLLHGDELGRTQRGNNNVYCQDNELSWVDWDLSDAQRELLAFTQRVVNLRRTEPVFQRRRFFAGDAGHGGESEVGDIEWFSADGQEMTDADWADQSNPTVMVFLNGEAIPEPDRRGERIVGDSFLVLWNPWHEAVEFTLPEKAYGDGWAPRLDTADDQVGIVSIFTEESAFSPGAKLPVAARSVLVLARGPLGEK

SEQ ID NO: 9456 - protein, 137 aa, Solanum melongena
SSKYMTKSTGKDAFHLRVRVHPFHVLRINKMLSCAGADRLQTGMRGAFGKPQGVCARVAIGQVLLSVRCKDGNSNHAQEALRRAKFKFPGRQKIIVSRKWGFTKFSRTDYLKYKSENRIVPDGVNAKLLGNHGPLAA

SEQ ID NO: 9457 - protein, 340 aa, Streptococcus pyogenes
MKKQLRARLIYNPTSGQELMRKSVPEVLDILEGFGYETSAFQTTAQKNSALNEARRAAKAGFDLLIAAGGDGTINEVVNGIAPLKKRPKMAIIPTGTTNDFARALKVPRGNPSQAAKLIGKNQTIQMDIGRAKKDTYFINIAAAGSLTELTYSVPSQLKTMFGYLAYLAKGVELLPRVSNVPVKITHDKGVFEGQVSMIFAAITNSVGGFEMIAPDAKLDDGMFTLILIKTANLFEIVHLLRLILDGGKHITDRRVEYIKTSKIVIEPQCGKRMMINLDGEYGGDAPITLENLKNHITFFADTDLISDDALVLDQDELEIEEIVKKFAHEVEDLEQELEE

SEQ ID NO: 9458 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9459 - protein, 280 aa, Ostreococcus tauri
  misc_feature (1)..(1): Xaa can be any naturally occurring amino acid
XPAQDVPSTSGGALYDDVMQTAPPWGSLGRQAVLGVVALTGKAILDAANTTVVSGRERFERMISDRDRTSGEGLVTVCNHASTFDDPGVLSSLIPWSFFMGESAHAGVRWTLCADEICAKNSLREAFFLCGKALPIKRGGGVEQPAMRTAANLLARGDWVHVFPEGRVSKNGELGGMRRGLAKLLCDVEMSGGKRPIILPFFHSGMEHVKPYGKWQINVGNRVHVTVGEPLDLSDLTRQCARCEKNAKARDHLHTEIMRRIEKSLKDLERQNARERASPT

SEQ ID NO: 9460 - protein, 445 aa, Escherichia coli
AVMGRNLALNIESRGYTVSIFNRSREKTEEVIAENPGKKLVPYFTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9461 - protein, 381 aa, Ipomoea nil
MAIECVTTTPTRSDDPKAAAVVFDSSVLRHETNIPTEFVWPEHEKPGSYAAPECPVPVIDLAAFRSGDPAAVAETLKLVNEACKKHGFFLVVNHGVDPDRISDAIRHMDRFFDLPLSSKEKALRKVGESCGYASSFTGRFSAKLPWKETLSFRYSAQKECSHIVEEYFQESLGQDFAHIGLVYQKYSNEMSKLALEIMEVLGMGLGVNRKHFSDFFQENDSVMRLNYCPPCQKPEITLGTGPHCDPTSLTILHQDNSVNGLQVCVDNEWRSVSPSPNAFVVNIGDTFMALSNGIYKSCLHRAVVNSTITRKSMAFFLCPHEDKVVTPPPELVDSTHPRLYPDFKWPTLLEFTQKHYRSDTDTLLSFSAWLQQNQTPHATHP

SEQ ID NO: 9462 - protein, 709 aa, Xanthomonas campestris
MRHPASAAYATPSRIRQGRPFPRGAIFDGKGTNFALFSAHATRVELCLFDEQGNESRVDLPEYTNEIWHGYLPDVKPGQRYGYRVHGPYAPTEGHRFNHNKLLLDPYARELDGDLVWADELYGYTVGHPDGDLSFDERDSAPFMPKCVVVEDTYDWEDDARLLKPWNETVIYETHVRGYTMRNAQVPEAVRGTFAGLAQPSVLQYIKDLGITAVELLPVHAYLDDQHLLDKGLRNYWGYNTISFFALKSRYLSSGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRSGRRPWASVNFITAHDGFTLRDLVSYNEKHNIDNGEDNRDGSSNDGSCNYGEEGETDNAEILQLRERQMKNLLATLLLSQGTPMILAGDERAQSQGGNNNTYCQDNEITWLEWENDPTDGRLTDFVKSLTALRKRYPILSRGRFLNGQYNEEAGLRDLTWLNPGGTEMDDAHWTDAGARSVGLLLEGKAQTSGVKERGNDATLLIVINAYHEGVTFTLPSSDEPVHWKLALSTDEALEVDSMPAGASEFLAPPRSITVFECKVG

SEQ ID NO: 9463 - protein, 149 aa, Canavalia lineata
MGAFSEKQESLVKSSWEAFKQNVPHHSAVFYTLILEKAPAAQNMFSFLSNGVDPNNPKLKAHAEKVFKMTVDSAVQLRAKGEVVLADPTLGSVHVQKGVLDPHFLVVKEALLKTFKEAVGDKWNDELGNAWEVAYDELAAAIKKAMGSA

SEQ ID NO: 9464 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9465 - protein, 386 aa, Ipomoea nil
MAIECMIPTPTPNHERQEIENKPAAAVVFDSPVLRHESNIPTEFLWPDHEKPGPYAAREFQVPVIDMAAFRSGDPVAVAETCKLVDEACKKHGFFLVVNHGVDTELLSDGVREMDRYFELPLSFKEKALRKLGEHCGYASSFTGRFNAKLPWKETLSFRFSAEKECSHVVGEYFEKTLGQEFADLGELYQKYCNAMNTLALEITELLGMGLGVDRKHFSEFYQENDSVLRLNYYPPCQKPELTLGTGPHCDPTSLTILHQDSVSGLQVFVDNEWRAVNPTPNAFVVNIGDTFMALSNGLYKSCMHRAVVNNEIPRKSIAFFLCPHKDKVVTPPPELVDATHPKLYPDFKWPALLEYTQLHYRSDTDTLLNFATWLQQNQTLHATQA

SEQ ID NO: 9466 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9467 - protein, 135 aa, Haemophilus influenzae
MQILHTMLRVGDLDRSIKFYQDVLGMRLLRTSENPEYKYTLAFLGYEDGESAAEIELTYNWGVDKYEHGTAYGHIAIGVDDIYATCEAVRASGGNVTREAGPVKGGSTVIAFVEDPDGYKIEFIENKSTKSGLGD

SEQ ID NO: 9468 - protein, 257 aa, Rubrobacter xylanophilus
MGRVWFIGAGPGAPDLLTLRGARLISEADVVVWARSLVHEGVLEHARPGAEIVESTTLPLEGVRGVYERAAAEDLKVARVHSGDPSLYGAVLEQIELCEELGLAWEIVPGVSSLGAAAAALGRELTVPEVSQSVILTRRAFRTPMPENESIRGFAAHRTTMAVFLSAARPRLLQEELLSGGYPPETPCAVVYRASWPDEKVIECPLGELAERVRGAGIKRQALILVGPALGAGGRRSRLYSPRFSHMFRRAEGEGDA

SEQ ID NO: 9469 - protein, 445 aa, Escherichia coli
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGNYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYSQNAGIANLLLAPYFKQIADDYQQALRDVVAYAVQNGIPVPTFSAAIAYYDSYRSAVLPANLIQAQRDYFGAHTYKRT

SEQ ID NO: 9470 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVLGDATLGAIHIQKGVVDPHFVVVKEALLETIKEASGEKWSEELSTAWEVAYEGLASAIKKAMN

SEQ ID NO: 9471 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVLGDVTLGAIHIQKGVIDPHFVVVKEALLDTIKEASGEKWSEELSTAWEIAYEGLASAIKKAMN

SEQ ID NO: 9472 - protein, 236 aa, Nicotiana tabacum
MTRRYWNINLEEMMEAGVHFGHGTRKWNPKMAPYISAKRKGIHITNLTRTARFLSEACDLVFDAASRGKQFLIVGTKNKAADSVEWAAIRARCHYVNKKWLGGMLTNWSTTETRLHKFRDLRMEQKTGRLNRLPKRDAAMLKRQLSRLQTYLGGIKYMTGVPDIVIIVDQHEEYTALRECITLGIPTICLTDTNCDPDLADISIPANDDAISSIRLILNKLVFAICEGRSSYIRNP

SEQ ID NO: 9473 - protein, 372 aa, Wolbachia endosymbiont
MSKKDYYDLLEVGRNASIDEIKKAYKKLALRYHPDRNPGNQEAEEKFKEVTAAYEVLSDSEKRAGYDRYGHEGASGGFQGFSSAGDFSDIFNDFFGGGFGGGASRSRAKRSTTGVSGADLRYDLEITLEDAFKGIQAPIHYVTNVKCDTCQGTGGEGAIKPVQCHTCQGSGRIRTQQGFFTIERTCTTCYGEGEIIQNKCKKCGGSGRRRDEVNISVSIPKGIEEGAKVRISGKGEAGTKGGKSGDLYVYVKIIFHKIFARNKADLHCKVPIRMTLAVLGGEIDIQSIDGAKIKVKVPEGTQTGTKLRCREKGMPYMNSHARGDLYVQVIVETLNPKNLTKKQIELLKALEEEENASVQQQSEGFFSKVKKK

SEQ ID NO: 9474 - protein, 183 aa, Bacillus anthracis
MNIEIKDTLISEEQLQEKVKELALQIERDFEGEEIVVIAVLKGSFVFAADLIRHIKNDVTIDFISASSYGNQTETTGKVKLLKDIDVNITGKNVIVVEDIIDSGLTLHFLKDHFFMHKPKALKFCTLLDKPERRKVDLTAEYVGFQIPDEFIVGYGIDCAEKYRNLPFIASVVTEESYNLKSR

SEQ ID NO: 9475 - protein, 263 aa, Calystegia sepium
MSFGQGKWSLQGMTALVTGGTRGIGYGIVEELAGFGAEVYICSRKQNEVDECVGKWREKGFKVAGSACDISSRTQREELIKNVAHHFNGKLNILVNNAGTILPKDATEFKAEDYTLIMGTNFEASFHLCQLAHPFLKASSMGTIVFNSSVAGIIPVFKTTLYAASKGAINQVTKNLACEWAKDNIRVNSVAPWVIRTKLVNDFDSESEGSEEIERMIRRTPISRPGEVGEVSSLVAFLCLPAASYITGQTICVDGGYTITGFP

SEQ ID NO: 9476 - protein, 952 aa, Ostreococcus tauri
MGISVPFVGRRGRARARGNEDGRCDERGTPCLPMPREFIRAQLAANMGSEEALAKAKVVGATPDARDEGTPDAWVPRHESLVRLTGTHPFNVEPPLTELMECGGITPAELHLVRNHGAAQKCEWDSHRVTISGEDLKKSRSYTMDELLAKPAMTMPMLLVCAGNRRKEQNMYKKTIGFGWGPAGLSNSLWTGVPLRILLQECGVTCVTEKRQYVCFEGPEGELPNGPKGTYGTSIPLCKALDPAEDVMVAYAQNGEALRPDHGYPVRLLIPGYIGGRMIKYLTTIRITEQPSDNFYHFRDNRIMPPGVDAAMADKEGWWEKPEYIFNELNINSAISSPAHGERIPLDSKTYTVKGYAYTGGGHAITRVEVSLDGGYEWRLCNVVRPCAPNMYGKQWCWFFWNLEVDTAELAGAKEVMCRAWDQANNTQPRDFTWNLMGMGNSCHFRCKLSVSEDAIGRYVVGEHPTEPGALKGGWMGNEAGGWKPIIEMLESARAGEEKITTSEAVVTIRKKEEDKPADVVRENVRYITMEEVAKHNSEEDCWIVVKNKVYDVNEYIKSGVHPGGNASITMNAGEDTTEDFEAVHSDKAWKQLEPYYIGELGTTEQAKATADVKVIKQDDEPKRKFPEFPKRGGVNLLTWYEEHKEAYGDMITGEAAEAAAFDRMWAGAKFVVPKDAPLGLNPKKWMQLKIDKKIPLSHDSILLRLKLESDEHQCGMPVGYHIYLRGEWNGKKVMRAYTPSSLNGTLGAIELVVKIYYSDVHESYPNGGALTQYMHHLNEGDAIEVKGPVGNIKYLGGGNFTIDNKPLSPVKKMTLLGGGTGVAPMLQLIVAVLADEKDQTELSFIYANKTEDDVLLKYTLDRLEREHPSRFKVHYCISNETWAAEKKKGEEWSADRITYSRISLPIIEKYGFAANGTSHVAVMCGPPSFEEDTCIPALEKLGYPKETIIRY

SEQ ID NO: 9477 - protein, 172 aa, Methanococcoides burtonii
MVRKPASMYRNVKSRSFTRRKYMGGVPGSQVIHFDMGNKTADFPVKITLLADERCQIRHTALEAARITANRAMTTAAGRSGFHMKLRVYPHEVLRENKQATGAGADRVSSGMRAAYGKNVSTAARVSARQKIFTISVNKEHFIIAKDALRRAGQKLPTPVTIVVDQGQELVR

SEQ ID NO: 9478 - protein, 306 aa, Ralstonia solanacearum
MSARNGFTEADVPDQSGKGFIVTGANTGLGLETSRVLAARGARVLLACRDRSKAEAAMAHIRQTHPGADLAFLPLDLADLASVRAAAGQAMTAPRIDALINNAGVMMPPLMRTTQGFELQLGVNHLGGFALTALLLPKLAQTPGSRVVVTSSLAHRGASIDWDDLSAATRYNRVKRYGASKLANALFFFELDRRLRASGSPVTAVGCHPGAAVTDLVRYMGALQLLQPLVRRFLNTAAMGAWPTLQAATGPVQPGGYYGPTGLRGIRGPSGRATRSAQAQDPLLAQRLWDVSIAMTGIDPGLPVEN

SEQ ID NO: 9479 - protein, 933 aa, Oryza sativa
MEERSRWESECGREMWALRYGVRRENRYIWPKSTRFGASSIFGGLNAVSVGGPFSSRICHISDGGPDEGSPGDALRRVRGFWWWWGQCGGRWMGIPEVVVPPRAAGPRRYKGLVPWRFQPGFVRPPPVKPPAAAAAVAGGGVAGTPGGKGRGLGASGEGVGSSGGRGDPQSRRCTHSASAKGSGDARSVEEGGPRVAGDDGGSGKSGVAAEGSGFEGLRNGRGGGVGTAAAEDCGLEKSNPDGIVGDADVHLESGSDARDGECVSEGLKKPCVNNSNGSSAADCAPKVKKGNDSGNGGADECNAAAKSSNLACPGNNGDETNRKGRKVVLPWRFQVGFKRSFSKAFCSDSESSGPSGTQFYRAQDSSTPCTPATRSSVRCYASAHSGVRVSAMRDFSVKGEKETSTPYKKSKTGMDGPSQGMPKNGVVLARENIMGSLQNFRLIYRDLLDEEEEKSTEAVIRPDLQAYRIFRERFITDCDEKKYIGNVPGIKVGDIFHLRVELCVVGLHRPHRVGVDHIKQEDGTCIAVSIVSYAQSSDIKNNLDVLVYSGAMTAIANQKIEGTNLALKKSMDTNTPVRVIHGFVTHLNGNCQRKKIPTYIYGGLYIVEKYWREKEGNDRYVYMFRLRRMAGQKHIDIQDILNSGQAESYGGIIIKDISRGLEKIPVSVVNSISDEYPMPYRYIAHLQYPRNYQPAPPAGCGCVGGCSDSKRCACAVKNGGEIPFNDKGRILEAKPLVYECGPSCKCPPTCHNRVGQHGLRFRLQVFKTKLMGWGVRTLDFIPSGSFVCEYIGEVLEDEEAQKRSTDEYLFAIGHNYYDEALWEGLSRSIPSLQKGPDKDEEAGFAVDASKMGNFAKFINHSCTPNLYAQNVLYDHDDKSVPHIMFFACEDIPPRQELSYHYNYTIDQVHDANGNIKKKKCLCGSIECDGWLY

SEQ ID NO: 9480 - protein, 393 aa, Ostreococcus tauri
MAFILMFSAPFCFAMSMVETFEGFLICRLGIGLGLATFVCTQFWMSNMFNRKCVGLANATSAGWGNLGGGVTQFLMPGIYAICFAGCSKKAFLAWRWAYIVPGLAHVLTAFLTLAYGQDMPDGNYKLLTTSGAMEKKNALMVNLLGMKNYRMWAMVLTYGACFGVELTMNNIVAGYLFDQFGVSLQVAGVLASCYGLMNIFARSVGGIVSDWSSEKFGMRGRLWTLWIMQTLEGVLCIFMGLSKNNLGATIAFMVAFSICVQASEGASYGIVPFISRRALGVVSGFIGAGGNAGSTIVTALFFTKDSIETHEGLVYLGYYVIAVTALVIPIHFPMWGSMLFPASKDATEEDYYMSEFSPEEVKAGVAAPVQKFCENARAERPKWKRAETAVSP

SEQ ID NO: 9481 - protein, 727 aa, Oryza sativa
  misc_feature (286)..(286): Xaa can be any naturally occurring amino acid
  misc_feature (298)..(300): Xaa can be any naturally occurring amino acid
  misc_feature (303)..(303): Xaa can be any naturally occurring amino acid
  misc_feature (572)..(572): Xaa can be any naturally occurring amino acid
  misc_feature (593)..(593): Xaa can be any naturally occurring amino acid
  misc_feature (602)..(602): Xaa can be any naturally occurring amino acid
  misc_feature (661)..(661): Xaa can be any naturally occurring amino acid
MRNLLLLPLLVAVAATVPLAAALSADGVALLAFKTAVTDDPSGALSSWSDADDDPCRWAGVTCANTSSSGPRVVGVAVAGKNLSGYVPSVLGSLALLRRLNLHGNRLSGTVPPALANATSLHSLFLYGNSLTGGLPPELCDLPRLQNLDLSDNSLTGSLPPELRRCKQLQRLMLSGNGFSGEIPAGVWPEMVSLQLLDLSDNSLTGAIPPELGKLAALAGTLNLSRNHLSGGVPPELGHLPATVTLDLRFNNLSGEIPQSGSLASQGPTAFLNNPGLCGFPLQVPXRAAPPSSSTPPXXXAAXSISGAGGPRQPVKTSLIVLISVADAAGVALIGVIVVYIYWKLRDRRGDGCGGDGDDDEERKRGLFPFPCMRADDSSDDGSDAGDDGGGGGEEGQLVAIDKGFKMELDELLRSSAYVLGKGGKGIVYKVVVGNGTTPVAVRRLGGGAAAAERYKEFAAEAGAIGRVRHPNVVRLRAYYWSADEKLVVTDFVNNGNLATALRGRSGQAATLSWSVRLRIAKGAARGLAHLHECSPRRFVHGEVKPSNVLLDADYNAVLADFGLARLLTIAXCADPSSASGGGLMGCALPPTXVKPASAAAXHHHRPSAYRAPEARAVGARPSQKSDVYSFGVVLLELLTGRPPEHHASPSASTSSSASAXPEVVRWVRQGFEDARPLSELADAGVLRDGGARKEVVAAFHVALGCVEADPERRPRMKAVAESLDKI

SEQ ID NO: 9482 - protein, 297 aa, Oryza sativa
MGTLVGHVAPGAGFLLVGLWHLYNHIRLFLLRPTAYVAPVWFPVRRARYLELALVIAGAVASILMELVVGPARHQPFDADGTVPSDHLHNFEHASISLALLVYAAAAAALDVARVPHGRAVSQLVAAVAFAQQLMLFHLHSADHAGVEGQYHLLLQGVVAVTLAATVLGVAAPRSFAVSLVRSASLVLQGVWFLAMGVMMWTPALLPKGCFLSREDGHDVARCRADDGGDALARAKALVNLEFSWLYPEEPRYMPLVRGDCRDDDEDGGGDGDDNDVEAGKGGAGHVLREPLEIARP

SEQ ID NO: 9483 - protein, 889 aa, Zea mays
MSTCVEQPTHSASLDPTAAQRLPYPDLPVDILRRSSVRGSGFVAAALVSSARKADDDARHDDDDPSGDRHETYGSHYLANLGVEQSVRDEGTVDAWVESSQSLIRLTGKHSLNGELPRLMRHGFITPVPRHYVRNHGPVPRGDWATWTVEVTGLVRRPRALTMDELARDFPALELPVTLVCAGNRRKEQNMVRQTLGFNWGPGAVSTSVWRGARLSDVLRRCGSMSRKGGALFVCFEGAEDLPGGGGTKYGTSITREVALDPTMDVMLAYQQNGGPLLPDHGFPVRLIVPGCTAGRMVKWLKRIVVAPAESDNYYHYRDNRFLPSHVDAKLADAEGWWYKPEYVINEMNTNSVITTPAHNEFLPINAITTQRIYTMKGFAYSGGGKKVTRVEVTLDGGENWLLCELDHPEKPTKYGRYWCWCFWSIDVELIDLLACKEIAVRAWDQSLNTQPEFLTWNLMGMMTNCWFRVKVNVCRPRHGEKAGLAFEHPVRTNQPGGWMAQQKHLETAERTSAATSTTNQQFTMSEVRKHASQDSAWIVVHGHVYDCTAFLKDHPGGADSILINAGTDCTEEFDAIHSDKAKELLDTYRIGDLVTTGGAEQRSPLELAPSPPIRHEGPAAPVIALSNPREKVPCQLVARTVLSRDVRLFRFALPSSGQVLGLPVGKHIFVCASIDGKLCMRAYTPTSSVDEVGHFDLLVKVYFRNENTKFPDGGRMTQYLDSLPVGAHVDVKGPLGHVEYVGRGGFVIDGKPRKAGRLAMVAGGSGITPIYQVIQAVLRDQPEDKTEMHLVYANRTEDDILLRAELDRWAAEYPERLKVWYVVSQVKRLDEWKYSVGIVTEAVLRDDVPEARDGTLALLCGPPSMIQSPILPNLEKMKHQLDDSVVSF

SEQ ID NO: 9484 - protein, 859 aa, Pichia angusta
MDSIVTEVTYGLEIKKIKDITELPFPVRQDSPLTEVLPTDLKTKDNFVARDPDLLRLTGSHPFNSEPPLTKLYDSGFLTPVSLHFVRNHGPVPYVPDENILDWEVSIEGMVETPYKIKLSDIMEQFDIYSTPVTMVCAGNRRKEQNMVKKGAGFNWGAAGTSTSLWTGCMLGDVIGKARPSKRARFVWMEGADNPANGAYRTCIRLSWCMDPERCIMIAYQQNGEWLHPDHGKPLRVVIPGVIGGRSVKWLKKLVVSDRPSENWYHYFDNRVLPTMVTPEMAKSDDRWWKDERYAIYDLNLQTIICKPENQQVIKISEDEYEIAGFGYNGGGVRIGRIEVSLDKGKSWKLADIDYPEDRYREAGYFRLFGGLVNVCDRMSCLCWCFWKLKVPLSELARSKDILIRGMDERMMVQPRTMYWNVTSMLNNWWYRVAIIREGESLRFEHPVVANKPGGWMDRVKAEGGDILDNNWGEVDDTVKQAERRPHIDEDLEMMCNREKMDVVIKYSEFEAHKDSETEPWFAVKGQVFDGSSYLEDHPGGAQSILMVSGEDATDDFIAIHSSFAKKLLPSMHLGRLEEVSSVTKVKSVEQNVKREVLLDPRKWHKITLAEKEVISSDSRIFKFDLEHSEQLSGLPTGKHLFLRLKDSSGKYVMRAYTPKSSNSLRGRLEILIKVYFPNREYPNGGIMTNLIENLQVGNQIEVKGPVGEFEYVKCGHCSFNNKPYQMKHFVMISGGSGITPTYQVLQAIFSDPEDRTSVQLFFGNKKVDDILLREELDHIQEKYPEQFKVDYSLSDLDHLPENWSGVRGRLTFDILDTYVRGKKMGEYMLLVCGPPGMNGVVENWCNARKLDKQYVVYF

SEQ ID NO: 9485 - protein, 381 aa, Rickettsiella grylli
MAKKTDYYETLGVSRHATDSELKKAYRKLAMKYHPDKHHAAETQQAKEAEEKFKAISEAYDVLSDSKKRAAYDQFGHAGVESTGTSGNAQGFNFNDVFGDIGDVFGNIFGNRGGPQQSQRAQRGADLRYTLELDLESAIHGTTVQIRIPRLVTCKSCQGSGARKGTKPIVCKTCGGQGQVRIQQGFLTIQQTCPECHGEGRIITTPCPDCRGQGHVQETKTLAVKIPAGIDEGNRIRLAGEGEAGHRGAPAGDLYVQIHLKPHPLFKREGNNLYCDVPIHLTLALLGGDIQIPTLTGIVNLHIPPETQSGKVLRLRGKGVPGRPGGTGDLLCRVSVETPVHLTKAQKELVIALENALKNGNHYPKAKIWFEHVKKFFSKQY

SEQ ID NO: 9486 - protein, 643 aa, Ostreococcus tauri
MGTRERARVGADGASRARTRWSRRVVSPARAWEGTGGVETLGTVTTRRGDRANGTRAATGKDADGGKTLEERIASGEFTVQAKTGPYRVVADAIRGAIPENSGTFGRGAMSKMPVATGDIREIAGQPVFVPLYKLFLAYGEMFVLAIGPKKFVVVSDNAVAKEMLLTQAKSFSKGLLSEILDFVMGQGLIPANGEVWKIRRKVIVPSLHKKYVTSMVGMFGDCGLKGMAQLARAEKMGESVEMENFYSRFALDIIGKAVFNYDFDSLTTDDPVIKAVYTVLREAEYRSVTFIPYWKVPPLRWLVPRQRQCQEALKVVNDTLDELIDRCKKIVEEEDEEFVEEYMNTDDPSILHFLIASGDDVTSKQLRDDLMTLLIAGHETTAAVLTWTTFLLAKHPDIKQKVFEEVDRVVGDRNPTVADMRELVYTTRVINESMRLYPQPPVLIRRALEPVTLGGYNIDAGTDFFISVWNLHRNPRIWPEPDAFKPERFPIEGPMPNEYTEDYAYLPFGGGQRKCVGDQFAIFESIVSLAMLMRRFDFELDESKHPDGECGMTTGATIHTTNGLHVRLKRREGRGGAEMSGAVRGKALTELDDVDVVRGSIDAPTASADEVDVLIAEDIDAGTVEKIQRATKIIEEEEARAR

SEQ ID NO: 9487 - protein, 753 aa, Triticum turgidum
MEIRRWLLRLLALLTTTILLSPSTSTSSSISTVDDLQALLSFKSLITKDPLGALSSWTINSSSNGSTHGFCSWTGVKCSSAHPGHVKVLCLQGLSLSGTVSPFLGNLSRLRVLDLFNNKLEGQIPPSLGNCFALRRLNLSFNSLSGAIPPAMGNLSKLLVMSISNNNISGTIPLLFADLATVTMFSIKSNNVHGEIPPWLGNLTALKHLNMGGNMMSGHVPPALSKLIHLQFLNLAVNNLQGLIPPVLFNMSSFELLNFGSNQLSGSLPQDIGSILTNLKSFSLFYNKFEGQIPASLSNISSLEFIVLHGNRFRGRIPSNIGQSGRLTVFEVGDNELQATESRDWDFLTSLANCSSLVLVGLQLNNLSGILPNSIAPDKLASHKLIHILVFALVGGFILLGVCIATCCYIKKSRGDAGQVQETLPEMFQRMSYAELHLATDSFSVENLVGRGSFGSVYKGTFGSGANLITAAVKVLDVQRQGATRSFISECNALKRIRHRKLVKVITVCDSLDHSGSQFKALVLEFIPNGSLDKWLHPSTEGEFQTPSLMQRLNIALDVAEALEYLHHHIDPPIVHCDVKPSNILLDDNMVAHLGDFGLAKIIRAEESSQSLTGQSSSVGIKGTIGYLAPEYGMGTEISVEGDVYSYGVLLLEMLTGRRPTDPFFNDTTNLPKYVEMACPGNLLEIMDVNIRCNQEPKATLELFAAPVAKLGLACCRGPARQRIRMSDVVRELGAIKRLIMASQNSASWSTAQ

SEQ ID NO: 9488 - protein, 355 aa, Oryza sativa
MAAMATTASSLLKTSFAGARLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAHPELILASKDDGEIVDA

SEQ ID NO: 9489 - protein, 445 aa, Escherichia coli
AVMGRNLALNIESRGYTVSIFNRSREKTEEVIAENPGKKLVPYYTVKEFVESLETPRRILLMVKAGAGTDAAIDSIKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9490 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLSLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9491 - protein, 273 aa, Oryza sativa
  misc_feature (208)..(208): Xaa can be any naturally occurring amino acid
MPPPSPPLFLSLPSPPPPPLPHLLPSHRPAAALTLAPALSSRRVSSVCPVASQRHSDYFDPRAPPPPPPRDGYGGPAYSPPAAQGGQQNGRVFSTYSIYKGKAAMSLDPRPPQFVPLDSGAYKVVKEGFVLLQFAPAVATRQYDWTRKQVFSLSVWEMGSLLTLGPTDSCEFFHDPFKGRSDEGKVRKVLKVEPTPDGNSRFFNLSVXQNRLLNIDEHIYIPITKGEFAVIVSTFNYIIPHLMGWSTFTNSIKPEDSRAYTRPQSGPEYEWRR

SEQ ID NO: 9492 - protein, 196 aa, Unknown
  Azoarcus sp. BH72
MRTTALALTLLALATAAVVYAASEAPVPAATQAAAPASPLLDHSFRRLHGAETLNLRERYAGQPLLIVNTASHCGYTGQFKELEAIHQRYRAQGLKVLGFSSDDFNQEADNEAKAANVCFVNFGVTFDMFAPIHVRGGDAHPLFRELARQSQAPRWNFHKYVVDRQGKVVASFESAVKPDAPEVLAALERAIAGAR

SEQ ID NO: 9493 - protein, 412 aa, Zea mays
MADTGRDAFPDEAEPAFTLDEYMEDIEAVELEADLVLGGDEGKECTYAGGYLKRQAVFSCLTCVPDGVAGVCTACSLACHDGHEIVELWTKRKFRCDCGNSKFGGHLCKLCPEKDYENSANTYNHNFKGSYCTCGRPYPDPEAKEQVEMIQCSICEDWFHGDHIGLNSIEEIPRDEEGEPLYEELICHKCSSVCHFLKLYPDTIWASGKPNLAVETDASDSNVMKKPSGHADPEKHENGALVDNTVGEKTSVENDSTKAIAVPEEANLGSSSGNNCKLGVDVNTMPAITDKSEPFFMSKGWRETLCRCETCFNFYAQRGIAYLIDKEDSIEEYEKIAKQKREMKLEQQQGAETNFLNSLNHVQKIEMISGINDMKNEFQSFLESFDASKPVTSDDIHSFFENLAKKKKQRLS

SEQ ID NO: 9494 - protein, 314 aa, Symbiobacterium thermophilum
MRKVVILGTGPAGLTAAIYTARANLQPLVIEGNEPGGQLTTTTEVENFPGFPDGIMGPELMDNMRRQAERFGAEFRRGYVTGVDFSRRPFRITVDETDVIEAEAVIIATGASAKHLGIPGEDENIGRGVSYCATCDGFFYRGKKVLVVGGGDSAMEEANFLTKFADVTVVHRRSELRASKIMQERARANPKISWVLNAVPVEVLADERGFKALKVRDKETGEERLLEADGMFVAIGHKPNTDFLRGQIDMDELGYIKTIPGTAQTNVPGVFACGDVQDSRYRQAITAAGSGCMAALDCERFLEEVAAQEGSLTK

SEQ ID NO: 9495 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAHAAGDKDEFIEKVRRALYLGKIVSYAQGFSQLRAASEEYNWDLDYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9496 - protein, 571 aa, Clostridium tetani
MEGYAMSKKYLIVGGVAGGASTAARLRRLSEEDEIIMFERGPHVSFSNCCLPYHLAGLIKTANQLVLMSPEQFKKQYNIEARVNSEVIDIDRAKKEITIKDTLTGKEYTENYDKLILSPGAKPIVPPIKGIEDINLFTVRNVIDIDKLNKFVSTMKTKNATVVGGGFIGIEVAENLKEAGFNVTLVEAMPQVMKIFDYDMVQILHKELHDKGINLIVNDKVASFEKDTVVLESGKRVEAEAVVMAIGVTPETDLAVKAGLELGELGGIKVDQNYRTKDEDVYAVGDAIEVYHALTGKMTKLPLAGPAQKQAREVADHIHGRLVPNTGYIGSSVVKCFEYNGASTGLNEGMIKALNLDIQYETVKVIPGDKVGLMPGCEPLHFKLLFEIPTGKILGAQAIGRGNVDKRVDVIATAIKFGATINDLRDLEFCYAPPFGTAKDVVNFAGYVGSNLLHDEFKQVHEYDVRDLVESGACIIDVREKHEYELSHIIGAKNIPLSEIRDRVAEIPKDQPVYLHCRSAQRSYNAAKALKHLGFDNIYNVSGGFMGISFYEYFNDQTTGREKIVTDYNFL

SEQ ID NO: 9497 - protein, 855 aa, Populus trichocarpa
MAMAVAPQHRESSGSGSLNKHLTDNGKYVRYTSEQVEALERVYAECPKPSSLRRQQLIRECPILANIEPKQIKVWFQNRRCREKQRKESSRLQTVNRKLTAMNKLLMEENDRLQKQVSQLVCENGFMQQQLQTAPAAADASCDSAVTTPQHSLRDANNPAGLLSLAEETLAEFLSKATGTAVDWVQMPGMKPGPDSVGIFAISQRCSGVAARACGLVSLEPTKLAEILKDRQSWFRDCRNLEVFTVFPAGNGGTIELLYSQIYAPTTLAPARDFWTLRYTINLENGSLVVCERSLSGSGAGPNAAAAAQFVRAEMLPSGYLIRPCEGGGSIIHIVDHLNLQAWSVPEVLRPLYESSKAVAQKVTITALRHVRQIAHETSGEVVYGLGRQPAVLRTFSQRLSRGFNDAINGFNDDGWSLMNSDGAEDVIIAVNTTKNLISANNPAHSLSFLGGILCAKASMLLQNVPPAVLVRFLREHRSEWADFSVDAYSAASLKAGSYAYPGMRSMRFTGSQIIMPLGHTIEQEELLEVIRLEGHSFAQEDAFVSRDIHLLQICSGIDENAVGACSELVFAPIDEMFPDDAPLLPSGFRVIPLESKTKDAQEALTTNRTLDLTSSLEVGPVTNHASVDGSSCHLRSVLTIAFQFPFESNLQDNVATMARQYVRSVISSVQRVATAISPSGLNPALGPKLSAGSPEALTLAHWICQSYWQVLPQVSSCYHLGAELLRSDSVGGDSVLKHLWHHPDAILCCSLEALPVFIFANQAGLDMLETTLVALQDITLDKIFDESGRKALFTDFAKLMQQANNGFACLPAGICMSTMGRNVSYEQAVSWKVLAAEENTVHCIAFSFVNWSFL

SEQ ID NO: 9498 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAQILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 9499 - protein, 243 aa, Fremyella diplosiphon
MYKCFLEHLEQSLLQRFTLESRPIPPGLDYQVSDRGRNPATIQSWCYQCPELRKIRYTYIDAGASAQIMNSVIYPSHHYDLPLLGIDFLSFGQVKNLIVMDFQPLFQDEAYLKKYIHPLQTLHDKYPDLAQGLEMKFYDANQYFSKYLLFAKTDPETVKTRVFEAFKDYLNLYWQMLAQAEPLIDQSDIQRIVKAQKDYDQYSADRDPASGLFSSYFGHQWSERFLYEFLFEDAVPLATVVAK

SEQ ID NO: 9500 - protein, 112 aa, Haemophilus influenzae
MKKIEAMIKPFKLDDVRESLSDIGISGMTITEVRGFGRQKGHTELYRGAEYMVDFLPKVKLEVVVPDELVDQCIEAIVETAQTGKIGDGKIFVYHVERAIRIRTGEENEDAI

SEQ ID NO: 9501 - protein, 255 aa, Fremyella diplosiphon
MRSEAKLTLYQPFLDYAIALLQERLNLQPYPIPTGFESKQATVGKGKHQEEVLTTSYAYQSSKLRQIRAAHVQGGKSLQVLNFVIFPHLNYDLPFFGGDLVTLPGGHLIALDMQPLFRDDLDYQAKYTQPILPIFQTHQQHLPWGGDFPEEAQPFFSPAFLWTRPQQTELVETHVFAAFKDYLNAYLDFVDQAQPITDSKHLAEIEQAQLRYLRYRAEKDPARGMFTRFYGTEWTEEYIHGFLFDLERKLTSAIK

SEQ ID NO: 9502 - protein, 844 aa, Populus trichocarpa
MEVAPLHRESSSSGSINKHLTDDGKYVRYTAEQVEALERVYAECPKPSSLRRQQLIRECPILANIEPKQIKVWFQNRRCREKQRKESSRLQTVNRKLTAMNKLLMEENDRLQKQVSQLVCENGFMRQQLQTVTTDASCDSVVATPQHSLRDANNPAGLLSIAEETLSEFLAKATGTALEWVQMPGMKPGPDSIGIFSISQRCGGVAARACGLVSLEPKKIAEILKDRSSWFRDCRNLEVFTMFPAGNGGTIELVYSQIYAPTTLAPARDMWTLRYTTSLENGSLVVCERSLSGYGAGPDAAAAAQFVRAEMLPSGYLIRPCEGGSIIHIVDHLNLQAWSVPEVLRPLYESSKAVAQKMTIAALRYVRQVAHETSGEVVYGLGRQPAVLRTFNQRLSRGFNDAINGFNDDGWSLMNADGAEDVIIAVNSTKNLIGANNSAHSLSFLGGILCAKASMLLQNVHPAVLVCFLREHHAEWADFSVDAYSAALWKAGSYAYPGMRPMRFTGSQITMPLGHTIEQEDLLEVIRLEGHSFAQEDAFVSQDIHLLQICSGIDENAVGACSELVFAPIDETFPDDAPLLPSGFRIISLESKAKDTQEVLTTNCTLDLTSSLEAGLAINHTAVDGSSCHSLRSVLTIAFQFPFESNLQDNVATMARQYVRSVISSVQRVAMAISPSGLSPVLGPKLSAGSPEALTLAHWICQSHRQVLLNYHLGAELLRSDSVGGDSVLKHLWHHPDAILCCSLKSLPVFIFANQAGLDMLETTLVALQDITLDKIFNESGRQALYTEFAKLMQQGFACLPAGICMSTMGRNVSYEQAVAWKVLSAEENAVHCIAFSFVNWSFL

SEQ ID NO: 9503 - protein, 159 aa, Unknown
  Burkholderia sp. 383
MSTLYSFSAETLAGAPASLDAYRGKVLLIVNTASECGFTPQYAGLQKLYDQYAARGFYVLGFPCNQFGKQEPGDAAQIGAFCERNYGVTFPMFAKIDVKGDHAHPLYRYLTDEAPGILGLKAIKWNFTKFLVDREGRIVKRYAPSTKPDEIAADIDKLL

SEQ ID NO: 9504 - protein, 201 aa, Prochlorococcus marinus
MSSLRQSEIKRKTNETDISVLINLDGNGISEIETGIPFLDHMLHQISSHGLFDLKIKAIGDTHIDDHHTNEDVGIALGKAFSKALGERKGISRFGHFFAPLDEALVQVTLDCSGRPHLSYDLQLKAPRIGNYDTELVKEFFIAFVNNSGITLHINQIRGSNSHHIVEACFKAFSRAMRMATEIDLRRSDSIPSSKGMLENQ

SEQ ID NO: 9505 - protein, 276 aa, Unknown
  Azoarcus sp. EbN1
MSKNIGGFDPAVRGSDLPTRVARAGKVYLVGAGPGDPELLTLKAARLLAGAQAVVYDHLVGDGILELINPTARMIYAGKEAGHHALPQDQINHLLVQLARTGTNVVRLKGGDPFMFGRGGEEMEELLACGIECEIVPGITAACGIAACTGIPLTHRDHARSVIFTTGHLKDDTVNLDWPALARPKQTVVIYMGLAALEIICHQLMAHGLPADTPAAVIHAGTTDRQVIVADRIDRLVATARHAQLESPALIMIGSVVSLHSLAHDNRTFRELALTA

SEQ ID NO: 9506 - protein, 208 aa, Glycine max
MPLKMRMMRRMMVSDQTGFDTEGMISNSKQIKNEEKNPPLTPLGTDDSNNYNSSANHSNITVRVCSDCHTTKTPLWRSGPKGPKTLCNACGIRQRKARRAIAVAATANGMNPVEAEKSQVKKGNKLHSKGMKSKTKGAPHMKKKRKLGAKYRKRFGAFEDLTVRLSKNLALQKVFPPDEKEAAILLMALSYGLLHGFPTDRYVNYLDL

SEQ ID NO: 9507 - protein, 130 aa, Burkholderia pseudomallei
MSTPRIALIAHDAKKDDIVALAGAYRATLAQCRLVATGTTGGRIAQAHGLDVERKLSGPLGGDLQIGAELADGRVDIVIFLRDPMTAQPHDPDITALVRACDVHDVPVATNVATARVLLDDLARRLTANA

SEQ ID NO: 9508 - protein, 517 aa, Cucurbita maxima
MAVATDPLGCMQKLVQMLQAPPYVAAAVQSSALLLTFFIGDWRKRRRSPLPLLPAIPGIPVLGNLLQLKEKKPHKTFAQWSETYGPIYSIKAGASTVIVLNSSDLAKEAMVTRYSSISSRKLSKALTILTADKCMVAMSDYNDFHKLVKRYILANVLGANAQKRLRQRRDTMIDNISRELFACVKDSSSESVNFRKIFESELFGLALKETFGRDMESLYVDGLGTTLLREDLFRTLVIDPMEGAIEVDWRDFFPYLRWIPNKGVEDRIRKMDFRRRVTMKSLMEEKKKQIAAGEDLNCYSEFLLSEAKSLTEEQISMLLWEIIIETSDTTLVVTEWAMYELAQNPKRQERLYQHIQSVCGSAKITEENLSQLPYLTAVFHETLRKYSPVSIVPLRYAHEDTQLGGYFIPAGSEVAVNIYACNMDKKQWESPEEWKPERFLDESYDPMDLYKTMAFGGGKRVCAGAPKAMLIACTTLGRLVQGFTWKLREGEEDKVDTLGLTARKLQPLHIVAKPRIN

SEQ ID NO: 9509 - protein, 416 aa, Unknown
  Burkholderia sp. 383
MTNDRVMAIVGAGHAGGRAAQVLRESGWGGRIVLIGAEAHLPYERPPLSKGVLTGERSAARCRLREPEAWVADRIEPVVATVERIDPCAREVHVSGARVFGYDALLLATGGRARRLAIPGATLDGVFALRTLDDAAALGSRLVPDARVVLIGGGFIGLEVAASARRRGCRVTVLDAAPRLLGRAVPETIAARVHALHEQQGVAIRVSRKPVAIERTASGALAVVLDDGDTLIADTVVAGIGIEPADELARDAGLAVERGIVVNERLETSAHGIYAAGDVAVFPSALSGRPVRQETWHGAETQARVAARNMLGADEPYRDTPWFWSDQYDAQLHVAGEPALGERSVARVLGDDAEIHFHFDAGARLVAASGFGRASGFIKEMRVARMLVERGAGVTPTAVADVNVKLKSLIGEAGGR

SEQ ID NO: 9510 - protein, 554 aa, Psychrobacter arcticus
MTGHTMNTFPLFFKLEDRKVLIVGGGDVALRKADLLSRAGACITVLAPSINHEIQALLSSSKHELIYEHYNKTYMTNSRVIIAATDDERLNHQIHADATALNIPVNVVDTPHLCDFIFPAIVDRNPIVIGISSNGKAPVLARLLRARLETLIPQGYGKLAKLAGEFRGDVKAKIPTLTGRRQFWERAFEGKVSQLMFAGNENEALAQLQADLDNTAASITAKDATDDNGLSTASTSAPAIANEFTAARNTMGEVYIVGAGPGDPELLTFKALRLMQQADIVYYDALVSPQVLDLCRRDADKVFVGKKRRNHAVAQLGINELLVNSAKEGRRVVRLKGGDPFIFGRGGEEIESLRAHNIPYQVVPGITAANAAASYAGIPLTHRDHSQSVRFVTGFLKAGAPNNNFKNFLDTDETVVFYMGLHSLPRLTEGLIDAGRSAETPIAIVSNASMPNQQVLTGTLASIVELQEKNQLPTPALLIMGDVVSLHHDLAWYNLHNQQHNQNTSETDNNWLRGGTATTPKSNAQFNAHQQAHALSMITNLATEDGDLEQLIIG

SEQ ID NO: 9511 - protein, 710 aa, Clostridium thermocellum
MVKKTLCFVLTLAMLTAFILPQGIVSAAGSYNYAEALQKAIYFYECQQAGPLPEWNRVEWRGDATMNDEVLGGWYDAGDHVKFNLPMAYSAAMLGWALYEYGDDIEASGQRLHLERNLAFALDYLVACDRGDSVVYQIGDGAADHKWWGSAEVIEKEMTRPYFVGKGSAVVGQMAAALAVGSIVLKNDTYLRYAKKYFELADATRSDSTYTAANGFYSSHSGFWDELLWASTWLYLATGDRNYLDKAESYIPKLNRQNQTTDIEYQWAHCWDDCHYGAMILLARATGKEEYHKFAQMHLDWWTPQGYNGKRVAYTPGGLAHLDTWGPLRYATTEAFLAFVYADSINDPALKQKYYNFAKSQIDYALGSNPDNRSYVVGFGNNPPQRPHHRTAHGTWLDKRDIPEKHRHVLYGALVGGPGRDDSYEDNIEDYVKNEVACDYNAGFVGALCRLTAEYGGTPLANFPPPEQRDDEFFVEAAINQASDHFTEIKALLNNRSSWPARLIKDLSYNYYMDLTEVFEAGYSVDDIKVTIGYCESGMDVEISPITHLYDNIYYIKISYIDGTNICPIGQEQYAAELQFRIAAPQGTKFWDPTNDFSYQGLTRELAKTKYMPVFDGATKIFGEVPGGFEPVPSPSPTPAQYKVGDLNGDGVVNSTDSVILKRHIIKFSEITDPVKLKAADLNGDGNINSSDVSLMKRYLLRIIDKFPVE

SEQ ID NO: 9512 - protein, 99 aa, Porphyra yezoensis
MADYKIHLLCEEEGIDVTFNCAEDTYILDAAEEEGIELPYSCRAGACSTCAGKVTEGTVDQADQSFLDDDQLLAGYVLTCIAYPSSDCTISTHVEQELY

SEQ ID NO: 9513 - protein, 1037 aa, Zea mays
  misc_feature (237)..(237): Xaa can be any naturally occurring amino acid
  misc_feature (334)..(335): Xaa can be any naturally occurring amino acid
  misc_feature (359)..(359): Xaa can be any naturally occurring amino acid
  misc_feature (418)..(418): Xaa can be any naturally occurring amino acid
MAPSTAAASTLLPVLLLIATATQCTAADSFSSQDAAALLNLSAAVADPSGYLSTHWTPDTAVCSWPRVSCDATDTRVISLDLSGLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISXEIPPELANLTSLDTLFLQINALSGRLPTEIGAMGSLKSLDLSNNLFVGEIPASFASLKNLTLLNLFRNRLAGEIPEFIGDLPNLEVLQLWENNFTGXXPTNLGVAATRLRIVDVSTNKLTGXLPSELCAGQRLETFIALGNSLFGDVPDGLAGCPSLTRIRLGENFLNGTIPAKLFTLPKXLTQVEAAQQFCSPASSGWTGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGSLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFAGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPAFRRVCRFNGSSLGIVGCDLMWPRFLCPPSPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTTSIDVPLVIEPKEEDGGPEKKKKKQQQQQQEGPPDSPPQQDLLSI

SEQ ID NO: 9514 - protein, 94 aa, Arabidopsis thaliana
MSSRRSSRSRQSGSSRISDDQISDLVSKLQHLIPELRRRRSDKVSASKVLQETCNYIRNLHREVDDLSDRLSELLASTDDNSAEAAIIRSLLNY

SEQ ID NO: 9515 - protein, 954 aa, Pseudomonas fluorescens
MLSLSQLREPNAFLNRHLGPDAEEQQAMLASLGLGSRAELIEQTVPPGIRFNRALDLPPALDEAAALARLKGYAGQNQVWTSLIGMGYHATLTPTVILRNVLENPGWYTAYTPYQPEIAQGRLEALLNFQQMTIDLTGLDLANASLLDEATAAAEAMALAKRVSKSSSNLFFVDEHCHPQTVSVVRTRAEGFGFELVVGGVDELSGHQVFGALLQYPDTHGEIRDLRPLIDQLHAQQALACVAADLLSLLLLTPPGELGADVVLGSSQRFGVPMGYGGPHAAFFACRDDYKRAMPGRIIGVSKDARGQVALRMALQTREQHIRREKANSNICTAQVLLANIAGFYAVYHGPAGLKRIAQRVHRLTCILAVGLERHGIARVNRHFFDTLTLEVGGSQTAIIESARAQQINLRILGRGRLGLSLDETCDESTVTRLFDVFLGADHGLDVSNLDAEALESGIPDPLLRRTRYLTHPVFSAHHSETEMLRYLKQLENKDLALNQSMIPLGSCTMKLNASSEMIPITWPEFANLHPFAPREQAAGYGLLIAELERWLCAITGFDAICMQPNSGAQGEYAGLLAIRRYHESRRQGGRHVCLIPASAHGTNPASAQMAGMQVVIVECDEAGNVDLEDLKAKAQAAGERLSCLMATYPSTHGVYEEGISQICEVIHSHGGQVYMDGANLNAQVGLARPADIGADVSHMNLHKTFCIPHGGGGPGMGPIGVRAHLAPFVANHPVVPIDGPLPENGAVSAAPWGSASILPISWMYIALMGPQLADASEVAILAANYLAEQLSGAFPVLYSGRNGRVAHECILDLRPLKAQTGISEEDVAKRLMDYGFHAPTMSFPVPGTLMVEPTESESKAELDRFIEAMLSIRAEIAQVQEGNWPAEDNPLKGAPHTLADITGVWERSYSIEQAVLPTAHTRAHKYWPAVNRVDNVYGDRNLFCACVPLADYR

SEQ ID NO: 9516 - protein, 500 aa, Vicia villosa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSLVAMVPFGPYWKFVRKLIMNDLLNATTVNKLRPLRTQQIRKFLRVMAQGAEAQKPLDLTEELLKWTNSTISMMMLGEAEEIRDIAREVLKIYGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGIDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRGMCPGVNLATSGMATLLASLIQCFDLQVLGPQGQILKGGDAKVSMEERAGLTVPRAHSLVCVPLARIG

SEQ ID NO: 9517 - protein, 534 aa, Streptomyces lividans
MAAPNSHRAEDWWRDAVIYQVYPRSFADGDGDGTGDLAGVRARLPYLAELGVDAVWFTPWYVSPLVDGGYDVADYRTIDPPFGTLGEAEKLIAEARELGIRTIVDIVPNHVSDRHAWFRAALEAGPGSAERERFHFRPGRGADGELPPNDWPSQFSGRTWTRVPDGEWYLHLFTPEQPDLNWAHPEVRREHEEVLRFWFERGVAGVRIDSAALLAKDPALADFVEGVDPHPYIDQDELHDIYRSWRKVADEYGGVFVGEVWLPDAERFARYLRPDELHTAFNFNFLSCPWEADRLRRTIDDTLAEHAPVGAPATWVLCNHDVTRTVTRYGRADTGFDFAKKAFGTPTDLVLGTRRARAAALLTLALPGSVYLYQGEELGLPEADIPRDRIQDPMHFRSGGVDPGRDGCRVPLPWAADAPYCGFGSETEPWLPQPEGWAAYAADRQGADPESMLSLYRRALGLRRSTAGFGDGGLDWLPAPDGVLAFRRAGGPVCVVNLSAAPVELPAHSAVLLVSGPLDEAGRLPADTAVWLRA

SEQ ID NO: 9518 - protein, 212 aa, Yersinia pestis
MQNVDNTAVIDAANALPGRLTSIPVSPLHAVHGHSMTYIPEGMDLAFFAMGCFWGAERLFWQQPGVYSTAAGYSGGHTPNPTYHEVCSGRTGHAEVVRVVFDPAVISYQQLLQIFWENHDPAQGMRQGGDVGTQYRSAIYVLTPEQEEQAHKSRERFQQAMEKAGDQRVITSEITVALPFYYAEDDHQQYLHKNPHGYCGLGGIGVCLPPNV

SEQ ID NO: 9519 - protein, 500 aa, Lens culinaris
FLHLRPTPTAKSKALRHLPNPPSPKPRLPFIGHPHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDILVDEVDTQNLPYIRAIVKETFRMHPPLPVVKRKCTEECEINGHVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 9520 - protein, 500 aa, Lens culinaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMVLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGCVTPEGALILFNVWQVGRDPKYWDRPSEFRPERFLETGAEGEARPLDLRGRHFQLLPFGSGRRMCPGVNLATSGMATLLASLIQCFDLQVLGPQGQILKGGDAKVSMEERAGLTVPRAHSLVCVPLARIG

SEQ ID NO: 9521 - protein, 233 aa, Galdieria sulphuraria
MTTSVVTLSELLAARVHLGHRFNKWNPKMVSFIYAERNKVHIIDLVQTAFLLGEACDYVKLLAKKGKKFLFVGTRQELNTILAEEAERCNSFYINQRWLGGLLTNWVTIKSRVQALEKKESEGFFNSLPKKESARLKKELDKLRRYFNGIRKMNTLPDVVIIIDQRKDLTAVQECNKLNIPTICIVDTNCNPDIVDLPIPANDDAICSVKLILGKLVDFIKEGQIERELSKTS

SEQ ID NO: 9522 - protein, 105 aa, Saccharomyces cerevisiae
MLMPKEDRNKIHQYLFQEGVVVAKKDFNQAKHEEIDTKNLYVIKALQSLTSKGYVKTQFSWQYYYYTLTEEGVEYLREYLNLPEHIVPGTYIQERNPTQRPQRRY

SEQ ID NO: 9523 - protein, 473 aa, Burkholderia pseudomallei
MKTLFLQAPSYDGFDGGAGSRYQAKREIRSFWYPTWLAQPAALVPGSRVVDAPADGLSVEDTLKIAKDYDLVIIHTSTPSFPTDAMFAEDLKKMKPSMLVGMVGAKVAVDPHNSLTATQAIDFVCREEFDYTCKDIAEGKPFAEILGMSYRAKDGSIEHNGPRPMIENMDELPFVAPVYKRDLKIDNYFIGYLNYPYVSIYTGRGCRSKCTFCLWPQTVGGHRYRVRSVESVLAEVKWIRDNMPEVKEIMFDDDTFTDFKPRVEEIARGLGKLGVTWSCNAKANVPYSTLKIMKENGLRLLLVGYESGDDQILLNIKKGLRTDIARRFNEDCKKLGIKIHGTFILGLPGETKETIKKTIEYAKEINPHTIQVSLAAPYPGTRLYNQAIENGWMEENKTINLVSKEGVQLAAIGYPHLPKEEIYHQLEHFYREFYFRPSKIWEILREMLTSWDMMKRRLREGVEFFRFLRAHEA

SEQ ID NO: 9524 - protein, 94 aa, Unknown
  Synechococcus sp. CC9605
MASFNISIEGGASFACPDDTYILDAAEEAGVDLPYSCRAGACSTCAGLLVSGSVDQTDQSFLDEDQMGQGFALLCVSYPTADCVIKANAEEHLS

SEQ ID NO: 9525 - protein, 522 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEAYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLSK

SEQ ID NO: 9526 - protein, 251 aa, Arthrospira platensis
MPSVTMRDMLKAGVHFGHQTRFWNPKMKPYIFGARNKIHIVNLEKTLPLFNDALGFVNKLASSNNTILFVGTKRAAQKAVAEEATRCGMPYVDHRWLGGMLTNWKTIRQSIKRFRDLEAQANDGTFDKLTKKEALMRRREMEKLERSIGGIKDMGGLPDALFVIDVDHEDIAVQEARKLGIPVIAVVDTNSNPDGVDYFIPGNDDAIRAIQLYVGAVADAIIEGRQYAATQAPGGDSDGFVEVEEAGEAQA

SEQ ID NO: 9527 - protein, 501 aa, Mycobacterium tuberculosis
MTTAQAAESQNPYLEGFLAPVSTEVTATDLPVTGRIPEHLDGRYLRNGPNPVAEVDPATYHWFTGDAMVHGVALRDGKARWYRNRWVRTPAVCAALGEPISARPHPRTGIIEGGPNTNVLTHAGRTLALVEAGVVNYELTDELDTVGPCDFDGTLHGGYTAHPQRDPHTGELHAVSYSFARGHRVQYSVIGTDGHARRTVDIEVAGSPMMHSFSLTDNYVVIYDLPVTFDPMQVVPASVPRWLQRPARLVIQSVLGRVRIPDPIAALGNRMQGHSDRLPYAWNPSYPARVGVMPREGGNEDVRWFDIEPCYVYHPLNAYSECRNGAEVLVLDVVRYSRMFDRDRRGPGGDSRPSLDRWTINLATGAVTAECRDDRAQEFPRINETLVGGPHRFAYTVGIEGGFLVGAGAALSTPLYKQDCVTGSSTVASLDPDLLIGEMVFVPNPSARAEDDGILMGYGWHRGRDEGQLLLLDAQTLESIATVHLPQRVPMGFHGNWAPTT

SEQ ID NO: 9528 - protein, 377 aa, Oryza sativa
MRALPTRPGRAAAVAACASPAVPRRSLLLSTAAAGEPPCRPPADSSSPSKFSRFDRSAVRLLGWTAALQPEPVRLTRGASAAPKLRASPPDAAQAAAAFGSKEEAFAWAKSDNRRLLHVVYRVGDIDRTIKFYTECLGMKLLRKRDIPEEKYTNAFLGYGAEDNHFVVELTYNYGVDKYDIGAGFGHFGIAVDDVAKTVELIRAKGGKVTREPGPVKGGKTVIAFVEDPDGYKFEILERPGTPEPLCQVMLRVGDLDRAISFYEKACGMELLRKRDNPEYKYTVAMMGYGPEDKNAVLELTYNYGVTEYDKGNAYAQIAIGTDDVYKTAEVVKLFGGQVVREPGPLPGINTKITSILDPDGWKSVFVDNIDFAKELE

SEQ ID NO: 9529 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRAMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 9530 - protein, 195 aa, Oryza sativa
MSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLGFFLCPEMDTVVRPPEELVDDHHPRVYPDFTWRALLDFTQRHYRADMRTLQAFSDWLNHHRHLQPTIYS

SEQ ID NO: 9531 - protein, 397 aa, Yarrowia lipolytica
MAEFDRDLDDELEFKTSKDVDVTPTFESMDLKDDLLRGIYAYGFEAPSAIQSRAITQIIKGRDTIAQAQSGTGKTATFSISMLEVIDTKHRETQAMVLSPTRELATQIQSVILALGDYMNVQCHACIGGTSLSVDMKKLEAGQQVVSGTPGRCLDMIKKGCLRTKNLKMLILDEADELLNKGFQEQIYDIYRYLPAATQVVVVSATLPHSVLEMTSKFMTDPVRILVKRDELTLEGLKQYFIAVEQEEWKFDTLCDLYDTLTITQAVIFCNTKKKVDWLTQQMKDNNFTVCSMHGDMAQKDRDSIMNEFRSGRSRVLISTDVWARGIDVQQVSLVINYDLPPNRENYIHRIGRSGRFGRKGVAINFATNDDITTLRDIEQYYSTQIDEMPVNVTDMM

SEQ ID NO: 9532 - protein, 158 aa, Staphylococcus aureus
METIYDFVVETNKGVTYKLDAYKGDVMLIVNTASECGFTSQFEGLQSLYEKYKDQGFVILGFPCNQFGGQEPGSGEEAAQNCKLNYGVTFPMHQKIDVKGEHQLPLFRYLTAAQHGFFNEKIKWNFTKFLVDREGNVVKRFAPQKKPVQIEREIEKLL

SEQ ID NO: 9533 - protein, 370 aa, Oryza sativa
MVVQQEQEVVFDAAVLSGQTEIPSQFIWPAEESPGSVAAEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 9534 - protein, 564 aa, Unknown
  Magnetococcus sp. MC-1
MRLTGAEIIVQCLLEQGVKTVFGYPGGAVLNIYDEIYKCKDLQHVLGRHEQGLLHAADGYARVTGEVGVALVTSGPGATNAVTGLATAYMDSIPMVCITGQVPVALIGNDAFQEADTVGITRSCTKHNYLVKDVKDLARVLREAFYIARTGRPGPVLVDIPKDITIAATEYSPAKGEVSIRSYKPSISGHTGQIRKAAGLMAKAKRPLFYTGGGVILSNAAEELTQLVRKLGAPITNTLMGLGGFPCTDKQFVGMLGMHGTYEANMAVSRCDLLVAIGARFDDRVTGKISQFAPEAKIIHLDVDPTSISKNVEVDVPIVGDIKTVLGKMLAMMEDGKYQSELPDLGDWWAEIEQWRRKECLKFTQGDEVIEAQYVIQKLYELTKGNAIVATDVGQHQMWAAQFYGFEKPRRWLTSGGLGTMGYGLPAAIGAQMAFPHETVVLITGESSIQMNIQELATLKQYNLPVKIAILNNSFLGMVRQWQELFYERRYSESDMTVHPDFVQLAQAYGATGMMTARPAEVSGIIEKALAIDGPVLMDFRVNREANVYPMVPAGAALNEMILL

SEQ ID NO: 9535 - protein, 308 aa, Thermosynechococcus elongatus
MSPRVLILGLGHWGQTLAYLFEQRGCTVSSWGRSQGALSAALFQDIHLLVSALPIKAVREVAAQVTRLHPPLGIILVSATKGLESETFATAADIWQTYCPHHDLVVLSGPNLASEIQQGLPAAAVVGGNLAATKQVQDCLGSPTFRLYSNEDRRGVEMGGIFKNVIAIACGVNDGLGLGVNARSALITRGLVEMVRVGTHWGGQVETFYGLSGLGDLLATCTSALSRNYQVGWHLAQGKSLSQALALTKGTAEGVNTARVLCTYAQQHQLDIPITAMVNAVLCGSLTPQAALHCLLERPFKPEVIPGQ

SEQ ID NO: 9536 - protein, 331 aa, Unknown
  Synechocystis sp. PCC 6803
MGFFVVRCRQISLLGGPLPMKIASNITELIGRTPLVRLNRIPLLEGCGAKIVVKLEGMNPAASVKDRIGINMINRAEQEGLIEPGKTLLIEPTSGNTGIALAMVAAAKGYQLILTMPETMSQERRAMLKAYGAKLELTPGSEGMGGCIRRAQELAESLPNAYMLQQFDNPANPQIHQQTTALEIWQDTDGAIDFLVAGVGTGGTITGVASVLKEKKPSFQAIAVEPQNSPVLSGGKPGPHKIQGIGAGFIPEVLDVNLIDEVIAVTDEEAIAYGRRLAREEGILSGISTGAALAAAIKVAKRPANKDKLIVMIQPSFGERYLSTPLFQDLE

SEQ ID NO: 9537 - protein, 328 aa, Fulvimarina pelagi
MTRFTVIGAGAWGTALANLYARADHDVVLLGRNADAMAAMEATRRNEGYLPDVYLPPALRATHDAKEALSSAEVVLFVVPAQSLATAAETYGDLVPSNAMLVLCAKGIERRSGRFSSAIMAERFANNPLCVLSGPSFAADVANGLPTAVTVAAGTIERADRAAELLSANTFRCYASDDLAGVEAGGALKNVLALAAGMAIGRGLGESAKAAIVTRGFVELRRLGAAFGGQPQTLMGLSGLGDLILTCSSEQSRNFAYGIALGSGVDRTNLKLAEGVYSAGIAARLARERQIEAPIVQAVAEILDGEISIDEAMHALLSRPLRREVETA

SEQ ID NO: 9538 - protein, 708 aa, Rhodospirillum rubrum
MSLFNVFRKEIEWGGRKLVLETGRIARQADGAVMASLGDTTVLCTAVGAKTKSKFDFFPLTVNYQEKTFAAGKIPGGFFKREGRPSEKETLVSRLIDRPIRPLFVHGYKNETQLVCTVLCHDLENNPDIVAIVGASAALTLSGLPFLGPIGAARVGLIDGAFVLNPTRDQMADSVLDLVVAGTREGVLMVESEAHELSEQQMLDAVMFGHEGYQPVIDAIIALAEQCAREPRAIEPPAPEAEAVAAKVREVGEAGLRDAYKEADKMVRHDKVDAVRDAVTAAFAGDDAALALAGAAFKDLEKDIVRGSILDTGLRIDGRDTKTVRPIEIYPGILPRAHGSALFTRGETQALVTTTLGTGQDEQIIDALEGEYRENFMLHYNFPPYSVGEAGRMGSPGRREIGHGKLAWRAIHPMMPAKDAFPYTVRVVSEITESNGSSSMATVCGTSLALMDAGVPLKNAVAGIAMGLIKEDERFAVLSDILGDEDHLGDMDFKVAGTANGITSLQMDIKITSITKEIMNVALNQAKDGRIHILGEMTKALGNARSDVSDFAPRITTIKVPPQKVREVIGSGGKVIREITEVTGTKIDIEDDGTIKIASADAEATQRAVDWIKGIVAEPEIGVVYTGKVVKIMDFGAFVNFLGTRDGLVHISELSQDRVKKVGDVVNVGDQVKVKCVGFDDRGKIKLSMKQVDQVTGADLSTQAPAEE

SEQ ID NO: 9539 - protein, 380 aa, Pisum sativum
MAIECITSSAKLMTQKSDKNENEESSKLVFDASFLKNQLNLPKQFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNSSNIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 9540 - protein, 200 aa, Lactococcus lactis
MTRISHITRNTKETQIELSINLDGTGQADISTGIGFLDHMLTLLTFHSDFDLKIIGHGDHETVGMDPHHLIEDVAIALGKCISEDLGNKLGIRRYGSFTIPMDEALVTCDLDISGRPYLVFHADLSGNQKLGGYDTEMTEEFFRALAFNAGITLHLNEHYGQNTHHIIEGMFKSTARALKQAVSIDESKVGEIPSSKGVL

SEQ ID NO: 9541 - protein, 526 aa, Arabidopsis thaliana
  misc_feature (453)..(453): Xaa can be any naturally occurring amino acid
MNPEEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGXKHRKKSTKRSENCRSRRTAISVAEFEELLFRYQVEKETNFLHHSEFLVLFFSSLASQTQKREVYFYFKNSYIR

SEQ ID NO: 9542 - protein, 500 aa, Oryza sativa
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGIARPTFSEIIIRLDKIYAQCMKQGTWKDSLKIWSVSRRFKNIRSKHFRTKKRVHVPM

SEQ ID NO: 9543 - protein, 478 aa, Prochlorococcus marinus
MNNPRILFWHRKDLRIFDNQALIKAFSLSNAITSTYILDRNYTHDFSANSRAWFLGDSLQELGNNWEKMGSRLVIEEGDPVLIIPQLAKTIDAKFVIWNKTIEPYEINRDLQIKKNLKEKNIQVIESWDHLLVEPLKIFSGNNKPYSVYGPFYKNLKSKMNLLGLYDQDKVIFQFKDIDNKLKENKLINSSDSTLKKFLKNIKFSGSNICPCRPGENGAEILLEKFINEKNIYSYNSARDLPSHNGTSFLSASLRFGTISIRKVWNATLDLNSDFESHENSLSIETWQKELVWREFYQHCLFHFPELEKGPYRKKWGQFPWQNNNEWFQHWSNGETGVPIVDAAMRQLNSTGWMHNRCRMIVASFLVKDLICSWQMGEKKFMETLVDGDLAANNGGWQWSASSGMDPKPLRIFNPYTQAKKFDPICEYIKSWIPELSKVSNSDLLNGEISNLEKNNYSTPIVDHNIQQRLFKSLYAEI

SEQ ID NO: 9544 - protein, 897 aa, Oryza sativa
MAVGEECAAAVASQGFVSDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRRQDVTGLQLPGVLDDMFAYTGPLGAVFSDKDVDLYIWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKLVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKNTMIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPSKNHILSVFDNFVDILKIRYSSPLFRLSTASEIEVQQRVRFHNTGPSMVPGVIVMSIKDAQNEKCEMAQLDKNFSYVVTIFNVCPHEVSIEIHDLASLVLELHPIQVNSSDALVRQSTYEASKGRFTVPRRTTAVFVQPRC

SEQ ID NO: 9545 - protein, 335 aa, Glycine max
  misc_feature (218)..(218): Xaa can be any naturally occurring amino acid
  misc_feature (244)..(244): Xaa can be any naturally occurring amino acid
QLRRPPPPLKFSIVFFFFRFSIFYSMGIGGSALGPHFVAEALAPDNPPLKIRFVDNTDPAGVDHQIAQLGLELASTLVIVISKSGGTPETRNGLLEVQKAFREAGLDLPKQGVAITQENSLLDNTARIEGWLARLPMFDWVGGRTSEMSAVGLLPAALQGIDIIEMLAGASLMDEANRSTADMAILPYKDSLLLFSRYLQQLVMESLGKVFDLDGNRXYIQQLREGVHNFFVTFIEVLRDRPPXHDWELEPGVTCGDYLFGMLQGTRSALYANNRESITVTVQEVTPRTVGALIGLYERAVGIYASLVNINAYHQPGLGNMACGRGMLNCIQMKT

SEQ ID NO: 9546 - protein, 398 aa, Ashbya gossypii
MSFDRNQDGKLKVKTSSKLPVSPTFESMKLQENLLRGIYGYGFEAPSAIQSRAITQIIRGKDVIAQAQSGTGKTATFTIGMLQVIDSSSKDLQALVLSPTRELAAQISQVVRNLGDYMNVVALACTGGKALQQDISKVNKGCHVMSGTPGRVLDMIKRRIINTRHVKMLVLDEADELLSETLGFKQQLYDIFTKLPSSVQVVVVSATMSKVVLEVTKKFMSDPVKILVKRDEVSLEGIKQYHINVDKEEWKFDTLCDLYDSLTITQCVIFCNTKKKVDWLSHKLIQNNFAVASIHGDMKQDDRDKVMSDFRSGSSRVLISTDVWARGIDVQQVSLVINYDLPELLENYIHRIGRSGRFGRKGVAINFITREEVTKLKSIEKHYSIKIKPMPADIDSLS

SEQ ID NO: 9547 - protein, 296 aa, Unknown
  Azoarcus sp. EbN1
MDYKTLEDYVGHTPLVRLKRIGAGRNNVILAKLEGNNPAGSVKDRPALSMIVQAEARGEIRPGDTLIEATSGNTGIALAMAAAMRGYQMILVMPENQSVERRQTMRAFGAELVLTPRDGGMEMARDVAERMRDEGRGIILDQFANPDNPLSHYEATGPEIWEQTDGRITHFVSSMGTTGTIMGCSRFLKERNPAVRIIGCQPDEGSQIPGIRKWPEAYLPKIYEKPRVDALENVSQADAEEMTRRLAREEGIFAGISSGGAMHVAVRIAAELENAVIVSIICDRGDRYLSTGVFPG

SEQ ID NO: 9548 - protein, 553 aa, Micromonospora olivasterospora
MSTRTDTGVTRVLLIKPPIRACMIEIGRHMPIGLAYLAAQLRNSGMEVDIFDSLAFSEDNHVVPPSQYTDIDRAKVAAHPRWDHLVHWGADWARVEQVLRRGYDVVGVSCMFTPYYEPAYELGRLAKQILPQARVILGGQHPTVAHPHALAEEAFDALVLGEAEANVVEIVEALAAGRSLRGMPGLTFRCGTGLCDCPRPSGVHLQPRAEFLQDLDGLALPAVDLLDMGSYDETATLITSRGCPFSCSFCTVHATVGKKFRARAPENVVDEIEHYVTEHGIRRFFIEDDNFTFDIARVHEICRAITRRGLDVELHLPNGMTVVKLDKPLVDDMAAAGFQSLFLGLETTDVKRLRQIRKGFTSLEKVNAGAGLFTDHGITVGASLIVGLLGQTPAEVARDSINLMLAGIRFWTNPFYPIPGSPDFQQCLANGLITHDTELALYDQFNFAIGSDHLSPAELYWSVVITQAMAHWPDYVLEGARVRRERGTVGLDEALQRLLAHSDSLFGPNGELEVPAVPRRSTATSCTATRRLLPRGAAHQPAATARRGLHLHR

SEQ ID NO: 9549 - protein, 439 aa, Pseudomonas putida
MLTPEENLLLCRVEGDAPMGQMMRRHWTPVCLLEEVSEPDGTPVRARLFGEDLVVFRDTDGRVGVMDEYCPHRRVSLIYGRNENSGLRCLYHGWKMDVDGNVVEMVSEPAASNMCQKVKHTAYKTREWGGFVWAYMGPQDAIPEFVPPAWAPHEHVRVSIAKAIIPCNWAQILEGAIDSAHSSSLHSSDFVPARVGGAEATSKNWLRPSTDKAPRMQVERTSYGFRYAALRRPIQNAATSEYVRSTVFVAPATALIPPNNLYNVANINVPIDDTHTAFYFMAWGNPDNTPETETWRKFLGQQVGIDLDDSYRPLRNDGNRFFQDREAMKNGNFTGIKGFPNQDIAMWVTMGPIADRSDERLGASDLAVVEFRRVMLDALAAFQAGESAIGTGEKAIPSRICSFQAIVSKDIDWRDYQARYVWALDDANIVAEPDYEVHT

SEQ ID NO: 9550 - protein, 413 aa, Cucumis sativus
GDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 9551 - protein, 254 aa, Arabidopsis thaliana
MASSTISLQSISMTTLNNLSYSKQFHRSSLLGFSKSFQNFGISSNGPGSSSPTSFTPKKKLTPTRALSQNLGNTENPRPSKVQELSVYEINDLDRHSPKILKNAFSFRFGLGDLVPFTNKLYTGDLKKRVGITAGLCVVIEHVPEKNGDRFEATYSFYFGDYGHLSVQGPYLTYEDSFLAITGGAGIFEGAYGQVKLQQLVYPTKLFYTFYLKGLANDLPLELIGTPVPPSKDVEPAPEAKALKPSGVVSNFTN

SEQ ID NO: 9552 - protein, 257 aa, Unknown
  marine gamma proteobacterium HTCC2143
MRDMLQAGVHFGHQTRYWNPKMGQYIFGARNKIHIINLEHTVPAFNEALAVIQKLSVGKNKILFVGTKRAASKIMREEADRSSQPYVSHRWLGGMLTNYKTIRGSIKRLRDLEAQQADGTFDKLTKKEALMRTRAMEKLERSIGGIKDMGGLPDALFVIDVDQERIAIKEANSLGIPVIGIVDTNSDPDGVDYVIPGNDDAIRAIKLYSAAVADAVLAGKAADGSVPKDDFVEVEAEVAVEAEAVAEAPEAQAPAAE

SEQ ID NO: 9553 - protein, 148 aa, Burkholderia pseudomallei
MFFDSTDSTDSRMTDVTDDAPSPPTAFELVGGEARVRELVDRFYDLMDLEPEFAGIRALHPPTLEGSRDKLFWFLCGWLGGPDHYIERFGHPRLRARHLPFPIASSERDQWLRCIAWAMQDVGLDEPLRERLMHSFHDTADWMRNRPG

SEQ ID NO: 9554 - protein, 136 aa, Cichorium intybus
MARTKQTARKSTGGKAPRKQLATKAWNTLATATGGVKKPHRFRPGTVALREIRKYQKSTELLIRKLPFQRLVREIAQDFKTDLRFQSSAVAALQEASEAYLVGLFEDTNLCAIHAKRVTIMPKDMQLARRIRGERA

SEQ ID NO: 9555 - protein, 335 aa, Streptococcus pneumoniae
MKRIAVLTSGGDAPGMNAAIRAVVRQAISEGMEVFGIYDGYAGMVAGEIHPLDAASVGDIISRGGTFLHSARYPEFAQLEGQLKGIEQLKKHGIEGVVVIGGDGSYHGAMRLTEHGFPAIGLPGTIDNDIVGTDFTIGFDTAVTTAMDAIDKIRDTSSSHRRTFVIEVMGRNAGDIALWAGIATGADEIIIPEAGFKMEDIVASIKAGYECGKKHNIIVLAEGVMSAAEFGQKLKEAGDTSDLRVTELGHIQRGGSPTARDRVLASRMGAHAVKLLKEGIGGVAVGIRNEKMVENPILGTAEEGALFSLTAEGKIVVNNPHKADIELSSLNKSLS

SEQ ID NO: 9556 - protein, 136 aa, Griffithsia japonica
MARTKQTARKSTGGKAPRKQLATKAARKSAPASGGVKKPHRFRPGTVALREIRRFQKSTELLVRKLPFQRLVREIAQDFKSDLRFQSSAVLALQEAAEAYMVGLFEDTNLCAIHAKRVTIMPKDIQLARRIRGERT

SEQ ID NO: 9557 - protein, 1137 aa, Burkholderia vietnamiensis
MMKREDSLDDVRRAQFASVAPAGTARARRARRREPALSTDDPLWYKDAIIYQVHVKSFYDSNNDGIGDFPGLIMKLDYIAELGVDTIWLLPFYPSPRRDDGYDIADYRGVHPDYGTLADVRRFIREAHARGIRVIAELVINHTSDQHPWFQRARRAKPGSTHRDYYVWSDTDTKYAGTRIIFLDTETSNWTHDPVAGQYYWHRFYSHQPDLNFDNPAVVREVIQVMRFWLDLGIDGLRLDAVPYLVEREGTNNENLPETHAILKRIRATIDAEYPNRMLLAEANQWPEDVQEYFGNEDECHMAFHFPLMPRIYMSIASEDRFPILDIMRQTPALAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAINVEAQTRDPHSLLNWTRRILATRRATQVFGRGTIRFLRPENRKVLAYLRELDGHEPVLCVANLSRASQAVELDLSEFAGRVPIEMTSDSPFPPIGQLTYLLTFPPYGFLWFVLSEHGREPSWRQPQAEPLPEYVTIVMRRGEQRPDVGQLHTLAHDALSSWLTRRRWFASKDRKIGDARLNVVTPMPDEPFQYAEAWVTTHGGDVERYVVPLAAAWGGETSNPLFAQLALARVRRGHTVGYLTDAFALPAFGRGMLRMLRDGATVPTSDGGRLEFLPEQALAALDPGDDAEVRWLAAEQSNSSLVIGDAIVLKLVRKVAHGVHPEAEMSRYLTRIGYANTATLAGEVVHVDPDGTPHTVAILQRYVDNQGDAWTRSFDFLKRAIDELALPAVGDGEPAERDGEPDALLGYAAFAGVVGTRLGELHVALAQPSDDAAFAPERATPEHVDGWCVDAIASFGHALDVLATRLDALDPSARDAAETLLASRDAAVQALGALVPRTLDAVCTRIHGDFHLGQVLDVQGDALLIDFEGEPARALERRRAKSHPLRDVAGLLRSLSYVSATAQFAIEKVPPQAAGRKRALFDRFGQAAADRFVECYRAAAEHAPERFVDPRYADRLLALFLIDKASYELCYEAANRPDWLGVPVGGLAALVERLLDAHAASDHGGTR

SEQ ID NO: 9558 - protein, 112 aa, Colwellia psychrerythraea
MKKIEAIIKPFKMDDVREALGEIGVTGMTVSEVKGFGRQKGHTELYRGAEYMVDFLPKVKLEIVIAKEDVERCVNAILETAQTGKIGDGKIFITDVERVIRIRTGEENREAI

SEQ ID NO: 9559 - protein, 708 aa, Burkholderia vietnamiensis
MPSALPARLEPGRCYPLGATWDGLGTNFAVFSAHAHRIQLCVFDPTGRKELARLDLPECTDEVWHGYLPNAHPGTVYGFRADGPYQPQQGHRFNPTKLLLDPYARKLVGHFRWSDALFGYRVHSNRSDLSMDRRDSAPAMPKAVVVDEAFDWSTDRRPDVPWRNTVIYETHVRGASMRRAGLRAPERGTFASLAHPAFIDHLLSIGVTTVELLPVHAFLQQRALVNRGLRNYWGYDTAAFFAPEPSYLSTRRLDEMRIAIRQLHAAGIEVVLDVVYNHTCEGNELGPTLSWRGLDNASYYRLRQDDPRYHVDETGCGNTLNMSHPRVVQMVMDSLRYWATAFNVDGFRFDLGVTLGREDHGFEPGSGFFDALRQDPILAQRKLITEPWDLGPGGYQLGRHPPGFAEWNDRFRDTVRRFWRGDAGQRPELAARLAGSADLFNHQRRRTWASVNFVTAHDGFTLADLVSYEHKHNDANGEDNRDGRDDNCSANWGAEGPTDDPAIRDLRARVARSMLATLFTALGTPMLVAGDEFGRTQHGNNNAYCQDNELSWLDWELARGDEGTQMIRFVSRLAAMRRMYPVMSAPHYPSGDRDGAPGMREIEWFDERGEVLSVPAWEDGERRALTMRRVGTGRTGRTEALLVMLNASADAITFQQPAPALEYRVLLDTATPDAGPRSWPDSGVEVAAHAAVIAVAAVPPDLSTKEPS

SEQ ID NO: 9560 - protein, 492 aa, Xanthomonas campestris
MKAKPTLSFWQIWNMCFGFLGIQFGFALQNANASRIFQTLGAQVDDVPGLWIAAPLTGLIVQPIIGYLSDRTWTGWGRRRPYFMIGAVFTTLALLVMPNAPVLWIAAGTLWVLDASINISMEPFRALVGDQLPAEQRPSGYAMQSFFIGVGAIVASFLPWLLTRWGVDNTAPAGELPDSVRYAFYLGAAVLFLSISWTVLRTREYSPAELAAFEPAPAPAAAQLAATDQPSLQASVLWCLGGLLLAAAIAWQHGDRMLYVLAGLCIAYGVLLALARVLPRGGMLVAIMHDLRHMPQTMRRLAWVQFFSWFALFAMWIYTTAAVPQVHFGARDTVSAAYNDGANWVGVLFGAYNGFAALAATVIPLMVRAIGLRWSHLCNLWLGAAGLLSMLFIRDPYWLLLSMLGVGFAWASILSLPYALLSDSVPAAKMGVYMGIFNFFIVIPQLVAASALGFVLRVWLGGQPIYALAIGGLSLIVAGVCVVRVPSAQGGQ

SEQ ID NO: 9561 - protein, 210 aa, Psychrobacter arcticus
MATRIENKKLSKSSSAWMKEHIDDHYVQKAQKDGYRARAAYKLLEINEKTNLIKKGMTVVDLGSAPGSWSQVAGQLVGEKGILIASDILPMDTLPDVTFIQGDFREPEVFDHIMAEVGDRQVDVVLSDMAPNTAGNSAIDQPRMMYLCELAVDFALATLPEGGALIMKVFQGEGTQELRKQMQADFSKIRSIKPGASRPRSKEMFWIAIK

SEQ ID NO: 9562 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 9563 - protein, 493 aa, Herminiimonas arsenicoxydans
MLRFEKTLVWFRRDLRSVDHAALHHALAQSRQVYCVFIFDRAILDALPRADRRVEFIHASLLELAQALRALGGGLIVQHAWAETAIPELAIELGVDAVFANHDYEPQAITRDAHVAAALQAAGRSLHTFKDQVVFEKNEVLTQAEKPFSVFTPYKNAWLKKLYAESNEATLRPYEIDAYADRFVNLPESKFPIPSLTDLGFEKTNLPDLNIPTGMQGAQDLLDAFADRMQRYDQTRDFPALKGPSYLSVHVRFGTVSIRALARRALDAMRTGTGGNGAAVWLSELVWRDFYFMILFQHPHVVDHAFKADYDAITWESGDHARRLFQAWCDGQTGYPLVDAAMAQLNQTGYMHNRLRMVTASFLIKDLGIDWRWGEHYFAEKLNDFDLAANNGGWQWASSSGCDAQPYFRIFNPITQSEKFDQQGKFIRRYLPQLAKLSDRHIHAPWCAPALELRMAGVEIGNNYPGPLVQHDEARARTLQRYAVVKKVATHIE

SEQ ID NO: 9564 - protein, 497 aa, Legionella pneumophila
MIRNSMKSHTELLSWNLLQKEADRVRLNSDSLTCVVPDSNNYESSKQINCIEYDYSRQRVNRTIIDLLIDLANEVKLQEKIDNLINGKKINISENRPALHTALRDLGNKSIMIDGLDIMSAVINTREKIKVISNQIREKKWLGHSGLPITDIVNIGIGGSDLGPRVCINALSNYISKEFNYHFISDVDPASFNDVIAKINPQTTLFIVSSKSFTTKETLLNARKAFALYEDTASIDQHFIAVTAHPERAYQMGIKTVLPIWDWVGGRFSFCSAVNLITAIAIGYEQFVELLAGAHDIDTHVQFTDFKNNIPVLMALIGIWNNNFLNIHYDLIGYNFKEYFVPYVQQLDMESNGKSIDVNGRMVDYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFEQSVIWNINPFDQPGIESAKSAHREITLSSES

SEQ ID NO: 9565 - protein, 437 aa, Arabidopsis thaliana
MYGNNNKKSINITSMFQNLIPEGSDIFSRRCIWVNGPVIVGAGPSGLAVAAGLKREGVPFIILERANCIASLWQNRTYDRLKLHLPKQFCQLPNYPFPDEFPEYPTKFQFIQYLESYAANFDINPKFNETVQSAKYDETFGLWRVKTISNMGQLGSCEFEYICRWIVVATGENAEKVVPDFEGLEDFGGDVLHAGDYKSGGRYQGKKVLVVGCGNSGMEVSLDLYNHGANPSMVVRSAVHVLPREIFGKSTFELGVTMMKYMPVWLADKTILFLARIILGNTDKYGLKRPKIGPLELKNKEGKTPVLDIGALPKIRSGKIKIVPGIIKFGKGKVELIDGRVLEIDSVILATGYRSNVPSWLKDNDFFSDDGIPKNPFPNGWKGEAGLYAVGFTRKGLFGASLDAMSVAHDIANRWKEESKQQKKTAAARHRRCISHF

SEQ ID NO: 9566 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAEATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 9567 - protein, 143 aa, Solanum tuberosum
MAPKTGGKKPAEKKPVEEKKAEEVPAEKKPKAGKKLPKDAAVDKKKKRTKKSVETYKIYIFKVLKQVHPDIGISSKSMGIMNSFINDIFEKLAQEASRLARINKKPTITSREIQTAVRLVLPGELAKHAVSEGTKAVTKFTSN

SEQ ID NO: 9568 - protein, 256 aa, Unknown
  Erythrobacter sp. NAP1
MAATTVTMQQLIEAGAHFGHQTHRWNPRMKPYIFGNRNGVHIIDLSQTVPLFARALDFVEQTVRAGGKVLFVGTKRQAQEPIAEAARQSGQHFVNHRWLGGMLTNWKTISGSIKRLKTLEEQLSGDTSGFTKKEVLQLTRERDKLELSLGGIRDMGGIPDVMFVIDANKEDLAIKEAAVLGIPVIAVLDTNVDPTGIAFPVPGNDDASRAVRLYCQAISDAANAGRGQAVEQSGEDFGASETPPAEPTAEEAPAEA

SEQ ID NO: 9569 - protein, 521 aa, Trifolium pratense
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPIGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVDEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 9570 - protein, 206 aa, Triticum aestivum
NAPYISAKRKGTHIINLARTARFLSEACDLVFDAASQGKSFLIVGTKKRATDLVASAAIRARCHYVNKKWFSGMLTNWSITKTRLSQFRDLRAEEKMGKFHHLPKRDVAILKRKLSTLQRYLGGIKYMTRLPDIVIVLDQQKEYIALRECAILGIPTISLVDTNCDPDLANISIPANDDTMTSIRLILNKLVFSICEGRSLYIRNR

SEQ ID NO: 9571 - protein, 557 aa, Acinetobacter lwoffii
MNYKQPLIVKSQQQALSALRNLKMQTQDTHLNQFFSDDSGRFERFSVEQEQLVLDFSKHRIDQNVLNGLVDLAHAQDLTQWIQRLFSLEEINYTEQRAAMHWALRVPEQNQQVLPEITAQVHTQLERMYSLVEKIHAGQYRGATGEVIQDVVNIGVGGSDLGPLMVTHALSDFKVVTAKPLDVHFVSTMDGSQLSDLLHQLRPETTLFIISSKSFGTIDTLSNAQTVRQWLEKALGKNSHVLKHHFIGVSTKPDKMSEWGIAPENQLLLWDWVGGRYSLWSCIGLPIALTVGVDGFKQLLSGAYAIDQHFQTAPFAQNIPVLIGLLGVWNNNFLDIQTHAVLPYDGRLKYFAAYLQQLEMESNGKSTQRSGEKVDSATCPIVWGEVGPNAQHAFYQLLHQGTHKVSCDFIAPVKRYNANHFTYAENAEALIEQHHLALSNCLAQSRLLAFGNQALTADEIEDLPTYKQYEGNQPSSTILLKELNPYSLGMLIATYEHKVFVQSVLWNINPFDQWGVEKGKEIANQLLPILNREQDDLSTFDASTQGLLKILLGKNNG

SEQ ID NO: 9572 - protein, 486 aa, Alkaliphilus metalliredigenes
MKKYNQLSFELSKPGRIAYQLPACDVPEVNLSEILPAEMIRDQDVELPELSQGDVMRHYTLLSNKNFGVDTGFYPLGSCTMKYNPKVNEDIARLAGFSHIHPYQPEETVQGALALTYELDQMLSEITGMERVTLQPVAGSHGEMTGLMIIKAYHESRGDHKRKKIICPDSAHGTNPASAAVAGFDIIEVKSNDQGEVDVESLKAVLSDEVAGLMLTNPNTLGLFETNIKEMAQLVHEAGGLLYYDGANTNAIMGKTRPGDMGFDVVHLNLHKTFATPHGGGGPGSGPVGVRKDLVPFLPTPVVEKKEDRYILDYDRPQSIGKVSTFYGNFGVTVKAFAYILSMGGDGLKKASEMAVLNANYLMHLLKDHYEVAVNRVCKHEFVLAGLKKEIAEMSTLNIAKRLLDYGYHPPTVYFPLIVREAMMFEPTETESKETLDQFADALIKIAQEAKDNPELVSSAPQHTSVGRLDEAKAARSPVVKWQRSQ

SEQ ID NO: 9573 - protein, 539 aa, Zea mays
MSIGLTAETVTNKLASAEHPQVVPNSVFIALLCLCLVIGHLLEENRWVNESITAILVGAATGTVILLISKGKSSHILVFDEELFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSVVLFNAVQKIDFEHLTGEVALQVFGNFLYLFSTSTVLGIATGLITAFVLKTLYFGRHSTTRELAIMVLMAYLSFMLAELFSLSGIITVFFCGVLMSHVTWHNVTESSRITSRHVFAMLSFIAETFLFLYVGTDALDFTKWKTSSLSFGKSLGVSSVLLGLVLVGRAAFVFPLSFLSNLSKKHPGEKITIRQQVVIWWAGLMRGAVSIALAFNKFTRAGHTQVRGNAIMITSTIIVVLFSTVVFGLLTKPLINLLIPHRNATSMLSDDSSPKSLHSPLLTSQLISSIEEPTQIPRPTNIRGEFMTMTRTVHRYWRKFDDKFMRPMFGGRGFVPFVPGSPTERSSPDLSKA

SEQ ID NO: 9574 - protein, 653 aa, Carboxydothermus hydrogenoformans
MEIIVAQNAGFCFGVKRAIETAQKAAENNNPVYSLGPLIHNPQEVERLKKAGIIPIEEIEEGNGKTIIIRSHGTTPEKLQEIVDRGYVVEDATCPFVKKAQILAQKLTDEGYQVVVVGDKKHPEVQGIVGWSGYKALVVENPEEAARLPFYPKIAVIAQTTQKSENFWQVVEVIKKKGGEVRPFNTICHATRTRQEESRKLATEVEVMLVVGGKNSANTKKLAQICAATNTPTYLIEEASEIKPEWFAGKAKVGITAGASTPAWIIEEVRKKVEQMASMEQALLEIKPVKEGEIVRGKVVKVLEKEVLVDIGTKGEGVIPLEEITWYRIERARDAVKEGDEFPVLVLKEDEEGKIILSRKKALEILAEEKLLEWQKNKVPVTGKIVEVVKGGVLVDIGVRAFLPASLIALNYVEDLEALKGEEITAYVIEVDLAKRRVVLDRKSYLKEQEIKTKKEKIATLKEGSKVKGKVTKIMPFGAFVDLGGFEGLLRAQDISWQRNVRPEEHLQVGQELEVVVLEVDRHNLKVSLGLKQLTPDPWQKIPDELKEGAVLEGTVVKILRHGLILELFPGIEGYLPARETEAENEPLMKKYQVGQKMEVKILTLKPLEKKMTLSQKEALREKEKEQYQKELAEEENLTFSLGEILRGKLKDV

SEQ ID NO: 9575 - protein, 447 aa, Alkaliphilus metalliredigenes
MFPYIPNTVEDEKKMLAAIGLPSIESLFEDIPENVRLNRELNLGKSLSEFELVKYMKSLSNQNKSIEDLTCFMGAGAYDHLIPSTVDHVISRSEFYTAYTPYQAEISQGTLQVIFEYQTMIANLTGMDVANASLYDGSSAIAEAAAMAVDATRRMEVIVSSTVHPESKRVLNTYANFKNIKIVEIESKDGVTDVEQLKNAISKETAAVILQNPNFLGIIEKVEEVEKAIHEQKGLLIMSVDPISLGVLKSPGDLGADIAVGEGQALGNTLSFGGPYLGFMATTKKLMRKMPGRIVGETTDVNGERGFVLTLQTREQHIRREKATSNICSNQALNALAAAVYLTTLGKAGLKEVALQSTQKAHYALKEITKSGKYQLAFNQPFFKEFAVKTDVTAEVVQSGLLEKDILGGYHLEKFDPKLKNMLLFAVTEKRTKGEIEQLARVLGGIK

SEQ ID NO: 9576 - protein, 385 aa, Phaseolus vulgaris
MAIDMHPIPIMPQPSNQEIKEQDQHPLVFDASLLRHQLHIPSQFVWPDEEKACLNEPELPVPFIDLGGFLSGDPLAATEASRLVGEACQKHGFFLVVNHGIQQQLISDAHLYMDHFFALPLSHKQRAQRMPGEHCGYASSFTGRFSSKLPWKETLSFQYSPRNDSQTLVKDYLCDKMGKEFEKFGNVYQDYCEAMSNLSLGIMELLGLSLGVGRGYFREFFEENNSIMRLNYYPPCQKPDLTLGTGPHCDPTSLTILHQDQVGGLQVCVDNEWHSIKPDVNAFVVNVGDTFMALSNGRYKSCLHRAVVNSETTRKSLAFFLCPRSDKVVSPPCELVDKLSPRLYPDFTWPMLLEFTQKHYRADMKTLEAFTNWLQRRSNFDNHIM

SEQ ID NO: 9577 - protein, 369 aa, Thermosynechococcus elongatus
MAQTLVVKIGTSSLAGGKEGNLALATIAQLVEVLCHCQRRGDRVVLVSSGAVGVGAMRLGLTERPQQLAQKQAVAAVGQGHLMRMYDDLFAVLRQPIAQILVTRQNFVDRQSYLNIYNTFQALFELGVIPIVNENDTVAVDELKFGDNDTLSALVASLVEADWLFLLTDVDRLYSADPRIDKTAVPIERVVSLAELAQTIQVGSAGSPWGTGGMATKIRAAEIATEAGVRTVITDGRSPTNLLKILGGEALGTHFEPRPKTINARKRWIARALIPKGELWLDEGAVKAITVGGKSLLAAGITRVEGEFQAQDAVKLCDPTGAEIARGLVNYNSEEIRRVQGQQSTELANILGYAGADTIVHRDNLVVTL

SEQ ID NO: 9578 - protein, 370 aa, Phaseolus vulgaris
MLIPHPSMLLASQNTNMEPQQINLQAPTPNQSNIPSEFVWPDNEKPCLEPPKLKIPPIDMKGFLSGDPETVSAICAEVNAACRKHGFFLVVNHGVDKKLVEKAHKLIDTFFCMELPEKQKLQRKLGEHCGYANSFIGRFSSKLPWKETLSFHYAPDTKTVEDYFLNSMGEEFREFGSFFQEYCEVMSNLSLEIMELLGMSLGVSRECFRDFFKNNESVMRLNYYPPCHKPELALGTGPHCDPTSLTVLHQDQVEGLQVFVDGKWCSVAPKEDAFVVNIGDTFMALSNGIFKSCLHRAVVNNQIVRKSLAFFLCPNKDKVVSAPKELITVENPKKYPDFTWPNLLEFTQLHYRSDPETLDAFANWVLEKNK

SEQ ID NO: 9579 - protein, 307 aa, Mycobacterium smegmatis
MSADTKWTEADVPDQSGRVAIVTGSNTGLGYETARALAAKGAHVVIAVRNLDKGRDAVDRIMASTPKADLKLQKLDVGSLDSVRTAADELKGAYPHIDLLINNAGVMYPPKQTTVDGFELQFGTNHLGPFALTGLLIDHLLPVEGSRVVAVASVAHRIRAKIHFEDLQWERRYNRVEAYGQSKLANLLFAYELQRRLAAAGKPTISVAAHPGLSNTELMRHIPGTGLPGYHQIASLFSNSPLMGALATLRAATDPGVKGGQYYGPDGFREVRGHPELVKSSSQSRDPELQRRLWAVSEELTGVSYPV

SEQ ID NO: 9580 - protein, 491 aa, Actinobacillus pleuropneumoniae
MSGAELLVNVTPSETRVALVENGLLKELHIEREAKRGIVGNIYKGRVTRVLPGMQSAFVDIGLEKAAFLHASDIVSHTECVDENEKKQFVVKDIAELVREGQDIIVQVVKDPISTKGARLTTDITLPSRYLVFMPENSHVGVSQRIESEEERNRLKALVEPYCDELGGFIVRTAAEEVSEESLQQDTIFLKRLWRKILERKAKYPVKSMLYGELALAQRVLRDFVGTHISSIRIDSKMTYEQVKEFLAEFMPELTENVSLYSGSQTLFDAYGVEDAIQKALDKRVDLKSGGYLIIEQTEAMTTIDINTGAFVGHRNLAHTIFNTNIEATQAIAHQLQLRNLGGIIIIDFIDMQEEEHRERVLQSLQEALKGDRVKTNVNGFTQLGLVEMTRKRTRESLERVLCCDCPACKGRGTIKTVETVCYEILREIVRVHHLFKTEKVRVYASKEVAEYLINEETHASIAELEAFIGKTIEIKLEPYYHQDQFDVVVM

SEQ ID NO: 9581 - protein, 305 aa, Streptococcus pneumoniae
MSIYNNITELIGQTPIVKLNNIVPEGAADVYIKLEAFNPGSSVKDRIALSMIEKAEQDGILKPGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYE

SEQ ID NO: 9582 - protein, 339 aa, Rhodospirillum rubrum
MELEKAMTVIAPSAASESVGTSATDIEFRGKVYDSIVDTIGATPLVRLARFSKAHGVVADLLGKCEFFNPLASVKDRIGFAMIDAAERDGRIKPGATLVEPTSGNTGIALAFVCAARGYRLILTMPESMSIERRKMLTHLGAEIDLTPAAKGMKGAVARAQELVESIPGAVLLQQFDNPANPEIHRQTTAQEIWNDTNGAVDIVVSGVGTGGTATGIASVLKKLKPSVKLVVVEPEDSPVISGGAPGPHKIQGIGAGFIPGNLDVSLIDEVVKVANETAFATARAVARQEGVPVGISSGAALAAAVEVGQRPENKDKTLVVILPSFAERYLSTPLFEQP

SEQ ID NO: 9583 - protein, 468 aa, Escherichia coli
MSKQQIGVVGMAVMGRNLALNIESRGYTVSIFNRSREKTEEVIAENPEKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAESYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPIPTFSAAVTYYDSYRAAVLPANLIQAQRDYFGAHTYKRIDKEGVFHTEWLD

SEQ ID NO: 9584 - protein, 591 aa, Unknown
  Azoarcus sp. EbN1
MFSDFQSSTGSRFRAAFGPSLFMTTATPVSDFQESFADLFEESLARQEMRSGEVITAEVVSIDHNFVVVNAGLKSESYVPIEEFRDDRGELEVQVGDFVHVAIDALEDGYGETRLSREKAKRIAAWNDLEKALNEGSLVKGLISGRVKGGLTVMTNSIRAFLPGSLVDMRPVKDTSPYEGKEFEFKVIKLDRKRNNVVVSRRAVLEETMGEEREKLLANLKEGTVIKGIVKNITDYGAFVDLGGIDGLLHITDLAWRRVRHPSEVLNVGDEIDAKVLKFDQEKNRVSLGLKQLGEDPWVGISRRYPQGTRLFGKVTNITDYGAFVEVEQGIEGLVHVSEMDWTNKNIHPTKVVQLGDEVEVMILEIDEDRRRISLGMKQCMSNPWDDFAINHKKGDKVRGQIKSITDFGVFIGLDGGIDGLVHLSDLSWSDTGEEAVRRFKKGDEVEAVVLAIDVERERISLGVKQLEGDPFTNFIATHEKNSIVGGTVKSVEARGAVIALNEDVEGYLRASEAAAHRVDDLTTVLKEGQEVEVMIINVDRKTRSINLSIRAKDQAEQSDAMQKFASDSSAASGTTNLGALLKAKLNEQKQ

SEQ ID NO: 9585 - protein, 495 aa, Taxus wallichiana
MDAMDLTVAKFKEFTQLQSSAILLTAVSGIIVIVILLLRSKRRSSLKLPPGKLGLPLIGESLSFQWALRSNTLEQFVDKRVKKYGNVFKTSLLGQPTVVLCGAAGNRLILSNQEKLLSRTVSDRVAKLTGDNSISVIVGDSHRIIRAAVAGFLGPAGLQIHIGEMSAHIRNHINQVWKGKDEVNVLSLARELVFATSASLFLNINDREEQHQLHKTPETILAGYFSVPINFPGFAFRKALEGNSKRRKHFSVLLEKRRRDLSLGLASRNQDLLSVLLTFKDDKGNPLTDEDDLDNISALIDGSYESTSSQMAVLLKLLSAHPQCYEKVVQEQLEIASHKKEGEEITWKDVKAMRYTWQVMQETLRMFAPVFGPRGKAITDIHYDGYTIPKGWQLSWATYSTHQNDTYFNEPDKFMPSRFDEEGGRLAPYTFVPFGGGRRTCLGWEFAKTEILLFVHHFVKTFSAYTPIDPHESIRGRPLPPVPANGFPIKLISRS

SEQ ID NO: 9586 - protein, 192 aa, Wolbachia endosymbiont
MNDQYVQKTSKDGYRSRSAYKLVEMDNKFKLFQEGQKIIDLGASPGGWSQVASQKGANVVALDIKPMNAINGVEFIQCDIINEFEILREKFKDQKFDVILSDMAPESCGLKSLDHIRIMLLCEAALNFAKHFLSHGGTFVVKIFQGESDKDFCNELKKMFKTVKYFKPKSSRSESTEMYLVSLGFIGSKPSI

SEQ ID NO: 9587 - protein, 494 aa, Populus alba
MANATTFSLMLQFFFVTFCCLSYFSFAFTSQDYANALEKSILFFEGQRSGKLPSNQRLAWRGDSGLSDGSTYHVNLVGGYYDAGDNVKFGLPMAFTTTLLAWSVIEFGTLMQNQIENAKAAIRWSTDYLLKAATATPDTLYVQVGDPNMDHRCWERPEDMDTPRNVYKVTIQNPGSDVAAETAAALAAASIVFKESDPSYSTKLLHTAMKVFDFADRYRGSYSNSLNSVVCPFYCSYSGYQDELLWGASWIHRASQNGSYLTYIQSNGHTMGSDDDDYSFSWDDKRPGTKILLSKEFLEKTTEEFQLYKSHSDNYICSLIPGTSSFQAQYTPGGLFYKASESNLQYVTSTTFLLLTYAKYLGSNGGVARCGGSTVTAESLIAQAKKQVDYILGDNPARMSYMVGFGNRYPQHVHHRGSSVPSIHDTRIGISCNDGFQFLYSSSPNPNVLVGAIIGGPDNRDNFADSRNNYQQSEPATYINAPFVGALAFFSAKN

SEQ ID NO: 9588 - protein, 727 aa, Oryza sativa
MDASAGSSAPHSHGNPGKQGGGGGGGGGRGKAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARLGGGRQGTMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKAAGAEDGTGGDDSAEAAAAAAAGKADGGGCKGKSPHGVRRSRQEAAAAASMSQMAVSI

SEQ ID NO: 9589 - protein, 793 aa, Asparagus officinalis
MLLCGPIAGFITLELSHALSSLMLLCGPIAGFIVQPCVGFYSDKCQSRFGRRRPFILVGCLFICLAVIVIGFSSDIGYALGDTKEDCSVYHGPRRKAAVIFVGGFWVLDFANNAVQGPARALMADLSGRFGYNATNAFFAFWMAFGNILGYASGSTGEWHNWLPFLNTSACCDACANLKGAFLVAVVFLLLSMLVTLIVAKEVPLSSIPGKGEEEHRAEFLDIFRSIKNLPPGMPSVLLITGLTCLSWFPFILVDTEWMGREVFHGNPKGTPSQIDAFDRGVRTSVFGIMKDLPKVLNLTLNPSPSPFDVIVVLGSGTWDQHFGKGNISAFALASAFAFVCGCLGLFMLPKLSRSTFKTPYRAGGNQSSDTHEDIGRGVEGDDGDDDGRLSGDDSDNAPSVGSDLYKDEEDKEELEKMSELDREMILAERSTKIDDYMLKKKARETSSKVEMKTRKESPPPLRGRPSLRSDKPALNELRAKRYPNAKSELYAHQMHVHGNKKAQDGGVVQEVKKGLSLRNPSLNPLPNSTLVLFPSFVVAVGRGPRIGTNRAEALTGALLGALCTLHTSHVHLSYEVRLFDDVRSFDEVRLSYEVRLFDKVRLSYEVRLFDEVRLFDEVRSIDEVRISYEVRLFDYDRSFDEVHLSYEVRLFDDVRLSYEVRLFDDIRLSNERPWAALGCGWKLSRECGIRTSVWNMNVGIPTRVWNTNVRLTCAAAVETVPVRTLKPKGFELKGSEIEEIFYLDRKILQIEEILTVLGWYTPEYCTAIPESSLALGSLHRWPNISVSQTHNS

SEQ ID NO: 9590 - protein, 416 aa, Nocardia farcinica
MITRVRSELTRYLRTETVGGAILLVAAAIALLWVNSPWGDSYLRMTETVLAIEPLHLELTLADWTKDGLLAVFFFVAGLELKRELVVGELADPKRAALPIIAAVGGVVTPALIAAVIGHGAPGMDKGWAIPVATDIAFALGVLALTGSRIPATARVFLLSLAVVDDLLAIILIAVLFTVGVSLLWLLAAAACMAGWWLAQRRRLRTPLVYVPLALVTWYALHEAGVHPTLAGVALGLLTRVRPDPDEEWAPAARLEHLIQPVSAGICVPLFALFAAGVPLNATVFGELFTDRLALAVMLGLLLGKTIGIFGISWVAIRFGLATRPSGLGYRDMFALSVLGAIGFTVSLLVAELALPDGDTVELAKAAVLITSLAASLAGSALLLRRGRVHQARQDALELQPDEGDASDPSEGGSLR

SEQ ID NO: 9591 - protein, 890 aa, Oryza sativa
MAASVEYKLAPHPWASNAPSSNLDLFPSGGGKRRSGSETDSDDEDSIPPDWRSLYHPRLEVAEPAVKDPRDEATSDAWVRRHPALVRLTGKHPFNSEPPLPRLMSHGFITPAPLHYVRNHGAVPKADWSTWAVEVTGLVKRPARLNMEQLVTGFEAVELPVTLVCAGNRRKEQNMVRQTVGFNWGPGAISTSVWRGVRLRDVLRWCGVMGASAGAANVCFEGAEDLPGGGGCKYGTSLRREVAMDPAHDVILAYMQNGEPLTPDHGFPVRVIVPGFIGGRMVKWLKRIIVASSESESYYHYRDNRVLPSHVDAELANAEAWWYKPEYMINELNINSVITTPGHDEVLPINALTTQRPYTMKGYAYSGGGRKVTRVEVTLDGGETWQVCNLDHPERPTKYGKYWCWCFWSVDVEVLELLAAKEIAVRAWDESLNTQPEKLIWNLMGMMNNCWFRVKTKTCRPHKGEIGLVFEHPTQPGNQAGGWMARQKHLETSESAVSTLKRSTSTPFLNTATTQYTMSEVRRHTTPESAWIIVHGHVYDCTGFLKDHPGGADSIMINAGHRLHRGIRTPSTPTRPVASSRCTGIGELIVTGSDYSPQSSSADLTSIVESPTATAAPAVPVSTVALSNPREKVKCRLMDKKSLSYNVRLFRFALPSPDQKLGLPVGKHVYVCASIGGKLCMRAYTPTSSVDEVGYIELLIKIYFKGEDPKFPDGGLMSQYLDYLPLGATIDIKGPIGHIEYAGRGAFTVNGERRFARRLAMVAGGTGITPVYQVIQAVLWDQPDDGTEMHVVYANRTEDDMLLREEIDRWAAAHPARLKVWYVVSKVARPEDGWEYGVGRVDERTLREHLPPGDGETLALVCGPPAMVECTVRPGLEKMGYDLDKSCLVF

SEQ ID NO: 9592 - protein, 407 aa, Unknown
  Sphingomonas sp. KA1
MITYDVVIVGAGHGGAQAAIALRQRHFEGSIAVIGEEPDLPYERPPLSKDYLSGKKAFERILIRPATFWEERGVRMLTGRRVAAVNPAAHTVSTDDGESFGYGRLIWAAGGRPRRLTCTGHDLAGVHQVRTRADVDQMIVELPETARVAVIGGGYIGLEAAAVLAEMGKHVTVLEAQDRVLARVAGEALSRFFEAEHRAHGVDVRLGAAVDCIEGRDGRAVGVRLADGTLVAADMVIVGIGIVPAVEPLLAAGALGMNGVQVDEHGRTSLPDIFAIGDCALHINAFADNLPIRLESVQNANDLATTVARTLTGDPEPYVSVPWFWSNQYDLRLQTVGLSAGHDAAITRGNPVDRSFSIVYLNQGRVIALDCVNAVKDYVQGKALVATRVAASPEALSDPALPLKAFV

SEQ ID NO: 9593 - protein, 121 aa, Glycine max
MAKSSADDGELRRACDAAIEDPRQKIVMALRVAKSHGIFGKSSSKLGRMAKPRVLALSIVGDDVVFPAAKSKGLRTSAFLRVLKYSTGGVLEPAKLYKLKHLSKVEVVANDPSGCTFTLGF

SEQ ID NO: 9594 - protein, 393 aa, Sulfolobus solfataricus
MSGDFDTIRDASSPDEVQLVRLLEEKIKSLQIEIENLRKELNYYKAEMEKMLSPPLIEAVVLDVLPDGRVLVRSSSGPNLVVNIASHIDQKLIKPGISVALNQRGSTILEVLPQKEDPIVKTMEIIERPNVTYSEIGGLEEQIRELREVVELPLKNPEIFREIGVEPPKGVLLYGPPGTGKTMLAKAVATESNAVFIHVVASEFAQKFVGEGARIVRELFEMAKRKAPSIIFIDEIDAIGAKRIDIGTSGEREIQRTLMQLLAELDGFDPLDNVKIIAATNRIDILDPALLRPGRFDRIIEVPLPDFKGRTEIFNIYLKKMKIEDNINLELLSQLTEGFSGADIKNVCVEAAYMAIRDGRNKVTMNDLVEAINKINVKRNKMESMKERREKYS

SEQ ID NO: 9595 - protein, 383 aa, Bordetella pertussis
MQGKPRIAVIGAGLGGTAGAALMARAGFNVRLYEQAPAFSLLGAGIHLGPNVMKIMRRIGIEDELNRQGSHPDYWYSRDWQTGAELARIPLGDYAVSHYGATYLTVHRGDFHALMTAALPAGLLQFNKRLTRVDEDDDVVRLHFADGSVEEAEIVIGADGVNSRLREHLLGAELPKYTGYVAHRAVFPTPLDSGSLPFDMCVKWWSDDRHMMVYFVTGKRDEIYYVTGVPEQQWDMGKSWVPSSKEEMRAAFAGWHPTVQALIEATPEVSKWPLLERDPLPLWSRGRIVLLGDACHPMKPHMAQGAAMAIEDAAMLTRIFEQTGLQDHAAAFRLYEDNRAERASRVQRVSHDNTWLRTNENPDWCFGYDVYAEPLVEGRRAAA

SEQ ID NO: 9596 - protein, 500 aa, Lupinus albus
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVARVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVLLDTLLEFAEDETMEIKITKDHIKGLVVDFFSAGTDSTAVATEWALAELINNPKVLERAREEVYSVVGKDRLVDEVDTQNLPYIRAIVKETFRMHPPLPVVKRKCTEECEINGYVIPEGALILFNVWQVGRDPKYWDRPSEFRPERFLETEAEGEARPLDLRGQHFQLLPFGSGRRMCPGVILATSGMATLLASLIQCFDLQVLGPQGQILKGGDAKVSMEERAGLTVPRAHSLVCVPLARIG

SEQ ID NO: 9597 - protein, 472 aa, Unknown
  Rhodococcus sp. RHA1
MSETATPVPAQMHRGLQNRHIRMIGLGSAIGTGLFLVSGSTIQTAGPAVLLAYVLAGAVIFLIMRMLGEMAVHSPVAGSFSEYAREHCGPLVGFIAGWNWWMTCIVVSMLELTAVGTFMDFWFPGIPHWVTAAVALVLITGVNLIHVSAFGEFEFWFTLIKVAAVVAMIVFGVAIVFGAGHYDTAALSNLWNSGGFAPHGITGILLSLVAVTFTFGGIESLGTTAGEAKDPARSIPKAVNGVIVRILIFYVGAIGVMLMIWPWARVGVDGSPFVLMLDGLGVGGAATLLNIVVLVAALSVYNTMVYSNARVLHGMAAKKQAPALLAKTNHRGVPVTGIVINSAITAIVVLLNYLFPGQLLMILVAIILSAEIITWSTIAISHLRFRRTVGAGVFRSPLYPYTNYLVLAYLAGVVVLMTQLPDFRAGAIALPLWLAGLLAAALLYRRIRRNRDHASADTAAEAGRPLIDHTPT

SEQ ID NO: 9598 - protein, 109 aa, Pseudomonas fluorescens
MSSDLIKHVSDASFEADVLKAEGAVLVDYWAEWCGPCKMIAPVLDEIAETYKGKLTVAKLNIDENQETPAKHGVRGIPTLMLFKNGNVEATKVGALSKSQLAAFLDANI

SEQ ID NO: 9599 - protein, 463 aa, Prochlorococcus marinus
MMGEKNTNDSTHIENVVIIGSGPAGYTAAIYAARANLQPLLVTGFAKGGIPGGQLMTTTFVENFPGFPDGVLGPELMDLMKAQALRWGTNLLEADAEEIELKKPPFIIKTTEETIRTNSLIIATGARANKLGIPSEVRFWSRGISACAICDGATPQFRNEELAVVGGGDSACEEAVYLTKYGSHVHLLVRSNQLRATASMSDRVISNPQISVHFETELLDAEGKDWLEKVLIKRKGSNQTRSISVKGLFYAIGHTPNIDLLKNQLEIDNKGYIITKDGRPETSINGVFAAGDVADKEWRQGITAAASGCKAALAAEKWLSKENLASLIKRKNSEPEPSPKNKSTQTTTEETFSEEAIWQKGSYPLRKLYHESNKPLLIVYTSKSCGPCHVLKPQLKRVLNELKGQALGVEIDIELDTEIAKQAGVNGTPTVQLFKSKKLHNEWQGVKQRSVFKEEIINLLKKD

SEQ ID NO: 9600 - protein, 590 aa, Ostreococcus tauri
MPVVMEAKALISSTEEWRALRSHVEAIDKTHLRDLIRDEARCDALALEYDGLYCDFARQRVTTETMEKLYDLARAAGVREKVNAMFNGEAINSTENRAVLHVATRAPKDKVINVDGRNVVPDVHDVLEKIKEFSERVRNGEWIGETGKPLKDVVAIGIGGSFLGPLFVHTALRTNPEAAVGASGRQLRFLANVDPVDVARSLNGLDPETTLVIVVSKTFTTAETMLNARTVRAWIRASLGENAVQKHMVAISTNLKLVKEFGIDPDNAFAFWDWVGGRYSVCSAVGMLPLSLQYGYDTMEKFLEGAWSMDQHFANAPFEENLPVTLGMLSVWNVSFLGCPARAILPYCQALAKLAPHIQQVAMESNGKGVAIDGTPLDYDTGEIDFGEPGTNGQHSFYQLIHQGRTIPCDFIGIVKSQQSVYLKGEIVSNHDELMCNFFAQADALAVGKSAVELRSENVPDALIPHKTFSGNRPSLSIMLPELNAYTTGQLLSLYEHRVAVQGFVWGINSFDQWGVELGKVLASRVRATMNDKRTKGETMSGGEGYNPSTTRLLNRYLAGKAKLIYPEPKDVFPCDLIDSDECRPPTSYV

SEQ ID NO: 9601 - protein, 778 aa, Yersinia pestis
MKQIRVLAQYYVDLMVKLGLVRFSLLLASALVLLAMVVQMAVTFVLRGSVETLDLVRSIFFGLLITPWAVYFLSVVVEQLEESRQRLSRLVDKLEVMRHRDLELNKQLTENITQLNQEIVEREKAEKAHLQVVDKLKEEMGHREQAQIELGQQSALLRSFLDASPDLVYYRNEDNEFSGCNRAMELLTGKSEKQLVGLTPKDVYAPDIAEKVMETDEKVFRHNVSLTYEQWLVYPDGRKACFELRKVPFYDRVGKRHGLMGFGRDITERKRYQDALENASRDKTTFISTISHELRTPLNGIVGLSRILLDTELDAEQLKYLKTIHVSAITLGNIFNDIIEMDKLERRKVQLDNQPVDFTGFMADLENLSGLLVQPKGLKFIMEPQLPLPEKVIADGTRLRQILWNLIGNAVKFTQQGKIVVRVRREGNDRLIFEVEDSGMGIPEDEQDKIFAMYYQVKDRNGGRPATGTGIGLAVSKRLAQSMGGDITVKSTQGVGSCFTLTIKAPAVQEASNAPSGDDMPLPALHVLLVEDIELNVIVARSVLEKLGNSVDVAMNGHDALAMFNPEDFDLVLLDIQLPDMSGLDIARQIRAEYGKQSLPPLVALTANVLKDKKEYLDAGMDDVLSKPLSVPALTAMIKQFWDSKPSSAVQKQEHKVMQTHESLLDTTMLEQYIDLVGPQLIHQSLEMFEQMMPGYLAVLDSNMTARDQKGITEEAHKIKGAAGSVGLRHIQQLAQQIQTPTLPAWWDNVQDWVDELKLEWRNDVQVLREWAAEVEKK

SEQ ID NO: 9602 - protein, 425 aa, Thermosynechococcus elongatus
MTHIDWLVQTDPLVAEMVQREVQRQQQHLELIASENFTSPAVMAAQGTVLTNKYAEGLPGKRYYGGCEFVDEVEQLAIDRAKELFGAAHANVQPHSGAQANFAVFLALLNPGDTIMGMDLSHGGHLTHGSPVNVSGKWFNVVHYGVHPETERLDMDQVRDLARQHRPKLIICGYSAYPRVIPFAEFRQIADEVGAYLMADIAHIAGLVASGYHPNPVPLCDVVTTTTHKTLRGPRGGLILTRDEDLGKKLDKAVFPGTQGGPLEHVIAAKAVAFGEALKPEFKAYCGQVIRNAQALAAGLQARQLRLVSGGTDNHLMLIDLRSVNLTGKEADRLMGEIHITTNKNTIPFDPASPFVTSGLRLGTPALTTRGFTEVEFAEVAEIISDRLHAPEDEAIKNRCRERVAALCAQFPLYPHLQFPQPVLA

SEQ ID NO: 9603 - protein, 500 aa, Beta vulgaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEDVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCIEECEINGYVIPEGALILFNVWQVGRDPKYWDRPSEFRPERFLETGAEGEARLLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 9604 - protein, 398 aa, Triticum aestivum
  misc_feature (75)..(75): Xaa can be any naturally occurring amino acid
MASLVQHVAGLACPPLSGASRRPGAPMRPSALVCGTYVLSKDEKERERMRTLFDEASERCRTAPMEGITFSPEDXESAVETTDIDTDIGSLIKGTVFMTTSNGAFIDIQSKATAFLPIDEACLLDIDNIEEAGIRPGLVEQFMIIDENPNDETLILSLQSIQQDLAWERCRQLQAEDVVITGKVIGGNKGGVVALVEGLKAFVPFSQVSSKTTAEELLDKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLSLSSEGILGPLSSDTAQEEGLPADE

SEQ ID NO: 9605 - protein, 128 aa, Thiomicrospira crunogena
MFKLEMRVRDYECDLQGVVNNAVYQNYLEHARHEFLLANEINFPALAKQGIDLMVVRSEIDYKASLRPHDHFYITVEMIKEGRVKVIFLQNIYRADGALMVAAKTYGATVKNGRPVRLVEELASLVAG

SEQ ID NO: 9606 - protein, 315 aa, Zea mays
  misc_feature (299)..(299): Xaa can be any naturally occurring amino acid
MYSLVFKLFLFLSLLQISVSARNLASQEPNQFQLLKYHKGALLSGKISVNLIWYGKFKPSQRAIISDFITSLTHTSPTSKTLHQPSVATWWKTTEKYYKLATPSKNSSPLSLTLGKQIIDESCSLGKSLTDKKIQTLASKGDQRNAINVVLTSADVTVTGFGMSRCGTHGHARGLGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGDLLVDTTTGGSFNAYGANGRKFLXLPALYDPTTSACSTMV

SEQ ID NO: 9607 - protein, 409 aa, Yarrowia lipolytica
MATAEAVKASGVAGESSSASQRVAKSAPSTDPVIPVDIPLAVPTTNKELPPPRHSKPSQVLRGVIAVFYFLCACLSIVLTQWIGYPLKYQSKMAWVVWVEYTKQQFIVVMLCLVQALTSTEMRVSGDETMKGVFSVDGNGYLSSRFEERAIVIANHQLYTDWIYLWWFALTSGFGGCIYILLKKSLRSIPILGSGMANYNFIFLSRKWADDEQNMKEHFQGLNKLQAPVWLTMFPEGTNTSHNGTNNSNKFAAKIGVKPMKHVLLPRTTGLRFAIENLAQTVDYLYDCTLAYEGVGRGEYGQDFYTLGNVFLRGQGPVYVKAHWTKFVIKEIPYKDEKKFEKWLYDLWYDKDQMMDNFIETGKFFPDNEESEKIAKLQLAHPLQGLQVFVIPAAAALILRLGWKYWQTI

SEQ ID NO: 9608 - protein, 242 aa, Alkaliphilus metalliredigenes
IAMGLIKEEGQIAILSDIQGMEDALGDMDLKVAGTENGITALQMDIKIAGIDRNIMETALAQAKIGRTHILNKMKEAITSPRTELSAYAPQVTKLKVHPDKVREVIGAGGKVINKIIDETGVKINIENDGTIYIAAPDQESARVALEMIELIVKDPVVGEVYTGKVIKIMDFGAFVEILPGKEGLVHISNLAHERVAKVADVLAEGDLIEVKLMEINPQGKIGLSRKALLPKPEKEAPNKVE

SEQ ID NO: 9609 - protein, 478 aa, Clostridium perfringens
MKFNELNLSDDIIKALNNLGYKNPSEVQEASIPKLLKGEDIIVKSQTGSGKTASFGIPVCEKINIEEKKVQCLVLTPTRELAIQVKDELSNIGRIKKVRCAAIFGKQPFNEQIRELKQRVHIVVGTPGRVFDHMERGTLDLSEVNYVVIDEADKMLSMGFIDQIKDILGELRLNKTTALFSATFSKEIEEICEEYMRNPMLLEVKSKVFNRDRIEESAIEIEEKNKGKALWKCLYSYHPESAIVFCNTRNKVKSVYKMLKDEGITCNELHGDMEQKKRIEVMENFRDKHFKVLVCTDIAARGIHVDSIELVINYEVPMETESYVHRIGRTGRAGREGKAITFVNHYEKKYLENVEEYIGYEIRKASLPSDEEVKAGRKIFKESQKVQLKESKKPKKEVHVDIVKIHVNGGKKKKIRAFDIVGCFSNLPGLTGEDIGIIDVQDGFSYVDILNGKGDKVLKSFKEVTIKGKKVKIQKARK

SEQ ID NO: 9610 - protein, 214 aa, Oryza sativa
MAGLAHLVLALLLPLALLPPAARGTEETPQYTTVHAESDFEVRRYRDTVWMSAPSDDISFHVATKLGFHRLFQYLMGANLNSSRIRMTTPILTSIVPGAGPLHSSAYFVRLYLPAKFQASPPVPLPELNLHPDRWPSHCIAVRSFSGYARDNNVVEEAEKLALSLSRSPWANSTNYPSKSAYSIAQYNNPFRIIGRLNEVWFDVDCKSTGVEAY

SEQ ID NO: 9611 - protein, 546 aa, Hypocrea jecorina
MGLAEHTSRVVAQFDFSDEELNRHVDEFLKQANAGLKQDGTSLSQIPSYVTAVPNGTEKGIYLAVDLGGTNFRVCSVSLNGDSTFNLVYNKVAIPKNLMVAKTARDLFAFLAKQIELFLREHHRDHFESAAHRRSTMSFPEGYRDEQIFRLGFTFSFPVQQLGINKGKLIRWTKGFDIPDAVGKDVCKLLQDEIDRLGLPVKVAALVNDTVGTLMARSYTSAGKHRSLLGAIFGTGTNGAYIEKTASITKPIPGEYDKSTGEMVINTEWGSFDNELNVLPSTVWDQTLDRESVNPGIQMYEKRVSGMFLGEIVRLAINDMMKDDEASLFRDTNSSYNDWSTTTNVSPQSGLLSQWGLDTAVLSVAAADNTPELSTIRQELENTLQVYTPSLEDAQAFKAVAGAVVRRAARLAAVAIGAIVLQSGKLDDPEEELIDIGVDGSLVEHYPFFRDMIYEALRAIEGIGPSGADKIRIGIAKDGSGVGAALIALIAQKMEKPGDFLADLRRDIRRRLSLPFENAGMLPLQNHSTPAFCFLCSVSLAPSLLA

SEQ ID NO: 9612 - protein, 409 aa, Glycine max
TASSHFFSSDSTTCPNSEVPLLLVILLFFLLLRTSNTKTKHYNSQFHRNTRINKTHNNKRSEKWRAQWRRRVARARKLSLWSFLLHLVGRSCFGGLWLAFKRGEKKRSYKNLEIQRNFAFSESGWSRCLSKFIPKKAGTPKKNEIVFTAPTGEEINNRKQLEKYLKAHPGGPAVSEFDWGTGETPRRSTRISEKAKAAPPIESEPPKKRTKRSSASQKETSQEEKEEKTKEAEMQEADYTTKDDNDIEKEKDVVMENQDVKSVEDTDVNKSTHSGEEAKAGENVEVPIEKDKSNAADGELPALKDKVDDKGTEGSEVFLRKDEVKIEQPQEETKEYRGSGEPEKSETCTTADKTVEVEGVDKEEHVKSTHEFEVGEMEGTKVIGEEHHKLDEINKKAETELTVNGNHGS

SEQ ID NO: 9613 - protein, 802 aa, Prunus avium
MVHGLESSDVAFCGGDLHHHHMKDVNIPISDGFGGGGAMEELEDQEDNLGVDPSEMWLDDNDQETAFLADVNDPSIFYNDHFPPLPDFPCMSSSSSSSSTPAPVKPVTSSSTSSSISSSSSAASWAILRSDAEEDGERRQQQHHNSYNHRYQYSQVDDQAVDAHALSSTASMEISQPSDLGREGGAIDCMGAMETFGYTDLFESNEFFDLSSIFQSDSLLMEQFQQDDDHQQLLTPHQLQDPNEATAIIPQQQQQQEVAVRDEENNKKDDQNENKEPDDMAMVFLEWLRSNRETVSAEDLRSVKIKKSTIECAARRLGGGKEAMKQLLKLVLEWVQTNHLQKRRSNSLTTKDANIVAQQQQYHDPFQNPNPNTSPRVLEPNPSCSFTQTPWMAPPPHAAYDHAGESLSPLRPRRPPPAAYPSMMGYIAPDQYVNGPGPYQPSPEYHHMIDSGQPTWPSSPFGMGTAHYGSFPDNNIHLAPPPQHRPQAFAGYGSQYQPYQYFPGNGEHQLMRLGSSATKEARKKRMARQRRLVSHHRHGHHHQQQHLNAQMPDHLLHQQHTRLVGNAANLNCANSVPLQANPGNWFYWATATAAPSPSPAMMPSITPEAAPPPPVQQMDRPASTQAQNYNQGRSAAQERQERRQGWKSEKNLKFLLQKVLKQSDVGSLGRIVLPKKEAETHLPELEARDGISIPMEDIGTSRVWNMRYRYWPNNKSRMYLLENTGDFVRANGLQEGDFIVIYSDVKCNKYMIRGVKVRQAGPKSEGNKRPGKSQRNQHASTPAGTNGSSPSSASASATHKKQ

SEQ ID NO: 9614 - protein, 492 aa, Hypocrea jecorina
MVGLGPRPPPSRKGSAADLPKDLLNEVRKLEEIFTVDTAKLKEITDHFVNELAKGLSVEGGSIPMNPTWVMSYPDGHETGSFLALDMGGTNLRVCEITLTDRKSEFDIIQSKYRMPEELKTGSSEELWEYIADCLHQFIETHHGDCSKLEALPLGFTFSYPATQHYIDEGILQRWTKGFDIAGVEGKNVVPMFEAAIAKRGVPIKLSALINDTTGTLIASAYTDPKVKIGCIFGTGCNAAYMEDCGSIPKLAHMNLPPDCPMAINCEWGAFDNEHKVLPRTKYDIAIDEDSPRPGQQAFEKMIAGLYLGEIFRLVLVDLHDNKDIHIFENQDISLLRRPYTLDSSFLSGIEEDPFENLQETFDTFQSKLNITPTGPELELVRRLSELIGTRAARLSACGVAAICKKKSFESCHVGADGSVFNKYPHFKARGAKALREILDWPAKSNPKEEDPVEILAAEDGSGVGAALIAALTLKRAKAGNLAGILHPENFV

SEQ ID NO: 9615 - protein, 567 aa, Oryza sativa
MASAPPVQEEPLQPGTNHFRSLLAAAVRSISWSYAIFWSISTSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKTIICIPFTSGVLELGTTDPTFIIAYACHNMEQVLEDPKLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVPASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 9616 - protein, 265 aa, Oryza sativa
MVSEDPNLVNRIVAYLKELQFPICLEVPSSTPSPDETEDADTVFDGLIEEDQMVILQGEDELGDVVVAECETNGANPETITMETDEFYSLCEELDLDLGSYQLVPTSARETVAAAAAAANDVDGVAYSHASCFVSWKRANPAEKVVAVPMTAGIESQKLLKKAVGGGTAWMSNIDDRGSVAITTTPGSNIKSHVMSERRRREKLNEMFLILKSLLPSVRKVDKASILAETITYLKVLEKRVKELESSSREPSRWRPTEIGQGKAP

SEQ ID NO: 9617 - protein, 324 aa, Cryptococcus neoformans
MGRAEAGSTKAIANAIKAKGLGRLRWYCQVCEKQCRDENGFQAHCRSEPHMRKIMLLGPKAGQAISDFSRQFQSEFLLLLRTRHLTNRVQANKVYNEYIQDKHHVHMNATRWVTLSGFIQTIGKEGLVKVDEDEKGIWIQWVDNRPETLSKQAAAMKVERSQMDSEERERKMLEEQIARARAQQADQPDLTVGLQKKEGEKIKLNLFGASEPKTEEGKEEESASASAETKPTIGFGKLSAPGTAKPLAVSTNPLKRPAPVNVFKSSKAAKTESGGSAINGDSNGAPKYKSEAERLMMEDQARKASRGQGQGQGYRGFGPSRGGR

SEQ ID NO: 9618 - protein, 276 aa, Unknown
  uncultured alpha proteobacterium EBAC2C11
MLRVAALQYCASDDVAKTLHHIQPLIAEAASKASLVALPECANYLAASREQLFQKAEWDDESYSQKWLGNIAREFGIWLLAGSLIMRRRDNNQLANRSLLFGPDGEVIAYYDKIHMFDADVGDGKMYRESASFSAGQSPVIAHIDNVPCGLTICYDVRFAHLYRQLALDGAQLFLVPAAFTALSGKAHWHVLLRARAIETGCYIVAPAQSGTHADGRKTYGHSLIINPWGEIIAEAKDGDSIIYAALDLSATARARNAIPSLKTNPVIGPTRTIGP

SEQ ID NO: 9619 - protein, 334 aa, Triticum aestivum
MASQGVASMFALALLLGAFASIPQSVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLFDTTVDAFYTAMAKHGGSNVKLVVSESGWPSGGGTAATPANARIYNQYLINHVGRGTPRHPGAIETYVFSMFNENQKDSGVEQNWGLFYPNMQHVYPISF

SEQ ID NO: 9620 - protein, 533 aa, Prochlorococcus marinus
MNFPDFNNNNKDDQWERFSQLLFYDEEIGFWLDISRMKFSSEDIGSLQDNFKEACKSMKALEKGSIANIDESRQVGHYWLRNASLAPSKQTSNSIRNEINDIKTFGENILNGKITTAQGKPFTDVLWIGIGGSGLGPLLIVNSLQDNNKGLNFSFLDNVDPNGINKTLNSFRDKLSTTLFVVVSKSGGTPEPQIAMDQTRFFLDKNGLDWSSRAVAITMEGSSLDQIAENEKWLKRFDLPDWVGGRTSITASVGLLPLVLIGEDIDSFLDGASQMDQITRRIDIYKNPSALLAASWYFSGAGKGKRDMVVLPYQDRLQVFSKYLQQLVMESLGKEEDRNANKVNQGLAVYGNKGSTDQHAYVQQLRDGIDNFFVTFVEILEDCTEIPKINKKSPGDYLSGFLQGTRLALSENDRQSITITIKKFNSYTLGSLIALFERAVGIYAELIDINAYHQPGVEAGKKAASNILKLQSEIELLLEDGKLYSIEGIMNTIPGSSQESIYIILRHLSNNDHTYKFVGNLSDPRELQIKKAV

SEQ ID NO: 9621 - protein, 286 aa, Streptococcus pneumoniae
MDLWFSEVHTPDVKLSLRTAKQLYAGKSEWQDIEVLDTPAFGKILILNGHVLFSDADDFVYNEMTVHVPMAVHPNPKKVLVIGGGDGGVAQVLTLYPELEQIDIVEPDEMLVEVCREYFPDFAAGLDDPRVTIYYQNGLRFLRNCEDDYDIIINDATDPFGHTEGLFTKEFYGNSYRALKEDGIMIYQHGSPFFDEDESACRSMHRKVNQAFPISRVYQAHIPTSPAGYWLFGFASKKYHPVKDFDKEGWKKRQLFTEYYTANLHVGAFMLPKYVEDILEEEEGKK

SEQ ID NO: 9622 - protein, 287 aa, Unknown
  Acinetobacter sp. ADP1
MLSNFGIAGIQMQVSAFTSNVEQMGNYMRHIRMRYPWVKMVLFSELAPLGPKHSTAEVFPSQTEAQLAELARETGLWLIPGSLFERVESPEGDVIYNTLSVINPQGQIVARYRKMFPFRPYEKSVAGGNEFCVFDVPEVGRFGVSICYDMWFPETTRTLVAMGAEVILHPTMTDTIDRDIELSIARASAAQNQVYFIDINGVGDGGIGRSIVIDPSGYVLHQSEAGPEIIPIDVDLEKVRRERRRGLRSLGQPLKSFRDRDCNFTVYQDTTAFPYLDSLGPLVKPDD

SEQ ID NO: 9623 - protein, 361 aa, Unknown
  Dehalococcoides sp. BAV1
MKAIILVGGQGTRLRPLSINTPKSMVPVLNVPFLSHVLRHLSSYGIKDIILTQGHLAAPIEQYFGNGQSLGVNLVYSVEHEALGTAGAIKNAERFLDDTFFTLNGDIFTHLDLDAMLQSHRDRKALVSIALTPVDDPTKYGLVETTPDGRVSRFLEKPSPSQITTNMINAGTYLIEPEVLKYIPEGENHSFERQLFPRLLNECQVVYAYPSSAYWIDIGSPEKYSQLNRDLLCGEGGDFGFSRGNEIIIGRGCQLHPTAQISGPVLVGENCVIGANARITGPVVIGAECRIEDEATLTESVIWRNVTIGTECKVVSSIIANHCHLKAGGKYENVVLGDNVTAECGCAPEPGSKVCPGILMI

SEQ ID NO: 9624 - protein, 411 aa, Nicotiana plumbaginifolia
MNALAATNRNFRQAARILGLDSKLEKSLLIPFREIKVECTIPKDDGTLVSYVGFRVQHDNARGPMKGGIRYHPEVDLDEVNALAQLMTWKTAVADIPYGGAKGGIGCKPKDLSKSELERLTRVFTQKIHDLIGINTDVPAPDMGTNAQTMAWILDEYSKFHGHSPAIVTGKPIDLGGSLGREAATGRGVVYATEALLAEYGKNIKDLTFAIQGFGNVGAWAAKLIHERGGKVIAVSDITGAVKNPNGLDIPALLNHKEATGKLIDFSGGDVMNSDEVLTHECDVLIPCALGGVLNRENADNVKAKFIIEAANHPTDPEADEILCKKGIVILPDIYANAGGVTVSYFEWVQNIQGFMWDEEKVNRELRKYMTKAFHNLKNMCQSHNCSLRMGAFTLGVNRVARATTLRGWEA

SEQ ID NO: 9625 - protein, 456 aa, Saccharomyces cerevisiae
MSSSQQIAKNARKAGNILKTISNEGRSDILYKIHDALKANAHAIEEANKIDLAVAKETGLADSLLKRLDLFKGDKFEVMLQGIKDVAELEDPVGKVKMARELDDGLTLYQVTAPVGVLLVIFESRPEVIANITALSIKSGNAAILKGGKESVNTFREMAKIVNDTIAQFQSETGVPVGSVQLIETRQDVSDLLDQDEYIDLVVPRGSNALVRKIKDTTKIPVLGHADGICSIYLDEDADLIKAKRISLDAKTNYPAGCNAMETLLINPKFSKWWEVLENLTLEGGVTIHATKDLKTAYFDKLNELGKLTEAIQCKTVDADEEQDFDKEFLSLDLAAKFVTSTESAIQHINTHSSRHTDAIVTENKANAEKFMKGVDSSGVYWNASTRFADGFRYGFGAEVGISTSKIHARGPVGLDGLVSYQYQIRGDGQVASDYLGAGGNKAFVHKDLDIKTVTL

SEQ ID NO: 9626 - protein, 586 aa, Triticum aestivum
MITGTDFYHVMTAMVPLYVAMMLAYGSVKWWGIFTPDQCSGINRFVALFAVPLLSFHFISTNNPYTMNLRFIAADTLQKLIVLALLTLWSHLSRNGSLEWTITLFSLSTLPNTLVMGIPLLKGMYGDESGSLMVQIVVLQCIIWYTLMLFMFEYRGARIPINRAVPDTAGAIASIAVDPDVMSLDGRRDMIETEAEVKEDGKIHVTVRRSNASRSDIYSRRSMGFSSTTPRPSNLTNAEIYSLQSSRNPTPRGSSFNHTDFYSMVGRSSNFAAGDAFGPVVRTGATPRPSNYEEDKAGNNNNSKYGQYPAPNPAMAAPQKPAKKAANGQAKGEDGKDLHMFVWSSSASPVSDVFGNGTEAYNDAAAKDVRVAAASPRKADGVERDEFSFGNKERDAEAGDEKAAAEQGTAGLVAAPTVMPPTSVMTRLILIMVWRKLIRNPNTYSSLIGLIWSLVCFRRNFVMPAIIMKSIAILSDAGLGMAMFSLGLFMALQPRIIACGNKRATFAMAVRFLTGPAVMAAASIAVGLRGTLLQIAIVQAALPQGIVPFVFAKEYSVHPDILSTAVIFGMLIALPITLVYYILLGL

SEQ ID NO: 9627 - protein, 209 aa, Arabidopsis thaliana
  misc_feature (65)..(65): Xaa can be any naturally occurring amino acid
  misc_feature (124)..(124): Xaa can be any naturally occurring amino acid
  misc_feature (140)..(140): Xaa can be any naturally occurring amino acid
  misc_feature (151)..(151): Xaa can be any naturally occurring amino acid
  misc_feature (180)..(180): Xaa can be any naturally occurring amino acid
  misc_feature (187)..(187): Xaa can be any naturally occurring amino acid
TRKKKKKKSPYYPPPPTRGLTKSEEDLWLSSMVSSARMVASPAQVTMVAPFNALKTSGAFPVTRXKANNDITSITSNGGRVNCMQGWPPIGKKNRDTLSYLPDLTDSELDKEVDYLIRTKWIPXDEFELKNGFVYPEHGXNSPGYYDGRDXTMRMLPLFSCTYSAQVLKEVGECKKEYPXAFIKIIXFNNTREVQSIRFIAYKTPSFTG

SEQ ID NO: 9628 - protein, 219 aa, Ashbya gossypii
MSNNEDYGYDYDYLFKIVLIGDSGVGKSNLLSRFTTDEFNVNSKSTIGVEFATRTIEVEGKKVKAQIWDTAGQERYRAITSAYYRGAVGALIVYDISKSSSYENCNHWLTELRENADENVAVGLIGNKSDLAHLRAVPTDEAKNFAQGNQMLFTETSALNAENVDLAFRELITAIYQMVSKNQVDLSENNGSGTVPRGPTISLAPAPSEKSKKKTNNCC

SEQ ID NO: 9629 - protein, 600 aa, Oryza sativa; identical to SEQ ID NO: 505

SEQ ID NO: 9630 - protein, 168 aa, Saccharomyces cerevisiae
MARRPARCYRYQKNKPYPKSRYNRAVPDSKIRIYDLGKKKATVDEFPLCVHLVSNELEQLSSEALEAARICANKYMTTVSGRDAFHLRVRVHPFHVLRINKMLSCAGADRLQQGMRGAWGKPHGLAARVDIGQIIFSVRTKDSNKDVVVEGLRRARYKFPGQQKIILS

SEQ ID NO: 9631 - protein, 322 aa, Agrobacterium tumefaciens
MSDTNNPYGGSYGGQMTASAHHNGELNGAASGHIKDTTTAGFSKDVLEESRRQPVLVDFWAPWCGPCKQLTPVLEKVINEANGRVKLVKMNIDDHPSIPGQLGIQSIPAIVAFADGRPVDGFMGAVPESQIRQFIDKIAGPDAGDPKAEIEAALSEAKQLLADGDFNGAAQLFGAVMQADPENPAAIAGIAECMIAAGQYERASELLSSLPAELNDDAGIQLVSKKIAQYEEARKIGDPVALERDLAQNPDHHEARVKLAKVLNAQGRRDEAADHLLYVMRKDRTFDDDGARRQLLEFFESWGFKDPASIAGRRKLSAILFS

SEQ ID NO: 9632 - protein, 226 aa, Suaeda salsa
KLVSQIKESTKIPVLGHADGICHVYVDKSASLDMAKQIVLDAKLDYPAACNAMETLLVHKDLLQNGGLNELVSDLRSEGVELFGGPRVSALQELSIPATHTFHLEYNSPACTVEIVEDVFAAIEHINQHGSAHTDCVVAEDHKVAEVFLQQVDSAAVFHNASTRFCDGARFGLGAEVGISTSRIHARGPVGVEGLLTTRWILKGSGQIVDGDKGVVYTHKELPIVA

SEQ ID NO: 9633 - protein, 266 aa, Phacelurus digitatus
CELDNIMRLTGITGIVNGMDVSEWDPSKDKYITVKYDVSTAVEAKALNKEALQAEVGLPVDRKIPLVAFIGRLEEQKGPDVMAATIPQLMEEDVQIVLLGTGKKKFERMLMSAEEKYPDKVRAVVKFNAALAHHIMAGADLLAVTSRFEPCGLIQLQGMRYGTPCACASTGGLVDTVIEGKTGFHMGRLSVDCNVVEPADVNKVATTLKRAIKVVGTPAYEEMVKNCMIQDLSWKGPAKNWENVLLNLGVAGGEPGIEGGRSRRSP

SEQ ID NO: 9634 - protein, 258 aa, Paspalum simplex
CELDNIMRLTGITGIVNGMDVSEWDPSKDKYIAVKYDVSTALEAKALNKEALQAAAGLPVDRKIPLVAFVGRLEEQKGPDIMAAAIPQLMEEDVQIVMLGTGKKKFERMLMSAEEKYPNKVRAVVKFNAALAHHIMAGADVLAVTSRFEPCGLIQLQGMRYGTPCACASTGGLVDTVIEGKTGFHMGRLSVDCKVVEPADVQKVATTLKRAIKIVGTPAYNEMVRNCMMQDLSWKGPAKNWENVLLSLGVAGSEPGIG

SEQ ID NO: 9635 - protein, 617 aa, Cucumis sativus
MITLSDFYHVMTAVVPLYVAMILAYGSVKWWKIFTPDQCSGINRFVALFAVPLLSFHFISTNNPYTMNLRFIAADTLQKLIVLAVLAVWSNISKRGCLEWTITLFSLSTLPNTLVMGIPLLKGMYGDFSGSLMVQIVVLQCIIWYTLMLFMFEYRGARMLISEQFPDTAGSIVSIHVDSDIMSLDGRQVLETEAEIKEDGKLHVTVRKSNASRSDIFSRRSVGLSSTTPRPSNLTNAEIYSLQSSRNPTPRGSSFNHTDFYSMMAAGGRNSNFGSSDVYGLSASRGPTPRPSNYEEEGGGNGGKPRFHYNATTGGNANANANANVNHYPAPNPGMFSPTGSKNAQPNNAKKPANGKTEDGSRDLHMFVWSSSASPVSDVFGNHEFGAHNDQKDVRLAVSPGKEGRRENQEEYAEREDFSFGNREMMNSNNNGGVGVGGTEKVGDIKPKTMPPTSVMTRLILIMVWRKLIRNPNTYSSLIGLTWSLVSFRWNVEMPAIIAKSISILSDAGLGMAMFSLGLFMALQPRIIACGNSIAAFSMAVRFLTGPAVMAVASIAVGLRGVLLRVAIVQAALPQGIVPFVFAKEYNVHPDILSTGVIFGMLVALPITLVYYILLGI

SEQ ID NO: 9636 - protein, 713 aa, Burkholderia pseudomallei
MSLFNKIVKEFQWGQHKVRLETGEIARQASGAVIVDIEDTVVLATVVGAKSAKPGQDFFPLTVDYIEKTYSAGKIPGGFFRREGRPSEHETLTSRLIDRPLRPLFPEGFYNEVQVVIHVLSVNPEIPADIPALIGASAALAVSGLPFNGPVGAARVAYVNNEYVLNPTREQIKASRLDLVVAGTERAVLMVESEADQLPEDVMLGAVVFGHEQMQTAIDAIHELVREGGKPEWDWQPAPKDEALNARVTELAQPELLAAYQIRDKQARSTKLKEVYAATSAKLEEEAVAAGTVAADKATVGNILFDLEAKIVRGQILNGEPRIDGRDTRTVRPIEIRTGVLPRTHGSALFTRGETQALVVATLGTKGDEQIIDALEGEYRERFMLHYNMPPFATGETGRVGSPKRREIGHGRLAKRALVACLPSADEFGYSIRVVSEITESNGSSSMASVCGGCLALMDAGVPMKAHVAGIAMGLILEGNKFAVLTDILGDEDHLGDMDFKVAGTADGVTALQMDIKIQGITKEIMQVALAQAKEGRMHILGKMKDAVAGANTQLSEFAPRMITIKINPEKIRDVIGKGGSVIRALTEETGTTIDISDDGVVTIASTNSEGMAEAKKRIENITAEIEVGHVYEGTVLKLLDFGAIVNLLPGKDGLLHISEIVNERVKDINDYLKEGQQVKVKVIQTDEKGRVRLSAKALLNEAAAQADTPPQQ

SEQ ID NO: 9637 - protein, 126 aa, Borrelia garinii
MEKKIALIAHDKKKDDLVNFVKQNYLFLSKFKLIATGTTGSRIQQATDLTIIKYKSGPMGGDQQIGAEVAEGNVLAIFFFRDPLTNQPHEPDVSALIRLCDVHNIPLATNVKTAEILIKGFEGLNT

SEQ ID NO: 9638 - protein, 73 aa, Codonanthe serrulata
ISGTNGEVMPGQWEFQVGPSVGIEAGDHIWCARYLLERITEQAGVVLSLDPKPIEGDWNGAGCHTNYSTKSTR

SEQ ID NO: 9639 - protein, 958 aa, Pseudomonas aeruginosa
MSQTPSLAQLQPADAFLRRHLGPDPAEQQAMLDFLGVSTRAELIVQTVPPAIRLNRPLELPAALDEQAALARLRGYAGLNQRWTSLIGMGYYGTVTPPVILRNVLENPGWYTAYTPYQPEIAQGRLEALLNFQQLTIDLTGLDLASASLLDEATAAAEAMALARRVAKARSNRFFVDAHCHPQTVSVLRTRAEAFGFELVVDEPDNLAAHAVFGALLQYPDSRGEIRDLRPLIEALHGQQALACVASDLLALLVLTPPGELGADVVLGSAQRFGVPMGYGGPHAAFFATREGYKRAMPGRIIGVSRDARGNPALRMALQTREQHIRREKANSNICTAQVLLANIASLYAVYHGPQELKRIAQRVQRLTALLAAGLESKGLRRLNRHFFDTLTYEVGERQAAILERARAARVNLRVVDDRRLALSLDETCDAATLATLFEIFLGAGHGLDVAHLDGGAVADGIPAVLQRTSAYLQHPVFNAHHSETEMLRYLRQLEGKDLALNQAMIPLGSCTMKLNASSEMIPITWPEFAELHPFVPREQAEGYRRMIDELEAWLRAITGFDAICMQPNSGAQGEYAGLLAIRRYHQSRGDSQRDICLIPASAHGTNPASAIMASMRVVIVECDPCGNVDLDDLRLKAAEAGDRLSCLMITYPSTHGVYEEGIGEICEVVHRHGGQVYMDGANLNAQVGLARPADIGADVSHMNLHKTFCIPHGGGGPGMGPIGVKRHLAPFVANHPVIRVEGPNPLNDAVSAAPWGSASILPISWMYIAMMGPQLADASEVAILSANYLANRLDGAFPVLYRGRNERVAHECILDLRPLKAQTGITEEDVAKRLMDYGFHAPTMSFPVPGTLMVEPTESESKAELDRFVEAMLSIRAEIGKVESGAWPAEDNPLKRAPHTLADVTGIWQRPYEIAEAVTPSEHARAFKYWPAVNRVDNVYGDRNLFCACVPLDDYRE

SEQ ID NO: 9640 - protein, 363 aa, Gibberella zeae
MGAPEVHHLFHNPIADHSFSADQSTLAVARDTSVELYGKVGSAFKLKDSLKGHDKTVTGVDIAPNSGRIVTCSQDRNAIVWEPSPEGYKPTLVLLRISRAATFVRWSPSENKFAVGSGDRVIAVCYFEEENDWWVSKHLKKPIRSTITSVAWHPNSVLLAAGSTDAHARVFSAFIKGMDARPPPGVWGERLPFNTVCGEYLNNSAGWVHSVSFSPSGDSLAFAAHDSSITVVYPSGPDQAPRAVVTVSTQQLPFKSLIWTSEDEIIAAGYDCEAFRFQGGEGGWQLAGPIEQKGGPGLGEHREESALNMFRQMDLKGKAKDDTQLQTTHQNTISTVRPFESSGDRVTKFSTSGVDGRIVLWSA

SEQ ID NO: 9641 - protein, 608 aa, Unknown
  uncultured bacterium
MGFTTCKVKSHEAHSYNYANSLWSLRMKSLFILLLTLVFVAGCSDSGSVSQSAANLSSSTSSDSTTSADYLSLAIVEEPTHWWHSTIFYEIWPRSFQDSDGDGSGDFNGMTNKLDYLKDLGVKGIWLTPVFEAPSYHGYDFQDFYNVETDYGTMADFENFIAQAHKRNIKVILDLVLNHISDKHEWFIKSANKTAGYEDYFIWRDERPTSGWGQPWSAESNPAAVWHWNETRKAFYYGAFGSSQPDLNLTKQVVIDELNKLASFWLAKGVDGFRLDAVRYAVEEGGYPLQADTQGTIDYWTIFSQHVKSVKPDAMLVAEAWADLKTIGKYRNNGKGLDSSFDFDFGTVVIDMLNPAVKQTADFGTISTNHLQQSRESLWANLTARKAAAPIHYFSPFLTNHDQTRIMYTLENDIAKAKIAASLLMTTPGILYIYYGEEIGLSQYKTGDDQYRRAIMQWSDEDSAGFNATGEFWLDQAKWFPWMQNHQGWWANYWQSLKGTGKSVAAQAQDPQSLFNHYKRMINVRNKNPVLQLPQEVRYYPVDNKEVWLVENIVVGKSVWVLINLSSTVDAEFVVPKNLRGARVDQVTGKEINLGERVSLPAAGVMIF

SEQ ID NO: 9642 - protein, 351 aa, Borrelia garinii
MKISVIGAGAWGTAIAKSLADKFDFNIFLWSFEEDVKNGINNDNVNDKYLKGIKLPKNLVASSDLFEVVSMSDYILISTPSLFTVDIFKKLDQFFDSLELKPKLAILTKGFLTFNGKTHTVIEAAEKVIKGYKDEITYIVGPSHAEEVGLGVITGLVAASNSRENAYLFINLFSKTSISLFYSNDVFGVQIAAALKNVFAIAFGILDAYKLNYPNLIGNNTESFLFSISLNNMKDIAIELGGKNVETFLFLSGSGDLDVTCRSMFGRNRRFGNEIVSKNILESFFSIDDLINNIEKIGYLPEGVFAAKSIFSLLKELNRDFNPNSLLSVIYKILNKELRAESVIDYMRNIG

SEQ ID NO: 9643 - protein, 645 aa, Ustilago maydis
MDVDKLFKLPSLPSAAVTKRKWTAPTPGEASSSGTDVSPSEQAPVRPHKAARVENEGDDDQAAAAEDETQFFSDDDQEDTRFFGGGLTDEQKQILDIIDSADTSSTAFAPTSTSSAHDVPSLRKQLLRFERAINKNAEMRVKHASDPTRFIESEADLDAELKSLLVLTTQPLQFYPEFIKLGGVASVVALLSHDNADIAAAAIEVIEELTDEDVLDQVNVEEDDGEQAERGLKVMSELVEALLEQSVLDLLVSNLSRFIDHVDLNLEQEQAATQAIQAESDAQAIYHTLGVVENLVTTRPALAERLVSETSFLEWILARLAAKRAVDQNTSYAAELLAILLQNSEPNRSALAATTISSDPGRENGIDVLLGVAARYRRTSPSSGEEQEWVENVFDCLCLALLQAENKWVFVQAEGVELMVLMMKEKKSFGRVRAVKVLDHATSGAQGSGACLRIVEAQGLSALFSVFLECNSASRKRSGSTATLQDAEHVLGVMSSLLTHLASDSIARIRLLAKFVYHNYTHVDHLLDLRETLSAQLDTLPPLSTDRDEDAYQQLYLEHLEHGLYSLQLLDTILAWLVMEDDACKDHISVLLKRARLDFAHLATTLRVYRENVGDQVAIEADQSNQDALKTKDILDALIAYLESL

SEQ ID NO: 9644 - protein, 182 aa, Cucumis sativus
YRGDWHGSEVAVKILTEQDFHPERVNEFLREVAIMKSLRHPNIVLFMGAVTKPPNLSIVTEYLSRGSLYRLLHKSGVKDIDETRRINMAFDVAKGMNYLHRRDPPIVHRDLKSPNLLVDKKYTVKVCDFGLSRLKAHTFLSSKSAAGTPEWMAPEVLRDEPSNEKSDVYSFGVILWESNSRG

SEQ ID NO: 9645 - protein, 66 aa, Glycine max
MVRFFSAVSILILVAVTALMVVLPLMLPPLPPPPLVLLFFPVGIMAVLMLLAFVLSEAPMTTKVIL

SEQ ID NO: 9646 - protein, 272 aa, Griffithsia japonica
RFVQACTRRLMSDVPVGVFISGGLDSSLVASIAKKHLPDGYVFHSFSCGLEGSPDVRAAQKVADYLGTKHHVLTFTVEDGISALRDVIYHLETYDVTTIRASTPMYLLSRLCKQYVKVVLSGEGADEVYGGYLYFHNAETERDFHEETVRRVKLLYTSDVLRGDRSTAAQSLELRVPFLDRDFLDVSMSFSAQDKVTQKGKRIEKWPMRQAFAKEFCGEEFLPDDILWRSKEQFSDGVGYNWIDGLKEFCDKEVSDKLLANASDKFPHQPPK

SEQ ID NO: 9647 - protein, 514 aa, Magnetospirillum magnetotacticum
TDSPSRVWARFIAEERNSPEAAEAITGVDPQEIRKAARLYATGGNAAIYYGLGVTEHSQGSTMVMGMANIAMATGNIGKVGAGVNPLRGQNNVQGSCDMGSFPHELTGYRHVSDDATRESFEAIWGAKLDSAPGLRITNMLDEAVGGSFKGMYIQGEDIAQSDPDTHHVTSGLKAMECIVIQDIFLNETAKYAHVFLPGASFLEKDGTFTNAERRISRVRKVMAPLGGYGDWEGTIMLARALGYEMNYSHPSEIMDEIARLTPSFTGVSYQKLEELGSIQWPCNEKAPLGTPMMHVDRFVRGKGRFMITEYVATDERTTGKFPLILTTGRILSQYNVGAQTRRTENSRWHEEDVLEIHPFDAEMRGIVDGDLVSLESRSGDIALKAKVTERMQPGIVYTTFHHAKTGANVITTDYSDWATNCPEYKVTAVQVRRTNRPSDWAGQVLRGRLLAHPHRASRGVIFGERRRDIRSGSPTHPPHPEAPERSGGLEGGLQTALQVLKPSFEARQGGHLG

SEQ ID NO: 9648 - protein, 139 aa, Glycine max
  misc_feature (129)..(129): Xaa can be any naturally occurring amino acid
  misc_feature (131)..(131): Xaa can be any naturally occurring amino acid
  misc_feature (133)..(133): Xaa can be any naturally occurring amino acid
MSSKESCRSELRIAIRQLSDRCLYSASKWAAEQLVGIEQDPAKFTPSNTRFQRGSSSIRRKYKTHEITGTPIAGVSYVATPAMEEDELVDGDFYLLAKSYFDCREYKRAAHVLRDQNGRKSVFLRCHAXYXAXEKRKEE

SEQ ID NO: 9649 - protein, 620 aa, Neurospora crassa
MDNTNRPHLNLGTNDTRMAPNDRTYPTTPSTFPQPVFPGQQAGGSQQYNQAYAQSGNYYQQNHNDPNTGLAHQFAHQNIGSAGRASPYGSRGPSPAQRPRTSGNSGQQQTYGNYLSAPMPSNTQTEFAPLPSGTPTNMAPMPTTTRRSAHSWPLTSLRTASSAPGSATRGECCSDALLPLHPAVIGADTLFRQSEMEQKLGETNDARRRESIWSTAGRKEGQYLRFLRTKDKPENYQTIKIIGKGAFGEVKLVQKKADGKVYAMKSLIKTEMFKKDQLAHVRAERDILAESDSPWVVKLYTTFQDANFLYMLMEFLPGGDLMTMLIKYEIFSEDITRFYIAEIVLAIDAVHKLGFIHRDIKPDNILLDRGGHVKLTDFGLSTGFHKLHDNNYYTQLLQGKSNKPRDNRNSVAIDQINLTVSNRAQINDWRRSRRLMAYSTVGTPDYIAPEIFTGHGYSFDCDWWSLGTIMFECLVGWPPFCAEDSHDTYRKIVNWRHSLYFPDDITLGVDAENLIRSLICNTENRLGRGGAHEIKSHAFFRGVEFDSLRRIRAPFEPRLTSAIDTTYFPTDEIDQTDNATLLKAQQAARGAAAPAQQEESPELSLPFIGYTFKRFDNNFR

SEQ ID NO: 9650 - protein, 178 aa, Sulfolobus solfataricus
MPLRPGRCYRHFSGPAYTRKEYIPGIPQPKITKFTSGNPNGDYDYEVRLITTEIGQIRHNALEAVRTLTLKTLSKKTGSETSFFMWILKYPHHVLRENKMMAFAGADRLQDGMRLSFGTPIGTAARIEKLGETLIVIKVKKEHLEFAKEALKIASKKLPLRTRIEIIPLRLVRQEVQS

SEQ ID NO: 9651 - protein, 381 aa, Candida albicans
MVAPALIYSNHELSTAIDSTHAFEGPEKLLEIWFYESKELSPINLRDIKFDTWIEILNLVHCEVLSKVSSNLCDAFLLSESSLFVFPHKIILKTCGTTTTLACLDLLFETVNKELLQNEGLKATFQSKNIYQIFYSRRSFMFPDRQIHVHGNWQEEVKLLNQYFNNGKSYIVGNNTNWHLYVGGNGKTKNPVASTTTTTTPVVNDCTLEIIMTQLSLEASQQFYTTRKPGDTAIDSNHDLGHDLGQEILKQTGLNELFKFKKQPTMPGLSSSPIKEIHDGFAFTPCGFSSNSINESDYYTIHVTPEPGWSYASFETNMIGDYKAIVDKCINVFQPGQFMVTFLTNTDMEKFECCLDDYKVNHREELDVEDYKLYFVEFVRQ

SEQ ID NO: 9652 - protein, 267 aa, Griffithsia japonica
HEAPTMSFLTFASPVMLHVAHPIKSIIPAINPATPRATAAEKSAPAKQVTSSDRLAQLPWTSTIAADDCPLFFMPFVTHQLDGLQTLSGLEDIPFEEKFSYQQSKKPSARIESWLFKSDIFRKIRLTYIDAGWKAQVFNSVWYPSPEYDLPVLGIDFLSFGKKKVLCVMDFQPLMQEESYLNKYCAPMEDVRNKYDGLSGKMSKRFYDEALFFSQQLIFAKFDNQEPIESQLLPAFKDYVNHYKQMITAATPDSSEDNVKRVLELHR

SEQ ID NO: 9653 - protein, 412 aa, Unknown
  Synechococcus sp. CC9605
MATTPLPSTGALSGLGETLAFFTQADFAQRRFETHGDVFETKLLAQRMVFIRGERAIGDMLGQGDALQGWWPESVRQLLGSRSLANRSGPGHKARRRVVGQLFSSAALARYTPSIEQLVAELCHELITTNTALPLAARMRRFAFAVIATTVLGLDGASRDALFADFEIWTRALFSIPLAIPGTPFAKAMAARQRLLKRIKGVLQAGTNQGGLDLLSGGLDEAGIPLDDDDLAEQLLLLLFAGYETTASSLSCLFRALLLNPEVESWLRDGLNKDPASPKLDATVMEVMRLTPPVGGFFRRSLAPIELAGVAVPEGSVIQVVLSPTSDGDDDDLASFRPQRHLDGSFKQTLLPFGGGERVCLGKALAELEIRLMAVGLLQAVELQLQPGQDLALQLIPSPTPKDGLLVQAAAR

SEQ ID NO: 9654 - protein, 280 aa, Streptomyces coelicolor
MANVVRAALVQATWTGDTESMVAKHEEHAREAARRGARVIGFQEVFNAPYFCQVQDPEHYRWAEPVPDGPTVRRMQALARETGMVIVVPVFEVEQSGFYYNTAAVIDADGTVLGTYRKHHIPQVKGFWEKFYFRPGNAGWPVFDTAVGKVGVYICYDRHFPEGWRQLGLGGAQLVYNPSATHRGLSAHLWRLEQPAAAVANEYFVAAINRVGVEEYGDNDFYGTSYFVDPRGQFVGDVASDSKEELVVRDLDFDLIDEVRQQWAFYRDRRPDAYEGLVRP

SEQ ID NO: 9655 - protein, 968 aa, Tropheryma whipplei
MHERHIGPSQEEIDHMLGFLGYKSLDDLMNAALPNGVQSPPDIKIPSHDELTCLTQLAAYAKMNRIKTSMLGQGFYNCITPAVIRRNILENPSWYTSYTPYQPEISQGRLEMLINFQTMICDLTGLEIANASMLDEASCAAEAMLLAKRVSRSSSNKYLVHNGVFPHIRRVLETRADAVGVEIVDLPEGQSIDFDHFGVYAQYQSASGKLLDLRHLFSRSKRAGAICVIGCDLLMLTLFTSPGELGADIAFGSAQRFGIPMNFGGPLASFLAARKAMERSLPGRLVGVSVDADSNHAYRLTLQTREQHIRREKATSNICTATVLMAIAAVAFAQHHGPKGLRAIAHRINTVAVGFARLLKQTAFRVSSLDIFDTIEINNPTQLCVEAESKHDLLFWKVDDNKLRITFDEVTARLDGDLPERLSKVFGISPDKIRDLGCNYDSCDCSFYSDSQQAREGLSSVASRNISVHSDLARHPLRRFSGYLKHPVFNNYTGEVALMRYLKALSDKDFALDRGMIPLGSCTMKLNAAFQLEPVLWPEFANLHPFAPRGDADGTLQIIDQIETWLANLSGYDAVSLQPTAGSQGELAGLLAIRGYYKSLNLDRDVCLIPASAHGTNAASAVLAGMRVVVVACDQQGNIDLDDLRLKASKNAHALAALMVTYPSTHGVYEDNISEVCSVVHKYGGQVYVDGANSNALIGYLRTGDFGGDVSHLNLHKTFGIPHGGGGPGIGPVVAKAHLAPFLPFRNRVHKPSTDLPAVKHMGGPIASSDYGFAGALYISWAYIFCLGSQGMKRCTAVAVLVANYIAKQLSDTFPVLYTGKNNLVAHEFIMDFREVTRVSGITVDDVCKRLIDYGFHAPTMSFPVPGTLMVEPTESEPFSEIQRFIKTIRSIRAEIDRVIDKTYDPDNNPLKRAPHTLEQIASDKWDRPYSRRTGIVYTSGKYWPASARIDNAYGDRNIFCTCPDLPD

SEQ ID NO: 9656 - protein, 200 aa, Oryza sativa
MEKMPWPATGPSSRWSGPRSDCQFATNSNSIWHVGPTTPVETQAHKSGSNFDPPTAAAAAISARRSGPTRQRDVLIAAGGLLLLILLVWINDFWGAEINWLAEMAVTRIGLAGLAVMGQNLALNIAEKGFPISVYNRTTSKVDETVQRAKVEGNLPVYGFHDPASFVNSIQKPRVVIMLVKAGAPVDQTIGNSCSTLGAG

SEQ ID NO: 9657 - protein, 438 aa, Unknown
  Polaromonas sp. JS666
MSQAPIPSASAAAGTHPLPSYLQADKLGPWGNYLQQVDRVIPHLGSLGRWAETLKRPKRILVVDVPINMDDGTIAHFEGYRVQHNVSRGPGKGGVRFHQDVTLSEVMALSAWMSIKNAAVNVPFGGAKGGIRVDPKTVSQGELERITRRYTSEIGIIIGPTKDIPAPDVNTNEQVMAWMMDTYSMNTGSTSTGVVTGKPVDLGGSLGRRDATGRGVFTVGVEAARHIDLDISTSRVAVQGFGNVGGVAGRLFHETGARIVAVQDHGGTIYREAGLDVPALIRHVAETGSVGGFPNAEVIANELFWEVDCDIMIPAALEEQINAANAGRIKARMIIEGANGPTTPEADDILQERNVLVLPDVIANAGGVTVSYFEWVQDFSSFFWDEAEINARLVRIMKEAFAGVWQVAQDHKVTLRTATFIVACKRILHTRQLRGLYP

SEQ ID NO: 9658 - protein, 446 aa, Oryza sativa
MAVTRIGLAGLAVMGQNLALNIAEKGFPISVYNRTTSKVDETVQGAKHTWSRVTVLLMEEMSGTRTLRGGRRQWRSVASSILGMVFPEEREGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVSPCHQQWRQHPRHVGESRVHVHEEAQGNVKEPPICEFCDGGLMATHSNEMVMARRPDQTKTMVGVRPLLPISPLAKG

SEQ ID NO: 9659 - protein, 714 aa, Unknown
  Synechocystis sp. PCC 6803
MDSPAILPTTRTLCPYCGVGCGLEAVASPQKSVVDAGHAHKIRGDRQHPSSQGMVCVKGATVMESMDKQRLLYPMFRSSLDQPWQQISWEAALEIVVDKIQQVKQTLGVSGLCMYASGQMQTEDYYVAQKLFKGCLGTNNFDTNSRLCMSSAVSAYSLSFGSDGPPCCYEDLEITDCAFLIGTNTADCHPIIFNRLRKHHKQNPHVKLIVVDPRCTATAEVADLHLAINPGSDITLLHGIAYLLKKWNLIDQKFIDNHTQDFEQYCQVIDHYPPEKVTQICGISLEQLETAAHYWGNAKTVLSLWSMGMNQSFQGTAKGRCLINLHLLTGQIGKPGSGPFSLTGQPNAMGGREAGGLSHLLPGYRSIKNPQHRQEVEQLWQISPGRINPEPGLSAWEMFMGLENQQVGFLWIVATNPVVSMPDLERVKKALQQSTFTIHQDAYSPTETAEYAHLLLPAAQWSEKTGTMTNSERRVTLSPAFRSPPGEARPDWEIFAEVGRRLGFENQFNFVDSAAVHREYVQLTAERLCDQSGVSYEKLQKLGPLQWPCRQSDQESQLLSTKRLYTDYKFCTENGRANFCLDHSRGLAEPVDPNYPFVLTNGRLYGHWHTQTRTGHIEKIKKMHPKPILEMHPKDAEKLGIKSQDLVAIKSRRGSAQLEVLVTRAIAPGTVFMPMHWGFLWDDNAEVNSLTHATACPISKQPELKACAVNITPV

SEQ ID NO: 9660 - protein, 177 aa, Oryza sativa
MSEEQGFTYCADYHAYRGKKRAASMAPKAEKKPAAKKPAEEEPAAEKAEKALAGKKPKAEKRLPAGKAEKSSGEGKKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 9661 - protein, 501 aa, Thermosynechococcus elongatus
MGAGLGTPSSLTLEAWTCLQQAQVVLYDALLSPSLLELTPADCLRVAVGKRAGAEAIPQLEINRLLVAYGQQYQRVVRLKSGDPGLFGRLHQELEAVLGAGLEAVVIAGVSSALAAPLLAGICVTAKDVSQSVAILSGHAPETLPWPAIARMETLIFLMATRSLRYIAEALLRQGRSPTEGLAILQWAGQPQQQFWFGTLESYLQSPQFPDMAPAVVVIGAIARKRYPLASLDLVFPEFLRISPSSMSALHGKTILVTRAAAQASDFTQQLTAAGATVLEMPTLEIVPPSSWQPLDQALAQLDTFDWLILTSHNAVTFFMKRLHSHGKDSRALAGLKIAVVGEKTAQTLNRYGLVADFTPREFVADALVVEFPEPVAGLRFLFPRVEKGGRPVLGEAFTAAGAEVVEVPAYNSRCPQTVDAPVLAALQAGQVDIVTFTSSKTVKHFCQLVGPQAAELLQNVQIASIGPQTSQTCRELLGRVDTEATEHTLEGLLQALLRIT

SEQ ID NO: 9662 - protein, 365 aa, Clostridium perfringens
MQPIKKIAILTGGGDCPGLNAVIRAVTRTAILKYGYEVIGYKFGYRGLYNNDFVKLDLDSVSGILHRGGTILHSSNKDNLFDYQVEDENGKIVKKDVSDVGVENLKKEEVDALVVIGGDGTLTSARDFARKGVNVIGVPKTIDNDLLATDVTFGFNTATEIATEALDRLHTTAESHHRIMLLEVMGRNAGWIALESGIAGSADVILLPEIPYDINKIVEKVKEREEAGKQFTIIVVAEGAKPKDGEVVVSKIVDDSPDPIRLGGIANKLAIDLEGLIKNHEIRSTVLGHIQRGGNTSTYDRILSTKYGVKAVELINSNLFGNMVALKGNKVSYESLENVIGHTKNVDPEGELVNTAKSIGISFAD

SEQ ID NO: 9663 - protein, 208 aa, Actinobacillus pleuropneumoniae
MGRKRSASSSRWLAEHFKDQFVQKAHKQKLRSRAYFKLDEIQQTDRLFKPGMTVVDLGAAPGGWSQYAVTQIGSKGRIIACDILDMNPIVGVDFLQGDFREESVLNALLERVGDDMVDVVMSDMAPNFSGMPSVDIPRAMYLVELALDMCRQVLAPKGSFVVKVFQGEGFDDYLRDIRAMFTTVKVRKPEASRDRSREVYIVATGYKG

SEQ ID NO: 9664 - protein, 274 aa, Oryza sativa
MGTMVGHVAPGAGFILIGMWQLFNHIRLFALRPSSYAAPVWFPVRGVRHLELILVIVGAAISILMELVIGPARHQPFDDDGTIPSNHLHNFEHASISLALLVYAAVTIHMDRARAPMRDAVSQLVAAAAFAQQLLIFHLHSADHMGVEGQFHWLLQTVIAVTLATTVLGIPCPRSFAVSLVRSASLVFQGVWFVVMGVMLWTPALIPKGCFLHLTKLYPEEPRYLPLVKGGGGGGDGDSDGGRFSIGDDEDDLEAAKGGFGHVAGGGNAVEIER

SEQ ID NO: 9665 - protein, 196 aa, Arabidopsis thaliana
MAASMTKPISITSLGFYSDRKNIAFSDCISICSGFRHSRPSCLDLVTKSPSNNSRVLPVVSAQISSDYIPDSKFYKVEAIVRPWRIQQVSSALLKIGIRGVTVSDVRGFGAQGGSTERHGGSEFSEDKFVAKVKMEIVVKKDQVESVINTIIEGARTGEIGDGKIFVLPVSDVIRVRTGERGEKAEKMTGDMLSPS

SEQ ID NO: 9666 - protein, 368 aa, Pseudomonas fluorescens
MTGAQRWVVKIGSALLTADGKGLDRTAMGVWVEQMVALHEAGVELVLVSSGAVAAGMSRLGWTARPSAMHELQAAAAIGQMGLVQAWESSFAEHGRHTAQILLTHDDLSDRKRYLNARSTLRALVELKVIPVINENDTVVTDEIRFGDNDTLAALVANLVEADLLVILTDRDGMFDADPRNNPDAQLIYEARADDPALDAVAGGTGGALGRGGMQTKLRAARLAARSGAHTIIVGGRLDRVLDRLKAGERIGTLLSPERGMLAARKQWLAGHLQTRGTLVLDEGAVSALSQGNKSLLPVGVKQVQGGFRRGEMVVCVAPDGREIARGLANYSALEAQKIIGQPSDAIVGVLGYMAEPELVHRDNLILV

SEQ ID NO: 9667 - protein, 862 aa, Lotus japonicus
MWSHHGFHLPQNCAAKEQIWGLVATVRHHRNHLFLLRSAVFHSIIFSFSYVVCNGNGSLTLEDSSWKSGNYRCSSKKYEQCTLSQGMTVHDGTFEAGFFHFENPQHHYFGVWYKSISPRTIVWVANRDAPLRNSTAPTLKVTHKGSILIRDGAKGVIWSTNTSRAKEQPFMQLLDSGNLVAKDGDKGENVIWESFNYPGDTFLAGMKIKSNLAIGPTSYLTSWRNSEDPASGEFSYHIDIRGFPQLVVTKGAAITLRAGPWTGNKFSGAFGQVLQKILTFFMQFTDQEISLEYETVNRSIITREVITPLGTIQRLLWSVRNQSWEIIATRPVDLCADYVFCGANSLCDTSKNPICDCLEGFMPQFQAKWNSLDWAGGCVSMEKLSCQNGDGFMKHTGVKLPDTSSSWFGKNMSLDECRTLCLQNCSCTAYAGLDNDVDRSVCLIWFGDILDMSKHPDPDQGQEIYIRVVASKLDRTRNKKSINTKKLAGSLVVIIAFVIFITILGLAISTCIQRKKNKRGDEGIINHWKDKRGDEDIDLATIFDFSTISSATNHFSLSNKLGEGGFGPVYKGLLANGQEIAVKRLSNTSGQGMEEFKNEIKLIARLQHRNLVKLFGCSVHQDENSHANKKMKILLDSTRSKLVDWNKRLQIIDGIARGLLYLHQDSRLRIIHRDLKTSNILLDDEMNPKISDFGLARIFIGDQVEARTKRVMGTYGYMPPEYAVHGSFSIKSDVFSFGVIVLEIISGKKVGRFYDPHHHLNLLSHAWRLWIEERPLELVDELLDDPVIPTEILRYIHVALLCVQRRPENRPDMLSIVLMLNGEKELPKPRLPAFYTGKHDPIWLGSPSRCSTSITISLLEAR

SEQ ID NO: 9668 - protein, 437 aa, Hypocrea jecorina
MMMLSKSLLSAATAASALAAVLQPVPRASSFVTISGTQFNIDGKVGYFAGTNCYWCSFLTNHADVDSTFSHISSSGLKVVRVWGFNDVNTQPSPGQIWFQKLSATGSTINTGADGLQTLDYVVQSAEQHNLKLIIPFVNNWSDYGGINAYVNAFGGNATTWYTNTAAQTQYRKYVQAVVSRYANSTAIFAWELGNEPRCNGCSTDVIVQWATSVSQYVKSLDSNHLVTLGDEGLGLSTGDGAYPYTYGEGTDFAKNVQIKSLDFGTFHLYPDSWGTNYTWGNGWIQTHAAACLAAGKPCVFEEYGAQQNPCTNEAPWQTTSLTTRGMGGDMFWQWGDTFANGAQSNSDPYTVWYNSSNWQCLVKNHVDAINGGTTTPPPVSSTTTTSSRTSSTPPPPGGSCSPLYGQCGGSGYTGPTCCAQGTCIYSNYWYSQCLNT

SEQ ID NO: 9669 - protein, 256 aa, Zea mays
MATTNSLQHHHHSSSSYHRHNLHPQSHVVPSSLSLKHPSSTATFSSLICSSSSSSVVSAALTTNASSVTAETSTEFDVLATHLTNQDFRKADEETRRLLIQIAGEAAVKRGYVFFSEVKSISVQDLQAIDNLWTKHSDGRFGYSVQRKLWLKVKKDFTRFFIKVEWMKLLDTEVVQYNYRAFPDEFQWELNDETPLGHLPLTNALRGTQLLKCVLSHPAFEIDGDDIEEAGEAENRGVGGKAKTKDTTVFKTDYSF

SEQ ID NO: 9670 - protein, 420 aa, Unknown
  Sphingomonas sp. KA1
MADIVIVGAGHGGAQCAIALRQAGFEGTVTIVGRECEPPYERPPLSKEYFAREKTFDRLYIRPPQFWEEKGVRLMLGIEVTAIDPASKQLTLSDGSSFGYGKLVWATGGDPRKLPVPGGSLSGVHGVRTREDCDTLMGEIDGGVKNICVIGGGYIGLEAAAVLTKMGCKVTLLEALPRVLARVAGPELSAFYEKEHRDHGVDLRTGATVEALEGEGRVTGVRLGDGSVLPADAVIVGIGIVPAVAPLIAAGAAGGNGVDVDEYCRTSLPDIYAIGDCAAFACDFADGKVMRIESVQNANDQATCVAKAICGDEKPYHAFPWFWSNQYDLRLQTAGLSVGYDQTVVRGSPDARAFSVVYLKGGKVIALDCVNMVKDYVQGRKLVEAGVSPNQQRLGDVSVALKELLPIQGDTHLRNGGAAV

SEQ ID NO: 9671 - protein, 440 aa, Pyrococcus abyssi
MRVVVIGSGTAGSNFALFLRKLDRKAEIIVIGKEPTMQYSPCALPHVISGTIEKPEDVIVFPNEFYEKQKIKMMLGVEAKKIDRERKVVITDKGEVPYDKLVLATGSKAFIPPIKGVENEGVFTLKSLDDVRRIKEYIGKRNPKKAVVIGAGLIGLEGAEAFAKLGMEVLVVELLEHLLPTMLDKDMASIVQKNMEEHGVKFRFGVGVSEIIGNPVEAVKIGDETVEADLVLVATGVRANVDLAKDAGLEVNRGIVVNEYLQTSDPDIYAIGDCAEVIDAVTGKRTLSQLGTSAVRMAKVAAEHIAGKDVKFRPVFNTAITELFDLEIGTFGMTEERAKREGIDVVVGKFRGSTKPEYYPGGKPITVKLIFRKEEGRLIGAQIVGGERVWGRIMTLSALAQMGAKVEDIAYLETAYAPPISPTIDPITVAADMALRKMKR

SEQ ID NO: 9672 - protein, 247 aa, Emericella nidulans
MPLPARTASLSRNTNETKIQVSLSLDGGVLPPYEPSSHFPVPTDPLEAEAAKKGIVPNKDAAHATQFTPTQQITISTGIGFLDHMLHALAKHSGWSLAIRAKGDLYIDDHHTTEDTFLALGTAFTTALGARQSLARFGRGDAPLDEALSWAVIDLSSRPWAVINIGFKREKIGDLSTEMITHGLQSFAQAAGVTLHIGCTYGDNDHHRAESAFKALAVAIRAACARRVEGEVGAGDVSGTKGPALIE

SEQ ID NO: 9673 - protein, 280 aa, Streptomyces coelicolor
MSRVIRAALFQTAWTGDKESMIQVHEQAVRDAAAQGAQVMCFQELFYGPYFCQVQDPEFYAYAERVPDGPIVERFQRLAREHGIVLVLPMYEEEQPGVLYNTAAVIDADGSYLGKYRKTHIPQVRGFWEKFYFRPGNSGWPVFDTAVGKVGVYICYDRHFPEGWRALGLEGAEIVFNPSATSRGLSGYLWQLEQPAAAVANEYFVGAINRVGVEELGDNDFYGTSYFVDPEARFVGEVASDKETELVVRDLDMARLREVRDRWQFYRDRAPGAYSPLTAP

SEQ ID NO: 9674 - protein, 461 aa, Glycine max
MNPNPNTNDFPLLSHLLNHLDPQTHPPLPAELDQSLLTQFPHLNHPSVLSSLARHASTLNVTPTLSLLRTLGPRPDPSAVAAARARIADPHAREDGGEAHVVHALVRVDDTHEECVKQLRASEKKLLEAYAESVKGVVEEVSEGVVRVLKKAESEEVERVDLSGSHLRILPEAFGKIRGLVVLNLSQNQLEVIPDSIAGLQRLVELDVSSNVLESLPDSIGLLVNLKIFNVSANKLTALPESIALCRSLVELDASFNNLMCLPTNMGFGLVNLEKLLIHLNKIRFLPASIGEMKSLRHLDVHFNELHGLPQSIGKLTNLEYLNVSSNFSDMTELPETLGDLVNLRELDLSNNQIRALPYSFGRLEKLTKLNLDQNPIIVPPIEVVNQGAEAVKEFMAKWWLDLIEEAQQKSMSETQNQQAQTGWLAWGASLLNNVAEVSESVAEYFGAKKAPRDPWLDQQL

SEQ ID NO: 9675 - protein, 517 aa, Staphylococcus aureus
MSEEKHVVEHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAILAGSDLLGTNHALSLAFSGYATSAVALVAAALFLAAAMQETNLHKRLALLVLSIVGNKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSVALYFIMIKVMPPEINTIEGGKDLIKEELHKLGPVSPREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKAGIPLTIVGYILVIVFSMTYWKWLGLL

SEQ ID NO: 9676 - protein, 330 aa, Cordyceps bassiana
MSPPAALSPPQHAAVPVSKVSDGNGHAVAKPGFPDTSGVAIDDMLGQWDKFQFAPIRESQVSRAMTRRYFQDLDTYAESDIVIIGAGSCGLSAAYVLGKKRPDLKIAIIEASVSPGGGAWLGGQLFSAMVMRKPADVFLREVGVPYEDEGAYVVVRHAALFTSTIMSKVLQMPNIKLFNATCVEDLITRAGRDGDEGVRIAGVVTNRTLVSMHHDDQSCMDPNTINAPLIISTTGHDGLMGAFCVKRLVSMQRIEKLGGMRGLDMNTAEDAIVKGTREIVPGLIVGGMELSEVDGANRMGPTFGAMALSGLKAAEEALKVFDIRKKENEL

SEQ ID NO: 9677 - protein, 704 aa, Xanthomonas campestris
MAKITKTFQYGKHTVTLETGEVARQASGAVIVKMDDTVLLVTAVAAKTAREGQDFFPLTVDYQEKFYAGGRIPGGFFKREGRATEKETLISRLIDRPIRPLFPEDYKNEVQIIATVMSMNPDIDGDIAALIGASAALSLAGTPFNGPIGAAKVGYKNGEYILNPTITELKDSQLELVVAGTANAVLMVESEAALLSEEVMLGAVTFGHREMQKVINIINELTVEAGTKPSTWVAPAKNTALISALKEAVGTQLAGAFQVRDKLQRRDAISAIKKDVLESLAGRVASEGWSSAELSKEFGELEYHTMRDSVLETKVRIDGRALDTVRPISVQAGVLPRTHGSALFTRGETQAIVVTTLGTARDGQVIDAVAGEYKENFLFHYNFPPYSVGECGRFGAPKRREIGHGRLAKRGVLAVMPSLEEFPYTIRVVSEITESNGSSSMASVCGSSLALMDAGVPVKAPVAGIAMGLVKEDDRFVVLSDILGDEDHLGDMDFKVAGTAEGVSALQMDIKIEGITEEIMKQALQQAKAGRLHILGEMSKALTTPRQELSDYAPRLLTIKIHPDKIREVIGKGGSTIQAITKETGTQIDIQDDGTIIIASVNAIAAQAAKSRIEQITSDVEPGRIYEGKVAKIMDFGAFVTILPGKDGLVHVSQISSERVEKVGDKLKEGDLVRVKVLEVDKQGRIRLSIKAVEEGEGVPASAE

SEQ ID NO: 9678 - protein, 368 aa, Camellia sinensis
MAPTTTLTALAEEKSLQQKFVRDEDERPKVAYNVFSNEIPVISLAGIDEIEGRRSEICRKIVEACEGWGVFQVVDHGVDANLIAEMTRLAREFFALPPEEKLRFDMSGGKKGGFIVSSHLQGEAVQDWREIVTYFSYPIRARDYSRWPDKPEGWRAVTETYSEKLMDLACKLLEVLSEAMGLEKEALTKACVDMDQKVVINFYPKCPQPDLTLGLKRHTDPGTITLLLQDQVGGLQATRDGGKTWITVQPVEGAFVVNLGDHGHYLSNGRFKNADHQAVVNSNCSRLSIATFQNPAPEATVYPLKIREGEKPILEEPITFADMYKRKMSKDIELAKLKKLAKEKKLLQDQQDIEKAKLEIKSTDEIFA

SEQ ID NO: 9679 - protein, 372 aa, Herminiimonas arsenicoxydans
MDSAIQSAKRIIIKVGSSLVTNDGKGLDTAAIQKWAEQIVQLRALGKEVVLVSSGAIAEGMQRLGFDKRPTGVHELQACAAVGQMGLAQIYETSFRQHQVQTAQILLTHADLADRERYLNARSTLFTLLQLGVVPIINENDTVVTDEIKFGDNDTLGALVANLIEADALIILTDQRGLFSADPRKDPHATFIHEAQAGDVELEAMAGGAGSSLGRGGMLTKILAAKRAALSGAHTVIAWGREEQVLTRLAAGEAIGTQLTAQTAQLTARKQWMADHLHTAGRIVLDQGAVLKLTAEGKSLLPIGVIEVSGSFGRGDVITCVDQSGRAIARGITNYTSSEARRIMRKPSTDILSILGFVEEPELIHRDNLVLL

SEQ ID NO: 9680 - protein, 656 aa, Burkholderia thailandensis
MCGISGFVGPVACAPETARATLARMTDSLAHRGPDDTGLWIDPDAGVALGHRRLSIVDLSEHGHQPMPSACGRYAMTFNGEIYNFRELRRELEREHRAPEWRGHSDSEVLLAAFSAWGIDRALQKAVGMFALALWNRESRVLTLARDRIGEKPLYYGRIGGSFVFGSELKALRRFPGFGAHPIDRNALCLYLRHASVPAPYTIYEGIRKLPPGTYVQHEGLGDEPAPRRYWSLDRVIAAGRANPFDGDANAAVAQLDHVLRDAIAEQSVADVPLGAFLSGGVDSSVIVALMQTQTAQPVQTFTIGFHEAGYDEAGYAKAVARHLGTSHTELYVKPSDVLATVPRMPSVYDEPFADSSQIPTLLVSELTRRHVKVSLSGDGGDELFGGYTRYFLTPRLWGRLRRVPAAVRMRIAAALHALRPDHADQIAALVQGAWSAAAQRDASPRVGDRLHKLANVMTADSRASLYRLLMSSVHHPERFTLAGHEPQTLIDTPGAWPAGLSFAEQAMAVDTLTYLPTDILTKVDRAAMAVSLETRMPFLDHRVVEFAWRLPEALRIPDGQDKWLLRKLLYRYVPRPLIDRPKQGFCAPVGAWLRGELSDWAAELLRPARLRDEGYLDATRVERLWRQHQSGRMNWQHPLWTVLMFQAWLERQRAE

SEQ ID NO: 9681 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVIAGDIMSYHLEEYDILHQRSLFNEARIAVTLIRGNHYFKASKTMNQQGEPYKVFTSFYRKWRPYLRHRDVYHYDLKSFEDFVIASPDDLVFDDIAFGSSQVIEQNKWQHFLDQDIQNYESGRDYLPEVLTSQLSVALAYGLLDIIEIFNDLLARYDEDEANHEAFIRELIFREFYYVLMTQYPETSYQAFKPKYRQIKWSQNEANFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQMVDHQEKRTQVLATFKALD

SEQ ID NO: 9682 - protein, 447 aa, Klebsiella aerogenes
MDQTCTLEGFLTRVQQRDPHQTEFAQAVREVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTELYRHLGPDTDVPAGDIGVGGREVGFMAGMMRKLSNNSACVFTGKGLSFGGSLIRPEATGYGLIYFTEAMLKRHGLGFEGARVAVSGSGNVAQYAIEKAMELGARVVTASDSNGTVVDEAGFTKKKLARLIDIKERAHGRVADYAREFGLTYLEGQQPWSVPVDIALPCATQNELDVDAARQLIANGVKAVAEGANMPTTIAATDLFLEAGVLFAPGKAANAGGVATSGLEMAQNAARMGWKAEKVDARLHHIMLDIHHACVQYGGEAKQTNYVRGANIAGFVKVADAMLAQGVI

SEQ ID NO: 9683 - protein, 473 aa, Debaryomyces hansenii
MLNLKLQTAVDDIVNQFTVTEEFLHDATKEFTKSMDTGLQNTASKREYMPMIPTYVTGIPTGKEKGLFLAADLGGTNFRVCSVNLHGDHTHELKQSKYSIPLDLMKNSTADSLFSFLAKKVETFLKDNHDDLEADEQLKLGFTFSFPINQTALNRGTLIRWTKGFDLPDCVDKDVVELLQSNIDLLGCKVNVVALANDTVGTLLSRAYSNNPEKTNANTIVGAIFGTGTNGAYFETLDNIPKLKSTNIPEGAKGMVINTEWGSFDNTLKILPKTKYDEIVDSETANKGFHLFEKRISGMFMGEILRVCLIDLFQRDLIFVDLYKSRGGSLPHRLSEEWLLSSEVLSYLQIDDSTDLKMSELILENELRLPTTKEERIVIQKLTQAIAHRAAYLSAIPVAAILNRVKGQFSNDNRDFEFGCDGSVVEFYPGFQASILEALEIINPLEGEKKKVHLKIAKDGSGVGAALCASTAK

SEQ ID NO: 9684 - protein, 1137 aa, Puccinellia tenuiflora
MEEAGSSPDDAVLLFGVSLVLGIGSRHLLRGTRVPYTVALLVLGVALGSLEYGTKHGLGKLGAGIRIWAAINPDLLLAVFLPALLFESSFSMEVHQIKKCMAQMVLLAIPGVVLSTVLLGSAVKLTFPYNWSWKTSFLFGGLLSATDPVAVVALLKDLGASKKLSTIIEGESLMNDGTAIVVCQLFYRMVLGTTFDAGSIIKFLTQVSLGAVALGLAFGIASVLWLGFIFNDTIIEISLTLAVSYIAFFTAQDAFEASGVLAVMTLGMFYAAFAKTAFKGDSQESLHHFWEMVAYIANTLIFILSGVVIADGVLQDNIHFERHGASWGFPLLLYVFVLTGRAVVVTVLYPLLRHFGYGMDVKEATVLVWSGLRGAVALSLSLSVKRASDADQPNLKSEVGTMFVFFTGGIVFLTLIVNGSTTQFLLHLLGLGKLSATKLRVLKYTRYEMLNKAKEAFGDLRDDEELGPADWITVKKYITCLNNLEDEQAHPHDAPDKDESVHTMNLRDTRVRLLNGVQAAYWGMLEEGRITQATANILMRSVDEAMDLVSTQSLCDWKGLRSNVHLPKYYRFLQMSRLPRRVVTYFTVERLELGCYICAAFLRAHRIARRQLHDFLGDSEIARIVIDESTAAGEEAKKFLEDVRLTFPQVLLALKTRQVTYAVLTHLSEYIQDLGKTGLLEEKEMVHLDDALQTDLRKLKRNPPLVKMPRASEILNTHPLVGALPAAVRDPLLSNTEETIKVHGTILYSEGSRPTGIWLVSTGIVKWTSQRLSTRHSLDPILSHGSTLGLYEALVGKPYICDIITESVVHCFFIEAETIEQLRQSDPSIEDFLWQESALVIARIFLPQIFEKMAMREMRVLISERSTMNIYIKGEDIELGPNYVCILLEGFLQMNQTLITPPAVLLPSNTDLNVFGLQSSAMNHIDYCYTAPSYQVTARARAILFDIRRPEAESDLQRSASLLSPNLGPPRTQSKEHIGLLRWPQSFHHRSRGPGNPSLAEIGKQPGSFSASALQVSMYGTMMDDEMHTAQPRPRPDRVEANQKHSASYPKVPSRSLSNTRPLLSVRSEGSNMMKRKSAPAPAHAPALDPFPPLAGGRHHRAITEGDLSSDESAGEEVIVRVDSPSMLAFQPRPQGN

SEQ ID NO: 9685 - protein, 64 aa, Arabidopsis thaliana
MGIRVYDDEEEWFQSIFSNSNKEDAIQNQYEFFVQRMGGPPLYSQRKGLPFYLKFRFFSLSYVF

SEQ ID NO: 9686 - protein, 470 aa, Debaryomyces hansenii
MPYALSESHKQLVEGHLKDIDPEVDQIIKDEVDRQKHSIVLIASENFTSTAVFDALGTPMCNKYSEGYPGARYYGGNEQIDKMEILCQERALKTFNATSDKWGVNVQTLSGSPANLQVYQALMKPHERLMGLDLPHGGHLSHGYQTDSRKISAVSTYFETMPYRVNLDTGLIDYDMLEKTAVLFRPKILVAGTSAYCRLIDYKKMREIADKVGAYLVVDMAHISGLVAAGVIPSPFEYADVVTTTTHKSLRGPRGAMIFFRRGVRSINPKTGQEILYDLENPINFSVFPGHQGGPHNHTIAALATALKQAATPEFKQYQEQVLKNSKVLEEEFTKKGYTLVSNGTDSHMVLVSLKDKQIDGARVETICEKINIALNKNSIPGDKSALVPGGVRIGAPAMTTRGLGEEDFKKIVSYIDFAVNYAKEIQANLPKDANKLKDFKNKVLNTEDEKLQAAKKEISQWAGEFPLSV

SEQ ID NO: 9687 - protein, 248 aa, Thiomicrospira crunogena
MEKIMAKVTMRQMLEAGVHFGHQTRYWNPKMGEYIFGARNKIHIVNLEKTLPMFNDALNFLGGIAAKKGTVLFVGTKRAAGDLVAQEAKRCGMPYVNHRWLGGMLTNFKTIKQSIKNLKDLEVQEQDGTFEKITKKEALMRSRQKAKLELSLGGIKDMRAMPDAIFIIDTGNEKIAIQEAKNLGIPVVGVVDTNNDPNGVDYVIPGNDDAVRAVSLYLSAAADAINEGKGSITTAVEGDEFVEEKAEA

SEQ ID NO: 9688 - protein, 1088 aa, Burkholderia pseudomallei
MKRMLFNATQQEELRVAIVDGQKLIDIDIETAGREQRKGNIYKGVVTRIEPSLEACFVNYGEDRHGFLPFKEVARQYFKEGVDMRSARIQDALREGQELIVQVEKEERGNKGAALTTFISLAGRYLVLMPNNPRGGGVSRRIEGDERQELRETMAQLQIPDGMSMIARTAGIGRSAEELQWDLNYLLQLWRAIEAASQSGHPGQPMLIYLESSLVIRAIRDYFQPDIGEILIDTTEIHDQARAFMDIVMPDNVGKVKRYHDDVPLFSRFQIEHQIETAYSRTVPLPSGGAIVIDHTEALVAIDVNSARATKGADIEETATRTNLEAADEVARQLRLRDLGGLIVIDFIDMESAKSQREVEQRLKDALKHDRARVQMGKISRFGLMELSRQRLRPALSEGSHVTCPRCNGTGHIRDTESSALQVLRIIQEEAMKENTAAIHCQVPVEVTAFLLNEKRQEINKIESRFKVGVVLIPNKHLDTPHYKLERLRHDDARLDDPRASWKMAEEAARELEAETGYSKRAEETKPRQEAAVKGITPERPAPSPAPQRQSAPEAAAPVAAAPASGGGFMKWLKGLFGAQPAAVPAPAPAAQETAARPARERAERGERGEKAERGERGGDRNRHRRGGAAQQAGGRDQAAAGGGRAQAPRAEREGKETREPREGREARGGRDNREGREARETREAREPREQREPREAREQREARERAETVDAAEAPRGERRERGERRKPAPHVATLETVNRGESAHAETAEKPLYAPGAEAGVDADSNARDGEERRRRRRGRRGGRREREDEVAGAVQAAEGSEGVTAEAEALEHAEHAQQRVAPVANQAPEHAAQAGAGVAAAAAATVAAEAIAHVESGAKVEPQPAAEASAGDTEQAEAVPARSIEAPAQAASTGQAEAVQAAPAAPAHVTPATADVAREPAAPAETASAETTPAEIPPAEAAPAEAPAAEASEVAASAVASAPAPAAEPAPAAEPHRPAPVSAAPASAAPAEADAAREPAAVAEPHVPAAAATPTPASVATTPGASLDTALAAAGLVWVNTDTDKLRAAQAAAAQIVQPVRVPRERKPLPPVDATPMQQVETTHR

SEQ ID NO: 9689 - protein, 133 aa, Prochlorococcus marinus
MRMLHTMLRVGDLDRSLRFYTEVLGMHLLRRKDYPSGRFTLAFVGYGKESDTTVLELTHNWDQDHYELGEGYGHIALGVEDIQSTCLAISKRGGRVVREPGPMQHGSTVIAFVEDPDGYKVELIQLASREAAS

SEQ ID NO: 9690 - protein, 604 aa, Magnaporthe grisea
MHFQLSASAWLLLLLGEATGLRSLQHVGKRDPVWIQSAPLQKYEVSIDSTEDVNTTATETHAVVRRAQPLFLTDKTRKFSVDGNGIPEVKFDVGESYAGQLPISNNSTDENKMFFWFFPSQNPLAKKEIMIWLNGGPGCSSMAGLMQENGPFLWQSGTFRPVKNPFSWTELTNVVWIEQPVGTGFATGKPNATNEEDVARQFLGFWRNFVDTFALQGYKVYITGESYAGAYCPYIADAMIKANDTQYFNMTGMLIYDPVIGEDSMQEEVPVMGLINAWPGLFPFNETFRADLQARDAKCGLTEFMTNGLSYPPKGPLSSVSPVEKDEKCVNIFDDVYKAAFEINPCFNIYEITQSCPLLWDVLGFPTSLDYVPEGATIYFNRTDVKRAIHAPENVNWEVCKDGIFKNGTDRSPPSSRAALPNVIDHTQNVIIGHGALDMVLIANGTLLSIQNMTWGGKLGFQSRPSAPFFVPRHRRDFKSKQGLGTLTGSGVMGFTHTERGLTYVGVEMSGHMVPQYQPAAAFRHVEVLLGRVANLSSTQPFTTQMNYTQPKPSELGGPPATANSPVGGGSGRGSPKSESPRLSSPSTLLPLAILVPLGFALVS

SEQ ID NO: 9691 - protein, 232 aa, Zea mays
MSEAAVRVIGLWPSPFVIRVLIALKLKGVEFEFVEEVVGRKSELLLRSNPVHKKIPVLLHHGKPISESLIVVQYIDEVWSSGAPAFLPVDAHARAVQRFWAQYVDDKLPWAIRILKGTDDGGMEQAAGQLSAALQLLEEAFAQLSQGKRYFGGDSVGYLDIALVSHVGWVKAVEKIAGVTLLDKAKVPNLVAWADRLCAHPAVVDAIPDADKFVEFSVTYGSFSKPINAPAK

SEQ ID NO: 9692 - protein, 326 aa, Unknown
  delta proteobacterium MLMS-1
MATGKILIVDDSPESVVLLRRMLEGGGYREIYDADGAAAAFAFFGLDDQGGGTPAPDVDCDLILLDIVMPGMDGIEVCRRLKKIPGLSEIPVIMVTADNTDSNLRAVFDLGAVDYIHKPVKQVELCARVKSALRLKDEMDRRATLAWELEEANQRLRQMAMVDGLTGIANRRRCDEFLEREWRRCRRDALPVAVCLVDIDFFKLYNDLYGHLRGDEVLKQVATLFQKAVNRPGDLLARFGGEEFVFILSGTDAQGAEKVARLAIAELQQAAIDHPHSPAGEHLTVCFGIAASKPALDTHPRLLLDQADKALYEAKQTRGNRIVVAA

SEQ ID NO: 9693 - protein, 153 aa, Oryza sativa
MAPKAEKKPAAKKPAEEEPAAEKAEKAPAGKKPKAEKRLPAGKGEKGSGEGKKAGRKKGKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 9694 - protein, 259 aa, Lactuca sativa
  misc_feature (64)..(64): Xaa can be any naturally occurring amino acid
MFLLRTTTATTTPASLPLPLLSISSHLSLSKPSSFPVTSTKPLFTLRHSSSTPKIMSWLGRLGXGTRTPADASMDQSSIAQGPDDDIPAPGQQFAQFGAGCFWGVELAFQRVPGVSKTEVGYTQGFLHNPTYNDICSGTTNHSEVVRVQYDPKACSFDSLLDCFWERHDPTTLNRQGNDVGTQYRSGIYFYTPEQEKAAIEAKERHQKKLNRTVVTEILPAKKFYRAEEYHQQYLAKGGRFGFRQSTEKGCNDPIRCYG

SEQ ID NO: 9695 - protein, 185 aa, Nocardia farcinica
MYGDDIASVLITEEQIAAKTKELAELIAKRYPAGAPEGDLLLVGVLKGAIFFMTDLAKALPIPTQMEFMAVSSYGSSTSSSGVVRIMKDLDKDIAGRNVLIVEDIIDSGLTLSWLKRNLSTRNPASLEVVTLLRKPDALRTQVEVAHVGFDIPNEFVVGYGLDYAERYRDLPYIGTLDPKVYGGA

SEQ ID NO: 9696 - protein, 311 aa, Symbiobacterium thermophilum
MARIYDSIADTIGRTPLVRLNRVTEGAVATVLAKVEAFNPASSVKDRIGYAMIKDAEEKGILKPGMTIVEPTSGNTGIALAFVAAAKGYRCILTMPDTMSLERRKLLKAFGAELVLTPGAEGMKGAIAKAKEILENTPGAWMPQQFENPANPEIHRKTTAEEIWQDTDGQVDIVVGGVGTGGTLTGVGEVIKARKPDFKVVAVEPAESPVISGGKPGPHKIQGIGAGFIPKNLNTEVVDEVITVASEDAIATARRMAREEGLLVGISSGAAAFAALQVARRPENAGKTIVVVLPDTGERYLSSALWADIQV

SEQ ID NO: 9697 - protein, 153 aa, Oryza sativa
MAPKAEKKPAAKKPAEEEPAAEKAEKAPAGKKPKAEKRLPAGKGEKGSGEGKKAGRKKGKKSVETYKIYIFKVLKQVHPDIGISSKAMSIMNSFINDIFEKLAAEAAKLARYNKKPTITSREIQTAVRLVLPGELAKHAVSEGTKAVTKFTSS

SEQ ID NO: 9698 - protein, 1001 aa, Glycine max
ERGSSTTAKQNQRDMRSCVCYTLLLFIFFIWLRVATCSSFTDMESLLKLKDSMKGDKAKDDALHDWKFFPSLSAHCFFSGVKCDRELRVVAINVSFVPLFGHLPPEIGQLDKLENLTVSQNNLTGVLPKELAALTSLKHLNISHNVFSGHFPGQIILPMTKLEVLDVYDNNFTGPLPVELVKLEKLKYLKLDGNYFSGSIPESYSEFKSLEFLSLSTNSLSGKIPKSLSKLKTLRYLKLGYNNAYEGGIPPEFGSMKSLRYLDLSSCNLSGEIPPSLANLTNLDTLFLQINNLTGTIPSELSAMVSLMSLDLSINDLTGEIPMSFSQLRNLTLMNFFQNNLRGSVPSFVGELPNLETLQLWDNNFSFVLPPNLGQNGKLKFFDVIKNHFTGLIPRDLCKSGRLQTIMITDNFFRGPIPNEIGNCKSLTKIRASNNYLNGVVPSGIFKLPSVTIIELANNRFNGELPPEISGESLGILTLSNNLFSGKIPPALKNLRALQTLSLDANEFVGEIPGEVFDLPMLTVVNISGNNLTGPIPTTLTRCVSLTAVDLSRNMLEGKIPKGIKNLTDLSIFNVSINQISGPVPEEIRFMLSLTTLDLSNNNFIGKVPTGGQFAVFSEKSFAGNPNLCTSHSCPNSSLYPDDALKKRRGPWSLKSTRVIVIVIALGTAALLVAVTVYMMRRRKMNLAKTWKLTAFQRLNFKAEDVVECLKEENIIGKGGAGIVYRGSMPNGTDVAIKRLVGAGSGRNDYGFKAEIETLGKIRHRNIMRLLGYVSNKETNLLLYEYMPNGSLGEWLHGAKGGHLKWEMRYKIAVEAAKGLCYLHHDCSPLIIHRDVKSNNILLDGDLEAHVADFGLAKFLYDPGASQSMSSIAGSYGYIAPEYAYTLKVDEKSDVYSFGVVLLELIIGRKPVGEFGDGVDIVGWVNKTRLELAQPSDAALVLAVVDPRLSGYPLTSVIYMFNIAMMCVKEMGPARPTMREVVHMLSEPPHSATHTHNLINL

SEQ ID NO: 9699 - protein, 383 aa, Mycoplasma pulmonis
MLKCLTMNKKEDYYKILGIDKSANEKEIKKAYRKLAMEHHPDRSSSKESEAKMREINEAYEVLSNPEKKAIYDKYGHEAANNPGFNGFNAGSAGFGNFGGFSNFGGFDSIFEEFFGGSRSHSKQNSNYPYPGESYSTQVKISFLDSVHGRVISQKLDKYKDCESCNGTGARSKSDIKTCSTCNGRGSVEKLVNSLFGKIKQSVTCSTCNGLGQEITHKCPSCKGAKKIKESISQKISIPAGVISGQEVLLRGFGGPGFNGGPNGDLYIRVYVTEHPYYQRINDDIYVDFPISIVNLILEKPVVVPTPYGDEKIKIKSTFKNDQIITFKGKGFKRKNRVGDLKIRLKFEIPNFSSKVKKNLESLLSETNDSINEDFVKKVNSIK

SEQ ID NO: 9700 - protein, 331 aa, Aspergillus nidulans
MIVRQLYARQSRQLLALNRQGYIPRRFSSTGTETPTPVETIVHRSIPEPGTRQSSAALTNNPAAKALAQEAEQRHKFQQLGTSVTNVYKPENLIRHPPFPSDITLELLLANQTHLGHSTSRWNPQNSRYIFGIREGIHIISLDITAAYLRRAAKVVEEVAARGGLILFAGTRPGQKRIVVRAAELSKGYHIFERWIPGSLTNGEQILGHCEKKVVNVLDEELPDLKESLADHAILKPDLVICLNPLENEPLLHECGLNNVPTIGIIDTDADPTRVTYPIPANDDSLRSVAVIAGVLGRAGQAGQKRRLEQAKKDLERKALHGDADIVWSLY

SEQ ID NO: 9701 - protein, 75 aa, Unknown
  Fragaria x ananassa
VLIHNGKPVCESVIALQYIDEVWTNKPLLPSDPYLRSQARFWADFVDKKIYDFGRKTWTTKGDEQEAAKKEFIDC

SEQ ID NO: 9702 - protein, 187 aa, Psychrobacter arcticus
MTQISNQEIEKTLRNSECLISSIEVAAAYERLAAQLNLHYAGLNPIVMVVMNGGLIPAGQLLTHLTFYHRMHYIHASRYRDNEGTNELDWKFKPDVSIAGEYVLLIDDIFDEGITLKSIVEELSKENPLSIESCVLLNKEHDRKVVDFDVDFVGINVADRYVYGCGMDFHGYLRHLPGIYAIKEDKI

SEQ ID NO: 9703 - protein, 209 aa, Pseudoalteromonas tunicata
MTKKKHSASSKRWLMEHFDDHYVLEAQKRGLRSRAMFKLEELQTKDKLIKDGMTVVDLGAAPGSWSQYVAELTGFKGKVIACDILPMDPLAGVEFLQGDFREESVLNALLERIDGKNVDVVLSDMAPNMSGHLSVDQAGSMYLVELALDMCHQVLKKNGSFAVKVFQGEGFEQYVQDVRSCFTTVKIRKPDSSRARSREVYLVATGYKL

SEQ ID NO: 9704 - protein, 355 aa, Streptococcus thermophilus
MLATDFGLENLTGYFYQYRIKRGDQSIIVLDPYAKSLAAWNSDDASKGPEHKIAKAAFVDLANYGPKDLDYAKIPNFKSREDAIIYEAHVRDLTSDKAISAELKHQFGTFAAFAERLDYLKDLGVIHIQLFPVLSYYFVNEMQNGKRLDAHASSNSNYNWGYDPQNYFSLTGMYFEKPSDPDKRIEEFKNLVSAIHAHGMDVILDIFYNHTAKTAIFEDLEPNYYHFMDADGTPRSSFGGGRLGTTHYMSRRVLVDSIAYLTKEYKVDGFRFDTMGDHDAESIEKAYLAARALNPNLIMLGEGWVTYAGDENSPVQPADQSWMKNTDTVAVFSDDIRNILKSGYPNEGDTCLHRR

SEQ ID NO: 9705 - protein, 525 aa, Bacillus cereus
MTTFRELGLSDSLLQSVESMGFEEATPIQAETIPHALQGKDIIGQAQTGTGKTAAFGLPLLDKVDTHKESVQGIVIAPTRELAIQVGEELYKIGKHKRVRILPIYGGQDINRQIRALKKHPHIIVGTPGRILDHINRKTLRLQNVETVVLDEADEMLNMGFIEDIEAILTDVPETHQTLLFSATMPDPIRRIAERFMTEPQHIKVKAKEVTMPNIQQFYLEVQEKKKFDVLTRLLDIQSPELAIVFGRTKRRVDELSEALNLRGYAAEGIHGDLTQAKRMSVLRKFKEGSIEVLVATDVAARGLDISGVTHVYNFDIPQDPESYVHRIGRTGRAGKKGIAMLFVTPRESGQLKNIERTTKRKMDRMDAPTLDEALEGQQRLIAEKLQNTIENENLAYYKRIAEEMLEENDSVTVVAAALKMMTKEPDTTPIALTSEPPVVARGGGSKKRGGNGGGYRDGNRNRSRDGRGGDGRNRDRNRDGRNRDGNRDRNRDGGNRGRRGEGQGRPGSSNGRGERKHHSRKPQA

SEQ ID NO: 9706 - protein, 159 aa, Prochlorococcus marinus
MKVSVTETSVQTSTGTIKKLGEYSGKVLLIVNVASYCGNTPQYSGLQELQNKFKDKGFAVLGFPCNDFGNQEPGTLDEIKEFCSVKFGADFEIFNKVHAKGFTTEPYTTLNKADPAGDVSWNFEKFLIGKDGSVVGRYEPSVQPLSEALISAIQLALDS

SEQ ID NO: 9707 - protein, 468 aa, Pseudomonas fluorescens
MRIELIKSRANLFLTTINLPRLPMIESVEDFLARLKKRDPDQPEFHQAVEEVLRSLWPFLEANPHYLSSGILERICEPERAVVFRVSWVDDQGKVRVNRGFRIQMNSAIGPYKGGLRFHPSVNMGVLKFLAFEQTFKNSLTSLPMGGGKGGSDFNPKGKSDAEVMRFCQAFMSELYRHIGADVDVPAGDIGVGAREIGFLFGQYKRLSNQFTSVLTGKGISYGGSLIRPEATGFGCVYFAEEMLKRRGDRVEGKRVAISGSGNVAQYAARKVMDLGGKVISLSDSEGTLYCESGLSEEQWLAVLELKNVQRGRISELASQFGLEFRAGQTPWDLPCDIALPCATQNELDAEAARTLLRNGCTCVAEGANMPTTLEAVDIFIDAGILFAPGKASNAGGVAVSGLEMSQNAMRLLWTAGEVDSKLHNIMQSIHHACVHYGEENGRINYVKGANIAGFVKVADAMLAQGVV

SEQ ID NO: 9708 - protein, 519 aa, Oryza sativa; identical to SEQ ID NO: 458

SEQ ID NO: 9709 - protein, 355 aa, Burkholderia thailandensis
MTSSDQTNPGADPVRAYLDRGIRNYWYPVAPSWQVSSAPVGITRLSEQIVLWRDREGNVHALEDRCPHRGARLSLGWNLGDRVACWYHGVEVNGGGTVTKVPAVSNCPLEGQACVRSYPVEERAGAIFLWFGDDAHREPAPLVLPDELVAPGYAQFVCVSNWTCNYQYAIDNVMDPMHGAYLHATSHSMAEGDKQADMRVRKTETGLMFEKVNQRDVNFDWVELGETGCLWLRLAIPYQRKFGPGGSFGIVGFATPIDDDHCQVYFWRTRKVAGWQRDVWRFLYRNRLEGLHWAVLEQDRYVLESMAPNARDHEYLYQHDVGITRVRRMLRQRAQEHLAALDAHRAAQADAAERA

SEQ ID NO: 9710 - protein, 413 aa, Unknown
  Thauera sp. DNT-1
MIKSIVIVGAGLAGTTAARALRARGYAGRIHLIGNESQLPYDRPSLSKGVLGGAQEIPPLLMEAAWFESEGIELHLGDPVFAINAKERLVTLHSGLSLDFDRLLFATGMRPRKLSIPGGNLEGVFSLRNFADCAALRQAFTAAKSLVIIGGGLIGCEVATSARKAGLEVTILECADELLTRVLGRQIGAWCREQLEAMGVRIELNAHISHLSGERSVRSLVFADGREVEAELVLVSIGGDPEDTLLNAAGVACNQGVVVDACGQTSSPDIYAAGDVAVWPLRHGGRRALETYINSQQQAEAAVAAMLGEYNPVPQVATSWTEIAGHRIQMIGDMQGPGEYVQRGEFEPNQQTVLFRVLDGKALAAVAINSTKDFGGVSRLVMSEIEIVPDHLADTDISIRELLKGNAARTVTA

SEQ ID NO: 9711 - protein, 302 aa, Triticum aestivum
  misc_feature (251)..(251): Xaa can be any naturally occurring amino acid
MNQFVPADWSGNMGDALPALSGEDDGLVELLWCGGHVVMQSRAPPRPAVREQEAAPWFQYPVVDEDDCSVERDLFSEIFGGMPADGAGRPCKEEDKQRGAADAVTALRSGVMPPPLLTGKAGLHGDGPRVSLASEAGESSVVTIGSRRVGGGSNQAQTAHVSDAAGDDSVPLPLIRNRKEARDSRSYHSASATLTSSSTWSRPSGTSKRKQSEGPSEVMQDVESNSADVTCETAQKPTTAKRRRAAQVHNXSERRRRDRINEKMRALQELVPHCNKTDKASMLDEAIEYLKSLQLQLQLMWA

SEQ ID NO: 9712 - protein, 344 aa, Thiomicrospira crunogena
MTIANKPLTIAVLGAGAWGSALAIHLSRIGHQVKLWDHNPENAATLESARENVRYLKGVPFPDALSVQSDLKVTLADVDAVLMVVPSQAFREVLQKMHHIMMGSKSHYHLAWATKGFEPETSLMLHEIVQQELGEQISFAVLSGPTFAAEVARGLPTAMVSASRDQQEAQFWADAFHCDTFRMYTQSDVVGVEIGGAYKNIMAIATGLSDGLRLGANARAALIGRGMVEMMRFGDALGAKHETMMGLSGLGDLVLTCTDDLSRNRRFGLMLAQSQRPAEDVIEEIGQVVEGVKAVKAVKLIADKYQLDLPIMEQVYNIIVGQSTAEQAVKELMRRHGRSELEFG

SEQ ID NO: 9713 - protein, 96 aa, Mycoplasma genitalium
FELNDFSFGIDLKTEHERFLCEQYFQNQPLFVINYPKELKAFYMKTNTDNKTVAAVDLLLPKIGEICGGSERESDLNQLKNRCQSLNIDTKSLNWY

SEQ ID NO: 9714 - protein, 452 aa, Bradyrhizobium japonicum
MMSQEQNDLITRTGPKDPCGKLMRSYWQPTALVDELEGARPIRPVRLLGENLVLFRDERGRYGLIDRHCAHRGADLAFGRLEHGGLRCAFHGWLFDATGQCIETPAEPKDSKLCQNIRQRSYPVVEKSGILWAYLGEGEPPAFPEIDCFVAPDTHTFAFKGHMACNWLQALEVGIDPAHASYLHRFFEDEDTSTAYGKQFRGASAGSDLPMTKILREYDRPIINVEHTEYGLRLIALREIDEERTHVRVTNQLFPHGFVIPMSTEMTITQWHVPVDDENCYWYAIFTSYTNPVDKKKMRDQRLELYELPDYKSRKNSGNDYGFDPHEQQTATYTGMGNDINVHDQWAVESMGAIQDRTKEHLGQSDKAIVQYRRLLRQEIEKVGGGEKPMLFLDEANARSIQGPATMDGIGPTRGWETYWMEVDVKRRRGAPWTAPVPKEIDGKVHRLTAAE

SEQ ID NO: 9715 - protein, 196 aa, Brassica rapa
MARLLFRLLGESNSPSPVQDPSTAAVTSDLVVTLAALLCAMVCVLGLIAVSRCVWLRRLAAGNRTHAGSQGGSVQSPPPPVAAANKGLKKKVLQSLPKLTFSPDSPSSEKFTECAICLTEFSNGDELRVLPQCGHGFHVSCIDTWLGSHSSCPSCRQILVVARCHKCGGLPGSSSSEPEIEIRIKQGADVPNSYLP

SEQ ID NO: 9716 - protein, 410 aa, Campylobacter coli
MRNLLENIKKNSQKLLNLTPKDKENIILKLACALRENFKIILEANEKDMTNFTKSGAMRDRLLLDKKRIFSLCDALEKIAYLEDPIGKISKGWVNYAGLKIEKISIPIGLISVIYEARPSLSAEIIALMIKSSNACVLKGGSEAKFTNSAIFDLVYKVLEKFNLQDCFAMFYERNEIMQILAFDDLVDVIIPRGSSNMIQEIASHTKIPLIKQDKGLCHAFVDESANLNMALEIILNAKCQRVSVCNALETLLIHEKIAKDFIKLLIPEFEKFKVKIHAHENILEHFKNSKLEISKADESTFDTEWLDYAISIKSVKDCDEAIEHINQHSSLHSETIISNNALNIGKFQRLLRSSCIYVNASTRFSDGGEFGFGGEVGISTSKLHARGPMGVEDICTYKYLISGEGQIRK

SEQ ID NO: 9717 - protein, 420 aa, Streptomyces coelicolor
MPRAKTFVIVGGGLAAGKAAEELREHGHDGPLLVIGDERERPYIRPPLSKGYLLGKEDRESIHVHPESWYREHDVDLLLGTSVTSVDARGRAVTLDDGRRVPYAGLLLATGSSPRRLSVPGADLEGVLYLRRVGDSERLKEAFTEGARIVVVGGGWIGLETAAAARAAGAEVTVLERGELPLLKVLGREAAEVFAGLHRDHGVDLRPHARIEAVTGTGGRVDGVRLADGTHLPADAVVVGVGITPNVRLAEEAGLDVRNGIVTDARLRTSAAGVHAAGDVANAYHPRLGRHLRVEHWANALHQPRTAALSMLGQDAVYDRLPYFYTDQYDLGMEYTGYAEPGGYDRVVFRGSREERRFLAFWMSGDRVLAGMSVNLWDVIGTIRALIESGAETDDAALADPSVPLESLLPPHARPTGDQA

SEQ ID NO: 9718 - protein, 290 aa, Campylobacter lari
MKLALIQQEFKQNKEKTIEKTCELIKQAAKEKAELVCLQELHQTQYFCQSENTNFFDLANDYEEDINFWSNVAKENKVVLVTSLFEKRSAGLYHNTSVVFEKDGSIAGKYRKMHIPDDPCFYEKFYFTPGDLGFEPIQTSVGKLGVLICWDQWYPEAARLMALKGAQILIYPTAIGWFDKDEKEEKQRQLEAWIGVQRGHAIANGLPVVAINRVGFEKDESGVEEGIRFWGNSFVFGAQGEELFRADDKQELCKIVEIDMQRCENVRRWWPFLRDRRIEYFHELNKRFID

SEQ ID NO: 9719 - protein, 131 aa, Bradyrhizobium japonicum
MMTDSDVAISMFERIGGSATIDLLVDRFYERMDTLPEAKVIRAMHAADLGLIRDVLKRYLTEWTGGPRLYSVEKGHPRLRQRHIGFAIGDAERDAWLTCMRGALEETVADAAARQDLDKALSGLADWMRNR

SEQ ID NO: 9720 - protein, 475 aa, Bacillus subtilis
MNLQENSSQQLKRTMKSRHLFMISLGGVIGTGLFLSTGYTLHQAGPGGTILAYVIGGLMMYLVMQCLGELSVANAVTGSFQKYATTFIGPSTGFMVGIMYWINWVVTVGSEFTASGILMQRWFPDSSVWMWSAIFAALLFICNAFSVKLFAETEFWFSSVKIVTIILFIILGGAAMFGLISLNGTADAPMLSNFTDHGGLFPNGFLAVFIAMISVSFAFSGTELIGVTAGESANPQKDIPRSIRNVAWRTVIFFIGAVFILSGLISWKDAGVIESPFVAVFAEIGIPYAADIMNFVILTALLSVANSGLYASTRMMWSLANENMISSRFKKVTSKGIPLNALMISMAVSCLSLVSSIVAPGTVYVVMVAIAGFAGVVVWMSIALSQLLFRKRFLKKGGDVKDLTFRTPLYPLMPIAALLLCSASCIGLAFDPNQRIALFCGVPCIILCYLIYHFKRNVTKAKKISQEEYPADHIL

SEQ ID NO: 9721 - protein, 155 aa, Oryza sativa
MAPKAEKKPAAKKPAEEEPAAEKAEKAPAGKKPKAEKRLPAGKGEKGSGEGKKDRAGRKKAKKSVETYKIYIFKVLKQVHPDIGISSKAMSIMNSFINDIFEKLAAEAAKLARYNKKPTITSREIQTSVRLVLPGELAKHAVSEGTKAVTKFTSA

SEQ ID NO: 9722 - protein, 213 aa, Erwinia chrysanthemi
MIANFDKTQPIGQSDALPGRTTPMPVARLHVVNQHSMTHVPDHMEVAIFAMGCFWGVERLFWQQPGVYSTASGYCGGYTPNPTYREVCTGKTGHAEAVRVVFDPAVVSYPQLLQLFWENHNPAQGMRQGNDIGTQYRSAIYTLTTEQETAAKESYQRFQQAMRDAGNDHDITTEIQPAGPFYYAEDEHQQYLHKNPDGYCGLGGIGVCLPPQG

SEQ ID NO: 9723 - protein, 399 aa, Rumex palustris
MAIECMHKTDHEVKQGREPLSLVFDSKILRNQASIPKEFIWPDDEKPDHEAAELEVPVIDMEGFCREETKSTNNASKLVQEAFMKHGFFLVKNHGVEAELIKHTHKYMREFFELPLVEKQRVQRKLGEHCGYASSFTTRFSCKLPWKETLSFPYSPEEANNTKVVEEYFNSKMTKDFAHMGKLYQEYCEAMNKLSLRIMELLGLSLGVGRQYFRDYFQGNDSVMRLNYYPPCQEPELALGTGPHCDPTSLTILHQDHVNGLQVFVDGEWRFIYPRFDTFVVNIGDTFMALSNGKYKSCLHRAVVNDTSPRKSLAFFLCPKEDLIVCPPNELVNESSPRVYPDFTWPIFLEFTQKHYRADMNTLLNFSRWVRERNQVQQSDGSSSVCPSIHLSCCNVQIK

SEQ ID NO: 9724 - protein, 77 aa, Coffea arabica
MKEQKWTHEGLITESLPNGMFRVRLDNEDLILGYVSGKIRRSFIRILPGDRVKIEVSRYDSTRGRIIYRLRNKDSKD

SEQ ID NO: 9725 - protein, 245 aa, Pseudomonas brassicacearum
WGNKPRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTDELVELGREITEEAVVLDTRFAYPEYGLPNEGTLEAIRLCGSLEGVLTDP

SEQ ID NO: 9726 - protein, 526 aa, Gibberella zeae
MNPSLISKAARPTRVLAQNAPKIQCLRKGAQLHTAAWHVGSQRQPSFRKGSQSPSAKRLFHATNAVQQKDPYQALGVGKTASAGDIKKAYYGLAKKYHPDTNKDPQAKDKFADIQSAYEILSDPKKREQFDQFGAAGFDPSGGGAPGGGGGFGGGHPFSGFGGFGGQGGFGGFGGQGGFGAGVNFEDIFSAFTGQQGFGRRSRQQAYQQEILVGENIEVQSTISFMEAAKGTTKTISITPLSTCDTCKGNGMKSGSSRSACSACDGSGTRINYMQGGFQMASTCGTCGGTGTVIPRGSECKPCSGNGVVRERKTITVDIPAGIEDGMRLRVDGAGDAALTGRSAEPNARSQNGDLYVFVRVAKDPKFRRDGSNILYTANIPLTTALLGGHAEIPTLDGTVNVKVATGTNTGDKITLPGMGMKRLGSRRGGNGDLRVEYRVSMPKYLSANQRTIVEVLADEMGDKTAKRVMGVGSSRDPNDPDTHRDEGFLKSLWHTLTNHPAHQKPNEDGSQNDGSTKKPGDDDKK

SEQ ID NO: 9727 - protein, 278 aa, Silene vulgaris
EAHSLKVEKILFQGKSKLQDVMVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKAATEGSYDAVIVDSSDPIGPAKELFEKPFFESVAKALRPGGVVCTQAESIWLHMHIIEDIVSNCREIFKGSVNYAWTTVPTYPSGVIGFMVCSTEGPAVDFRNPVNPIDKMEDEKRPLKFYNAEIHSAAFCLPSFAKRIIEAKANST

SEQ ID NO: 9728 - protein, 379 aa, Legionella pneumophila
MEQRDYYELLEVSRNASDAEIKKAYRRLAMKYHPDRNPGDTSAEEKFKEIQKAYNILSDKQKRAAYDQFGHAGVDPSMGGGPGGFGGFGGFGDVFEDIFENIFSGGRGQGRQSRGQRGADLQFNVQLTLEEAAIGKEVEITVPRHGTCTVCEGSGAKKGTSPKTCETCQGMGQVRIQQGFFSIQQTCPTCHGEGKIISDPCASCHGQGRVRESKKINVKIPAGVDNGDRVRLSGEGEAGVHGGGSGDLYVQISLKKHAIFERHENDLHCEVPISFATAALGGSIEVPTLEGRVTLKIPAETQTGKVFRLRSKGMKSVRGYGQGDLLCKVVVETPVNLSREQKELLNKLQDSLENAKGTHSPKTSSWFAGVKKFFEDMKF

SEQ ID NO: 9729 - protein, 317 aa, Brassica napus
MGKVRDFGAEDHIPSNIFHAVTAISICLSAIYLNLALVLISLFFLPTSLSLLVLGLLSLFIIIPIDDRSKYGLKLARYICKHAASYFPVTLHVEDYEAFKPDRSYVFGYEPHSVWPIGAVALVDLAGFMPLPNIKLLASNAIFYTPFLRHMWAWLGLASASRKSFSSLLESGYSCILVPGGVQETFHLQHDVENVFLSSRRGFVRIAMEQGAPLVPVFCFGQSRAYKWWKPDCDLYFKLAKAIRFTPICFWGVFGSPIPYRHPIHVVVGKPIQVAKSLQPTDEEIDELRGQFVEALKDLFERHKAGAGYSDLQLNIL

SEQ ID NO: 9730 - protein, 278 aa, Silene latifolia
EAHSLKVEKILFQGKSKYQDVMVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKAATEGSYDAVIVDSSDPIGPAKELFEKPFFESVAKALRPGGVVCTQAESIWLHMHIIEDIVSNCREIFKGSVNYAWTTVPTYPSGVIGFMVCSTEGPAVDFKNPVNPIDKTEDEKRPLKFYNAEIHSAAFCLPSFAKRIIEAKANST

SEQ ID NO: 9731 - protein, 199 aa, Haemophilus parasuis
EEGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKNTELDSYLIDITTDILGYKDTDGTPLVEKILDTAGQKGTGKWTGINALDFGIPLTLITESVFARCVS

SEQ ID NO: 9732 - protein, 935 aa, Unknown
  Nostoc sp. PCC 7120
MWRKFQAFIQRTRSVLIITPSVALTIIVGQSLGIFNLLEWKLRDEWVRLRSCEANTLLECSHNTMADEIIVITIDEQDIQSVGKWPIPDWSLAELLEKIRAQQPRAIGLDLYRDLPEGKGYEKLAEVFRTTPNLIGVEKITGERVNPPPELKKNDQVGLADLVLDGDRHVRRALLTAVDTKEEGKIKAGLATLVALKYLKAEKISLESVDAKQQKFRLGKQIHLPLQNSSAGYTDADLGGYQILLNWYGSEAAFRTVTMRDVLAGKIPPELMRDRMVFIGSTAASTNDFFSTPFSSSLISAQKPTPGVVIHANIAHQLVRGARTGKANLRGFSGLFMASWIILWSVIGSSGSWLLASARSGRRIPGGKILWTTTSISGAFLGGGYGMFLHGVLIPVTPPLAAFIVSVIATTNAYKQQKLEEANQQLEIANSQLLDYSKTLEIKVQERTHELLEAKQAADAANQAKSEFLANMSHELRTPLNGILGFAQVLEVSPNLREKDLEGVNIIHQCGSHLLLLINDILDLSKIEARKLELVVANVHLPTFLHGVSEICSIRAAQKGIAFKVSMGDRLPTVMEVDEKRLRQVLINLLGNAVKFTDSGGVTFKVELLDTQDQDNQQSSVAKIRFQIEDTGVGMSPEQLEKIFLAFEQVGDCRRQSEGTGLGLAISQRIAELMGSQIQVQSRLGEGSIFWLDVTLPVPISHDWQTYAPMHQKVIGIQGSAPQILIVDDDDNHRSMLNSLLQEIGCQTLEASDGKQGLQMVNEHHPDLILLDLAMPNMDGFELMVQLQENPQTSSIPIIVSSASVFEENRQRSLQAGATAFLPKPLQIDELFNALRSLLQVEWIYAPSASLSLSPQPGPTTPTELVLPSQDVLQQLYHLSMMGDIPAIEGILRELIQHNSQLTPFATELSKLTTNFQTAKIRQFLKSFVITESHP

SEQ ID NO: 9733 - protein, 549 aa, Aspergillus nidulans
MSSPLVKVLHRMQALFSNIVAALETMLLFPSLFRDSSRGGGKSRAAFRRRRALDALADEIEIIFSKPLTLKNMLAMSEKIREQFRAGLESSPINMLPSYNHALPTGLEQGTFLALDVGGSTMRVALIELCGQGKMEVLRVSSSLIDNDVKLLEGTSFFDWMAEKIEEMLREVGTNYGREEAPLSMGLSWSFPIEQTSISSGLVIHMGKGFRCSMGTVGQELGSLIVQSCQKRGLNVRVDAIVNDSSAALLSRAYVDPTTRMSLILGTGTNVAIHFPVHAIGLGKFGKRPQGWFDYAKHVIINSEMSMFGGGVLPMTRWDDILNRTHLRPDYQPLEYMATGRYLGEIVRLIIVDAVETAQLFGGELPHSMRDAYSLDTSIVAFIEADTSPFLTASAALLQKEHTMSRPPSPEDLRFLLRVCRTISKRAAGYLATAIHSMWCLRNEAEISQGPPSPSFKGPRDVTVTESGSNSDCLSIACDGSVINKYPGFRDRCQAYLDQLTQETNTSKVSQISEEGSCIRLEPAPEGAIFGAAVAVAVAVAGKLEQTIV

SEQ ID NO: 9734 - protein, 417 aa, Pseudomonas fluorescens
MFSRDLTIAKYDADLFAAMEQEAQRQEEHIELIASENYTSPAVMEAQGSVLTNKYAEGYPGKRYYGGCEYVDVVEQLAIDRAKELFGADYANVQPHAGSQANAAVYLALLQGGDTILGMSLAHGGHLTHGAAVSSSGKLYNAIQYGIDANGLIDYDEVERLAVEHKPKMIVAGFSAYSQILDFPRFREIADKVGAYLFVDMAHVAGLVAAGVYPNPVPFADVVTTTTHKTLRGPRGGLILARANADIEKKLNSAVFPGAQGGPLEHVIAAKAICFKEALQPEFKAYQEQVVKNAQAMAEVFIARGFDVVSGGTKNHLFLLSLIKQDISGKDADAALGKAFITVNKNSVPNDPRSPFVTSGLRFGTPAVTTRGFKEAECKELAGWICDILADLNNEAVIDAVREKVKAICKKLPVYGA

SEQ ID NO: 9735 - protein, 327 aa, Wolbachia endosymbiont
MAISILGAGAWGTAIAISLGSKKDVILWTHNETTFESINGKRESDKLPGCRISDNVSVKLAIEDIINASVTILAVPTQSLRKVCQQLHNCNLKKDVAIILACKGIEKSTLKLPSEIVNEILPNNPIAIFSGPSFAVEVARKLPYSMVLACQNNTLGSKLVSELQQENVKLEFSNDIIGVQICAALKNVFAIACGIVLGSKLGFNAHAALITKSMSEIKALYSAKIGDGSVDINTLLGPACLGDLIMTCTSLNSRNLSFGFKIGNSDNGFNVQQILSEGKSVIEGFSTAESIFNLAGKLKIKMPICEAVYRLLYESASIEDTLSVLIS

SEQ ID NO: 9736 - protein, 199 aa, Haemophilus parasuis
EEGDIIIDGGNSNYPDTNRRVKALTEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFSEWKKTELDSYLIDITTDILGYKDTDGTPLVEKILDTAGQKGTGKWTGINALDFGIPLTLITESVFARCVS

SEQ ID NO: 9737 - protein, 303 aa, Aspergillus oryzae
MKNERAYLVHVIVHHLRWRGFLILPRLHKPKPHHIPPQHKPKETRKTMSPQSTPFEEGAFLPGGHNTDPPLPPNDPTIGTKLNHSMLRIRDPQRSLHFYITLMGMRTVFTMNTGPFTMYYLGFPSSAEDRADLSAWAAKVSDPANLTQTLGLLELFHIHGTEKPVDEGGVEMANGNAPPNLGFGHLGFTVPDVGATVERLRAEGVKVVKELGVTTRESIPLSEWEEKRGVGVGEIHPNYKVFFDQIAYVADPVSFFFFFFWFRIVVIEADWVFRMGILLKFFRRIGSENVRGGVLMLDTAVDE

SEQ ID NO: 9738 - protein, 824 aa, Agrobacterium tumefaciens
MKAHAAGIAAATAGIALPAAAQPVPGGVSALQIKWSKAPCRFCGTGCGVMVGVKEGKVVATHGDMQAEVNRGLNCIKGYFLSKIMYGKDRLETPLLRKKNGVYAKDGEFEPVSWDEAFDVMAQQCKRVLKEKGPTAVGMFGSGQWTIFEGYAATKLMRAGFRSNNLDPNARHCMASAAYAFMRTFGMDEPMGCYDDFEHADAFVLWGSNMAEMHPILWTRIADRRLGFDHVRVAVLSTFTHRSMDLADIPMVFKPGTDLVILNYIANHIIKTGRVNEDFVRNHTKFVRGVTDIGYGLRPDDPVEVNAANSADPTKTEAIDFETFKEFVSEYTLEKTAAMTGVEAGFLEELAELYADPKRKVMSLWTMGFNQHVRGVWANQMVYNIHLLTGKISEPGNSPFSLTGQPSACGTAREVGTFAHRLPADMTVTNPEHRKHAEEIWRIPHGIIPEKPGYHAVQQDRMLHDGKLNFYWVQVNNNVQAGPNTKNETYLGYRNPENFIVVSDAYPTITAMSADLILPAAMWVEKEGAYGNAERRTHVWHQLVEASGEARSDLWQLVEFSKRFTTDEVWPAEILDANPAYRGKTLYEVLYKDSDVGKFPLSEINADYKNQESSDFGFYLQKGLFEEYAAFGRGHGHDLAPYDAYHEVRGMRWPVVDGKETLWRYREGYDPYVKPGEGVKFYGNKDGRAVIIAVPYEPPAESPDQEFDTWLVTGRVLEHWHSGSMTMRVPELYKAFPGARCFMNADDARKRGLNQGAEIRIVSRRGEIRSRVETRGRNRMPPGVIFVPWFDASQLINKVTLDATDPISKQTDFKKCAVKIEPVA

SEQ ID NO: 9739 - protein, 358 aa, Ustilago maydis
MGRAEAGSLKAISNAIKAKGLTKLRFYCQLCQKACRDENGYRSHLESEAHFRQVDALAASGGAQKVIDGFSATFQKEFVQLLSRRFGTRRIRANQVYQEYIADRHHTHMNATQWTSLSDFVKHLGREGVVQAEDTDQGWYITWIDNSPAALARQDALQKMERAKMDDEQRQRRLLQEQIDRASQVSSAAVTSSASSAAHSRDTQNCEGLQRTGTGPIRIGLSLGPIAKKTGPKAEDITAEEGTSGCSSTVPISGVSTTTVTPAEASSPTPAKMGFTVLKSTSRPANPLKQASQARRNGPLNSMAQISSSTGKSKPPNSMTMAEKIMHEELERKKRKANPSLERSTGPKMQPGMKRSRF

SEQ ID NO: 9740 - protein, 263 aa, Glycine max
MVQVQSITLKHLSLPTHTFVPPKFNIPLNRNLSFTPKFTFSTSLSVRCYHPNLVQPKPFPPLPQRPPVAELPQQRVYVGYSVYTRKGVLTVTPRPPEFESKSSGAFKVSKEGYVVLQFAPSVGADEPIYDWNQKQTLSLSVSEMGTLITLGARDSWEFSHETVKLKSNETEVRKVLKVEPLLDATGHLFSLSVLKKPANMEGIQESIFLPVTRADLEVLRSLFNCIMPYLLGWNAFGNSIKPEVYSQVNSTNPRYGADNEWNR

SEQ ID NO: 9741 - protein, 510 aa, Ustilago maydis
MASRRSYATLVQSFLKHSSLPVVRGPASPASILPRTFATSVLKMSIAVPTDFNKVLYQPLAEADPEVQQIIENETYRQFSGLELIASENLTSLATMEANGSILTNKYSEGLPGARYYGGNEYIDQLEVLCQQRALKAFNLDPKVWGVNVQPYSGSTANFATFTALLQPQDRIMGLGLPSGGHLTHGYYTAKKKISASSIYFQSFPYNVDPATGYINYDELKKNADLFKPRMVICGGSAYPRDWDYAKLAEIAKTQSAYLMADIAHISGLVAAQVQNNPFEYCDIVTTTTHKTLRGPRAGMIFFRKDRDAEIEGRVNAAVFPACQGGPHNNTIAGIAVALKQVADPAFKQYATQVIKNSQAIAKVLSGKGYKLQTDGSENHLILWDLRPLGLTGSKVENICDLAHITLNKNAVSGDTSALVPGGVRIGTGALTSRSMGEKDMEKVAEFLDRVVQISLEIQKTSGKKLVDFMNAARQSEAVKQLNKDVEAFATSFPLPGVPDTSIIKKPAAH

SEQ ID NO: 9742 - protein, 149 aa, Triticum aestivum
  misc_feature (38)..(38): Xaa can be any naturally occurring amino acid
  misc_feature (98)..(98): Xaa can be any naturally occurring amino acid
  misc_feature (110)..(110): Xaa can be any naturally occurring amino acid
  misc_feature (117)..(118): Xaa can be any naturally occurring amino acid
  misc_feature (127)..(127): Xaa can be any naturally occurring amino acid
  misc_feature (133)..(133): Xaa can be any naturally occurring amino acid
  misc_feature (136)..(136): Xaa can be any naturally occurring amino acid
SGIGFLDHMLHALAKHAGWSLALHCKGDLHIDDHHTAXEDVCLALGEAFNVALGTKMGIARFGSAYAPLDEALSRAVVDISNRPYCVSELKLQREKIXDLSTEMIPHCMXSFAQNAXXTLHVHCLHXDNDHQXAKXAFKGLANSFTGQN

SEQ ID NO: 9743 - protein, 216 aa, Camellia sinensis
MGRRPARCYRQIKNKPYPKSRYCRGVPDPKIRIYDVGMKRKGVDEFPFCVHLVSWEKENVSSEALEAARIACNKYMTKFAGKDAFHLRVRVHPFHVLRINTMLSCAGADRLQTGMRGAFGKPQGTCARVAIGQVLLSVRCKDGNSHHAQEALRRAKFKFPGRQKIIVSRKWGFTKYNRTDYLRWKSENRIVSMQPLGCHGPLANRQPGRAFINASA

SEQ ID NO: 9744 - protein, 309 aa, Leptospira interrogans
MKAKNILETIGNTPHVKINRLFNTKSEVYAKLERSNPGGSIKDRIALSMIEDAEKTGKLTKDSIIVEPTSGNTGIGLALVAAVKGYKLLLVMPESMSIERRRIMAAYGAEFELTPREKGMPGAIEKAKQIVAENPKAWMPQQFENEANIKIHVETTAQEIAKDFPDGLDYVITGVGTGGHITGVAQVLKQKFPKLKVFAVEPEASPVISGGKPGPHPIQGIGAGFIPKNLHTNLLDGTIQISKDEAFEYAQRAAKEEGLFIGVSSGAALAAVAKKLPEIPEGSRILTFSYDTGERYLSIEGLFPVPSNA

SEQ ID NO: 9745 - protein, 704 aa, Brassica rapa
MSNSCSGGGGCSIVWFRRDLRVEDNPALAAAVRAGPVIAVFVWAPEEEGHYQPGRVSRWWLKNSLAQLDSSLRSLGTCLITKRSTDSVASLLEVVKSTGASQIFFNHLYDPLSLVRDHRAKDALTAEGIAVKSFNADLLYEPWEVTDELGRPFSMFAAFWERCLSMPYDPESPLLPPKKIISGLLLHHTLSEIVSYPLLITLFVLAGDVSKCVADTLIFEDESEKGSNALLARAWSPGWSNADKALTTFINGPLIEYSKNRRKADSATTSFLSPHLHFGEVSVRKVFHLLRIKQVAWANEGNQAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTEWIHHPWNAPESVLQAAGIELGSNYPRPIVGLDEAKARLHEALSQMWQLEAASRAAIENGSEEGLGDSTEFVEAPIEFPRDITMEETEPTRLNPVRRYEDQMVPSITTSLIRPEEDQESSLSLRNSGGDSRAEVPRNMVNTNQARQQEARADPVSNQVTAMIPEFNIRIVAENTEESTAESSSSGRRERDGGIVPEWSGYSEQFASEENGIGGGSTTSTYLQNHHEIVNWRRLSQTG

SEQ ID NO: 9746 - protein, 500 aa, Unknown
  Vibrio sp. Ex25
MTIHVKNNIHWVGQRDWEVQDFHGTEYKMTKGTSYNSYLIREEKTVLIDTVEHRFSQQFIQNLEMEIDLKTIDFIVVNHAEEDHSGALSALMEKIPNTPIYCTEAATDSIVGHHHHPEWNFKTVKTGDSIDIGNGKQLVFVEAPMLHWPDSMMTYLTGDAVLFSNDAFGQHYCDERLFNDEVDQNELMEQCLRYYSNILTPFSSLVTAKIKEVLSFNLPVDMIATSHGIVWRDNPVQIIEQYLEWADNYQEDRITIFYDSMSNNTRMMADAIAQGIHDVDPSVAVKVFNVSKHDKNEILANVFRSKGILVGSSTMNNVMMPKIAGMLEEITGLRFKAKKAAAFGSYGWNGGAVDRIHARLTDAGFETAVSLKTKWRPDGKAMRECREHGKSIAKLWAKHPLTSPVAAPMMAASAPQVQSQPVVQVETQAVVERELINPSSEAHPSDCQCMICTVCNWVYDPAQGEPNQGIKPGTTWSDVPDYFLCPECHLGKDVFVEFKG

SEQ ID NO: 9747 - protein, 382 aa, Unknown
  Vibrio sp. Ex25
MQAPIVIIGSGFAAYQLVKTVRRMDAQVPIQVFTADDGAEYNKPDLSHVFSRKQTARDLVVTTGEAFAQEHHIELLTHTKIESVDTQAQQVVADGQVYAYSKLVFATGAKAFVPPMRGDASGDVLTLNSLQEYQLAEERVSQAKRVMVIGGGLIGVEIAMDIASSGKAVTVVESNQRLLANLIPEFVALPLESQLKQQGIQLALGNGVVEVNRNADSLVATLNSGEVIDTDVVISAAGLRSNTQLANACGLEVGKGIAVDAKLQTSTNNVFALGDCAEIQGRMLPYLQPIVLSANVLGKQLLGQEAQLKLPPMMVKVKTPSYPIQLAGDFSAVANWNVQISQSGIVAKAENEQSILTGFVVTGEQVAQAFPLLRELSQVAQS

SEQ ID NO: 9748 - protein, 1028 aa, Arthrobacter psychrolactophilus
MTPADVSYITDQGPGSGLRVPARSWLNSDAPSLSLNGDWRFRLLPAAPGTPGAGSVLPDGESVEGVAAESFDDSAWDTLPVPSHWVLHGEGKYGRPIYTNVQYPFPSDPPFVPDANPTGDYRRSFDVPAAWFGKYDAALTLRFDGVGSRYKVWVNGQEIGVGSGSRLAQEFDVTAALRPGSNLLVVRVHQWSAASYLEDQDQWWLPGIFRDVTLAARPAGGITDVWLRTGWTADTGAGQGAGTGTLDPEIIAEADAYPVTLTAPALGVAVRWDSPADVVPFTVDNVEPWSAELPRLYEATVSSAAESITLRLGFRTVEIVGDQFLVNGRRVVFHGVNRHETNPDRGRVFDEADAREDLALMKRFNVNAIRTSHYPPHPRLLDLADEMGFWVILESDLETHGFHRQGWVDNPSDVPAWRDAFVDRMERTVERDKNHASIVMWSLGNESGTGANLTVMQAWTHTAVRLSRPVHYEGDYTGAYTNVYSRMYSSIPETDSIGRNDSHALLLGCDAAESARQRTRPFILCEYVHAMGNGRGAMDQYEELVDKYPRLHGGFVWEWRDHGIRANTADGTEFFAYGGDLGEVIHDSNFVMDGMVLSDSTPTPGLHEYKQIVSPIRLSLALDDGGAPRLTVANLRHTADASDVVLRWRVEHNGAVAASGELAVDSADGPLRAGESVTLTLPPVAAAPEGETWLTMEVVLRDATEWAPAGHPLAATQLDLSAPQSAPRAPRPAAPVSGASPLSLGHAMFDAGALVALAGLPVSGPRFELWRAPTDNDRGKGFGAYGPEDPWLNNGKGVPAPSSEAVWKQAGLDRLTRRVEDVAALPDGLRVRNRYAAANSAASVAVEENWQLAGEELWLRLDIMPSAGWDLVFLRIGVRLDLPTDVDGASWFGAGPRESYADSMHATVVGRHSGSIDELNVPYARPQETGHRSDVRSLELSRNGAPWLRIEADPDALGRRPGFSLARHTAQQVTAAGHPHELPASSHSYLYLDAAQHGLGSRACGPDVWPDFALRPEARTLVLRFSAL

SEQ ID NO: 9749 - protein, 2052 aa, Yarrowia lipolytica
MDPLDIGNSQPREGWNRLNAFSNDGVSPTSNSYDHDELPPSPTSRTAFTGIDPDYEFAPKWEPGHGNNNSSIDDPLYSTLDPHARANASLTRSAPGPPPPGQRPPPERPTVITPVGTHTPSAGGSRAVTPISTNVDRRPSYASQGTTGSTGSKKSIPQKVMDLFVSDDTSADSDGQSSSSKKHHKVKLPRPSKSMFFFKKHDDDDSRSEHSRERTERTSHPGDGHQLRAARSFNKPDHGIFHKAATSNHFDDSNSIHRATSHSTLPSGDEDDTLIALAHKAKKSSKNIIGKVFHHKDKKKKSHTFDGPINPLESHAQPFRNASVASVPEPHAPKQQPTMRSASTVSHLDPHRNSSTSSRDHMASSSRDHTASSSREQVLNMISKRPSLANANFYNLDTDLDSMAGIVEDGGASSSANSSALPRHASTGSAAADSIPGMPVLPGGSISGPMGGPMVGDRSSVSTNNNTNNANNANNSNHNSVSGVASPTPVVNTANASGTTAAPVIGVGTDLSFIGNDDTAPQTNAGQWSAPESWAVADTGPGGGSKLEPEEIVETYADPTREQYGLETNVSTHIPGKPPINYFVRIFRQDDSFGTIVCPLETTVSELIQILGKKFFLPSVKGYQLCVRIGGLTRVLDLLEKPLLYQKILLEFMGYTEKDRLVEVGREDLSYLCRFLFLPSSIQTFTPEEEAIMSRDYVHADLQNLELQTIPIIFYQFSNEIEYLDVSNNPSISIPLDFIQSCINLKNLRFSGNRSRFFPVNISHAVFLEYLDMSRNMIKDVAQIRFERMSALTTLDLSCNQLTRINNNVALLKQLRRLSLSNNNVTDFPMAVCNLSNLIELDLSFNRLSSVPASISKLVNLERLVLNNNYISKLPNDIKNLVQLKELDVRYNRLNNVDALSSLPLLEVLYASKNQITSYEHNFESLQCLYFDRNPFTEVNVSNVLHTLTVLHLSKAKLSTLPENFFDRLPNLEKLVLDKNHFVSLPSSLGSLRKLIYLSAVGNNLSVLPSSIGQLTTLQFLDLHSNNLRKLPDEIWNLNVLSTLNVSSNLLDSFPKHKFHVSSVSSGDAFHRNLESEFDSNYEMRIRRPSAFSITSTLSPGETSRRGSLAYNSPKMSTSPMTFARDAPVSSRTTLANSLLILSLADNRLNDECFEELSLLTSLQVLNLSYNELMDIPYGALRRLNRLTELYLSGNNLTSLPADDFENIKTLRTLHVNGNKLHSLPAELGKILHLTVLDVSSNQLKYNISNWPYDWNWNWNLDLKYLSFSGNKRLEIKSAANNLMRHGDGTEQKNLSDFTVLSQLRVLGLMDVTLTTPSVPDQTENCRVRTYGSELNNMPYGMADSLGQHENLSIIDMVVERFRGNENEVVVGMFDGRNEINPRAGNKVAKLLQEMFGALLQDELKKMRDDDTIEDALKRSFLAANRDIGAAALTTVESHTAHRSSTTTHLNKQDGLTGSCATVCYISDNKLYVANVGDSMCILSKGTGEHRLLTTRHDPTEPEELGRVRAGGGFISAHGKLDGVCDVSRAFGFYNLIPHIQARPDIVSMELNDSDELLIIGSKQLWEVMSYETAVDIARTESQDPMLAAAKLRDFAISYGASDKLMVMVLGIGVKRRTANQSNLISGLPPVGEDELFQPYRKRRDKSLLPEDSNLARLGSEVDPPEGEMAMVFTDIKNSTLLWETYPIAMRSAIKIHNAIMRRQLRILRGYEVKTEGDAFMVSFTTPTSALLWCFSVQQQLLAADWPAEILESEEGYEVRDDEGNVVFRGLSVRMGIHWGSPVCEPDPITRRMDYFGPMVNRAARVSAVADGGQITVSADFISKVKKLQSLREKMNAENISLGEAFNDEITGQAITQNLDMLDSLGWIVKEIGELKLKGLENPEFLSLVYSAPLASRHGMQEDLLHPKKKAGGFTSDLLSQVLEIALRLEHMCARFNGQSRPVSLKDIQRHAIQHIAPTPESELGVYFENIVTRIENAIMMLCMRHTVARAGGFDPINIDNVNTSASTHGVEIGQLLDAVAQLTGIRYVPEGQQYHERQPEMESSVQVEEIN

SEQ ID NO: 9750 - protein, 319 aa, Glycine max
MVQFLEVVRIEGHAFSPEDVAMARDMYLLQLCSGVDESAVGACAQLVFAPIDESFADDALLLPSGFRVIPLDPKSDGPAPTRTLDLASTMEVGSGNARPAGEADLNGYNLRSVLTIAFQFTFENHTRDNVAAMARQYVRSVVGSVQRVAMAIAPSRLNTQLGPKSLPGSPEALTLARWICRSYRVHTGTELFKAESTAGDAILKQLWHHPDAIMCCSVKTNASPVFTFANQAGLDMLETTLVSLQDIMLDKVLDESGRKILCSEFSKIMQQGFASLPAGICVSSMNRPVSYEQVVAWKVLNDDDSNHCLAFMFINWSFV

SEQ ID NO: 9751 - protein, 503 aa, Unknown
  Nierembergia sp. NB17
MMQLSTELAIAAIIFLLAHILISKTSGRRLPPGPRGWPVIGALPLLGDMPHVSLAKMAKKYGPIMYLKVGTCGMAVASTPHAAKAFLKTLDINFSNRPPNAGATHFAYNAQDMVFAPYGPRWKLLRKLSNLHMLGGKALEDWSNVRANELGHMLKSMLDLSREGQRVVIADMLTFAMANMIGQVILSKRVFVDKGVEVNEFKNMVVELMTVAGYFNIGDYIPCLAWLDLQGIEKGMKILHKKFDVLLTKMFDEHKTTSHEREGKSDFLDMVMANRDNSEGERLSTTNIKALLLNLFTAGTDTSSSVIEWALTEMLKNPSILKKAQVEMDQVIGKNRRLLESDISNLPYLRAICKETFRKHPSTPLNLPRISSESCEVDGYYIPKNTRLSVNIWAIGRDPDVWENPLKFNPERFLSGKYAKIDPRGNDFELIPFGAGRRICAGTRMGIVMVEYILGTLVHSFDWKLPSDVIELNMEEVFGLALQKAVPLEAMVTPRLPLNVYAP

SEQ ID NO: 9752 - protein, 250 aa, Suaeda salsa
MGKSYPTVSEENQKSIEKAKKKLRGLISEKHCAPIMLRLAWHSAGTFDVQSKTPGPFGTMRHQAELAHGANNGLDIALRLLEPIKEQFPEISFADFYQLAGVVAVEVTGGPEIPFHPGREDKPEPPQEGRLPDATKGCDHLRDVFIKQMGLTDQDIVALSGGHTLGRCHKDRSGFEGPWTPNPLVFDNSLLKELLSGEKDGLLQLPSDKALLADPVFRPLVEKYAADEDAFFADYSDAHLKLSELGFADA

SEQ ID NO: 9753 - protein, 186 aa, Triticum aestivum
MASEGEHAAAAAGEQTPLKKAGDAEQGEELQAPSGWTKKLNPTRGGKFEVVFVAPTGEEVKTKRALTTYLKAHPGGPALSEFVWATGNTPRRSSRLSAKPKATESPEDEKPSRRSGKSKATESPEDEKPAKRGRPSSSKKGKKGKQEDAEDAEAESGDHADAEEAKGTEVEMKDTEEAKSLTWTWR

SEQ ID NO: 9754 - protein, 202 aa, Unknown
  Acinetobacter sp. ADP1
MRNVSMTERIIEVVRNTNETKIRVRLNLDGSGQGTLNTGVPFLDHMIDQIKRHGLFDIDIHCDGDLEIDDHHTVEDCGITLGQAFAQALGDKKGLRRYGHFYAPLDESLSRVVVDLSGRPGLFMDIPFTRARIGSFDVDLFSEFFQGFVNHALMTLHIDNLKGKNSHHQIESVFKAFARALRMACEIDPRAAGSIASTKGSL

SEQ ID NO: 9755 - protein, 467 aa, Arabidopsis thaliana
MMEGRRIIANPRPCSGSRRVIAKKRSRPDGFVNSVKKLQRREISSRMDRAFSISTAQERFRNMRLVEQYDTHDPKGYCLVSLPNLLKRSKVIEIVAARDIVFALTLSGVCASFSRETNKKVCFLNVSPDEVIRSLFYNKNNDSLITVSVYASDNYSSLKCRSTRIEYILRGQADAGFPLFESESLKWPGFVEFDDVNGKVLTYSAQDSVYKVFDLKNYALLYSISDKNVQEIKISPGIMLLIFKRAASHVPLKILSIEDGTLLKSFHHLLHRNKKVDFIEQFNEKLLVKQENENLQILDVRNAELIEVSRTDFMTPSAFIFLYENQLFLTFRNRNVSVWNFRGELVTSFEDHLLWHPDCNTNNIYITSDQDLIISYCKADTEDQWIEGNAGSINISNILTGKCLAKIKANNGPPKEEDCSSSDLGNSSRRRSAVAEALEDITALFYDEERNEIYTGNRHGLLHVWSN

SEQ ID NO: 9756 - protein, 373 aa, Bradyrhizobium japonicum
MASPELSQFRRIVVKVGSALLVDSDKGEVRTSWLAALADDMAKLHKEGRDVLVVSSGSIALGRSRLKLPRGPLKLEESQAAAAVGQIALARIWSEVLGAHGIDAGQILVTLQDTEERRRYLNARSTIGKLLEWRAIPVINENDTVATTEIRYGDNDRLAARVATMASADLLVLLSDIDGLYDAPPKNNPNAKLIPVVDSISSEIEAVAGDAESELSRGGMRTKVEAAKIATTGGTHMLIASGKIEHPLQAIANGGRCTWFLTPANPITSRKRWIAGTLEPKGTLTIDAGAVTALRAGASLLPAGVIKVEGQFARGDAVIVRGPDTSEIGRGLIAYDADDAERIKGRSSPDVMTILGISGRAEMIHRDDLVVGG

SEQ ID NO: 9757 - protein, 278 aa, Silene latifolia
EAHSLKVEKILFQGKSKYQDVIVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKVAPEGSYDTVIVDSSGPIGPAKELFEKPFFESVAKALRPGGVVCTQAESIWLHMHIIENIVSSCREIFKGSVNYAWTTVPTYPSGVIGFMVCSTEGPAVDFKNPVNPIDKTEDEKRPLKFYNAEIHSAAFCLPSFAKRVIEAKAKST

SEQ ID NO: 9758 - protein, 112 aa, Unknown
  Magnetococcus sp. MC-1
MKKVEAIIKPFKLDDVKEALAEVGIQGITVSEVRGFGRQKGHTELYRGAEYVVDFLPKLKVEVVLTDDHVERAVEAIENAARTGRIGDGKIFVSPVDTAIRIRTGERDSDAV

SEQ ID NO: 9759 - protein, 334 aa, Oryza sativa
MASQGVASMFALALLLGAFASIPQKAEAIGVCYGMSANNLPPASSVVGMYRSNGITSMRLYAPDQAALQSVGGTGISVVVGAPNDVLSNLAASPAAAASWVRNNIQAYPSVSFRYVAVGNEVAGGATSSLVPAMENVRGALVSAGLGHIKVTTSVSQALLAVYSPPSAAEFTGESQAFMAPVLSFLARTGAPLLANIYPYFSYTYSQGSVDVSYALFTAAGTVVQDGAYGYQNLFDTTVDAFYAAMAKHGGSGVSLVVSETGWPSAGGMSASPANARIYNQNLINHVGRGTPRHHGAIETYVFSMFNENQKDAGVEQNWGLFYPNMQHVYPISF

SEQ ID NO: 9760 - protein, 814 aa, Fulvimarina pelagi
MQKLVVIGAGMASGRVLETLFETDPSAYEVTLFNAEPRGNYNRIMLSPVLSGEKSFEEIVTHDDAWYAGNHVTCRFGEKVVSIDRERKIVTGKNGELAYDKLIIATGSSPFIVPVEGRDLPGVIAYRDLDDTNTMIEVSGDREARAIVIGGGLLGLEAAAGLRLRGMEVTVLHLSGHLMERQLDEAAGFLLRKDLEKRGIEVMTKASTQKILGTDKVEGVELADGTVLKADLVVMAVGIRPSVEIAKQAGLAVNRAIAVNAQMQTSDPDIYAVGECVEYNGTLFGLVAPLYEQAKVLAKSLLGENDAFVVKELSTKLKVTGCDLFSAGDFAEGEIREDVVLRDPALGIYKRLVIENDRLIGAVMYGDTSDSNWFFDLIRDKTPIAEMRDTLIFGPAYQGGSPLDPMAAVAALPDDAEICGCNGVCKVKITGAITAKGLTSLDEVRAHTKASSSCGTCTGLVEQLMSLTLGDAFDPNAVKPMCGCTALSHDDVRRLIKAKELKSIPEVQQELQWSTPNGCAKCRPALNYYLVADWPDEYADDYQSRFINERVHANIQKDGTYSVVPRMWGGVTSSKELRAIADVVDKFEIPTVKVTGGQRIDMLGIRKEDLPAVWADLGQAGFVSGQAYAKGLRTVKTCVGTDWCRFGTQDSTGLGIRIEKFMWGSWTPAKLKMAVSGCPRNCAEATCKDIGIICVDSGFDIHFAGAAGLDIKGTEILGHVDTDDEVLEHVVALAQMYREQGHYLERIYKWAKRIGLDEIRRQIMKDHAARRAYYERFVFSQKFAQIDPWSERVSGKDKHEFQPMAELEFAQAAE

SEQ ID NO: 9761 - protein, 631 aa, Solibacter usitatus
MCGIAGYALIDQSAQRARVQAMCDQIRHRGPDDEGVHVDRNCAIGMRRLSIIDLSTGHQPMCNEDGSVWIVFNGEIYEYKELRAELIAHGHQFRTASDTETLLHLYEEEGVEGLRRLRGMFAFAIWDARRNRLMLARDPFGKKPLYYAVLPTGIYFGSEISCLREAGVPLEPDPEALRLYFQFNYIPDPMSAYRAVRRLPAGSWLTWENGQVRQGRYWQPPVPAAQPVAGLSHADAVVKVREKFDEAVRIRMIADVPLGAFLSGGIDSSSIVASMAMQSREPIKTFSIGFEESEFNELPYAAMVARKYGADHHEIVVRPDSIGIIRKFARHFGEPFADASAIPTYIMSEFAARYVKVALSGDGGDELFGGYTSLRQVQKLAAFDRVPQAVRLMMSWASSRMPYSAYGKNFLHMLGRRSALDRYFAFNYAPFHMRSKLLRPDWMLPAESGFLARALPDCILPEDAGALSQVMYFEGTANLTGDMLVKVDRMSMAASLEVRCPLLDHELAELAATIPHAWKVVGGQGKRILLDALGDRLPPELLNRPKTGFGVPLVDWFRTSLRELLWDTLTAERFLAHNIVAPEFLRTLLEEHDSGRRDNSQWLFTLLVLALWFEDIEQPLASPVPARVEGA

SEQ ID NO: 9762 - protein, 150 aa, Silene latifolia
FLKVAPEGSYDTVIVDSSGPIGPAKELFEKPFFESVAKALRPGGVVCTQAESIWLHMHIIENIVSSCREIFKGSVNYAWTTVPTYPSGVIGFMVCSTEGPAVDFKNPVNPIDKTEDEKRPLKFYNAEIHSAAFCLPSFAKRVIEAKAKST

SEQ ID NO: 9763 - protein, 493 aa, Atriplex lentiformis
MARLSSLTTLFLVTICYLSVTTSAFAPRDYHDALQKSILFFEGQRSGPLPSSQRLNWRGDSGLSDGSSYHVDLVGGYYDAGDNVKFGLPMAFTTTMLAWSVIEFGSSMHDQLSAAKDAVRWGADYLLKAAATPGTLYVQVGEPNLDHQCWERPEDMDTPRNVYKVSTQNPGSDVAAETAAALAAASIVFKDSDPSYSSKLLHTAIQVFDFADKYRGSYSDSLNSVVCPFYCSYSGYQDELLWGAAWIHKASGDSSYLSYIQSNGHILGAEDDDFSFSWDDKKAGTKVLLAKDFLQDRVEQFQVYKAHADNFICSFIPGANDYQAQYTPGGLLFKQSDSNLQYVTTTSFLLVAYAKYLGKNGDITTCGSTVITAKKLISVAREQVDYILGDNPATMSYMVGFGNKYPQHIHHRASSLPSVHAHPSRIGCNDGFQYLNSGSPNPNVLVGAILGGPDSGDKFTDDRNNYRQSEPATYINAPFVGAAAFFSAYNERY

SEQ ID NO: 9764 - protein, 497 aa, Ashbya gossypii
MFIRRLHTSSRRLTCGEALRACQQTGARSANGQLMLSQHVQEFDPEMYDILTKERSRQKRSITLIPSENFTSVAVMNLLGSEMQNKYSEGYPGQRYYGGNQYIDMAESLCQKRALELYGLDPAKWGVNVQSLSGAPANLYAYSAIMEVGDRMMGLDLPHGGHLSHGYQLQNGNKISYISKYFQTMAYRVDPATGLVDYDTLSETSKLFRPKVIVAGTSAYARVLDYKRFREIADACGAYLLSDMAHVSGLVAAGVHPSPFEYSDIVTTTTHKSLRGPRGAMIFYRKGIRKVTKKGTEIMYDLDKRINFSVFPAHQGGPHNHTISALAVALKQAATPEFKNYQTAVVENAKVFGEELSKRGFSLVSGGTDTHLLLIDLSPMGIDGSRLETILERLNIAANKNTIPGDKSALYPSGLRVGTPAMTTRGFGPAEFGRVAAYINEAVKLAIGLKSQEPVDAKDAKTRLAHFKSFCAESEQVTKLANEVADWVAQYPVPGEL

SEQ ID NO: 9765 - protein, 416 aa, Unknown
  Azoarcus sp. EbN1
MFSAQDTLAKVDPELWTAIQAENRRQEDHIELIASENYVSHAVMEAQGSQLTNKYAEGYPGKRYYGGCEHVDVAEQIAIDRIKKLFGAEAANVQPNSGSQANQAVLMAFAKPGDTIMGMSLAEGGHLTHGMPLNMSGKWFNVVAYGLDEKEEIDYDAMERLAREHKPRIIIAGASAYSLRIDFERFAKIAKEIGAIFWVDMAHYAGLIAAGYYPNPVPHADVVTSTTHKTLRGPRGGIILMKAEHEKAINSAIFPGLQGGPLMHVIAAKAVAFKEALTPQFRDYQEQVIANARVMARVLGEERGLRIISGRTESHVFLVDLRSKNITGKAAEAVLGSAHITVNKNSIPKDPEKPFVTSGIRIGSPAMTTRGFTEIEAEQVAHLIADVLDAPQDEAVLANVQAKVAELCARHPVYGK

SEQ ID NO: 9766 - protein, 891 aa, Fulvimarina pelagi
MKHANEIGRTVRTTCAYCGVGCGVLATPEGNGLVKISGDPNHPANYGRLCSKGSALGETLGLEERVLHPMIGGARADWENALDLVASRFTAAIEEHGPDSVAFYLSGQLLTEDYYVANKLMKGFIGSANIDTNSRLCMASSVAGHKRAFGSDTVPGTYEDLEKADLVVLTGSNLAWCHPVIFQRIAAAKAERPEMSIVVIDPRRTATCEIADMHLAIRADGDVALFSGLLNALAENGAIDCDYIGQHTEGFVDAMRESRSMRLRHVSERTGLGPEEIRAFYELFKRNKKVVTVYSQGVNQSASGTDKVNAIINCHLATGRIGRPGMGPFSVTGQPNAMGGREVGGLSNMLAAHMELGNAEDRARVKSFWNAPRIAEKSGFKAVELFEAAADGKIKALWIAGTNPVVSMPDADAVKRALEACPFVVVSDVIAETDTTPFADVLLPAAAWGEKNGTVTNSERRISRQRPFLPLPGEARPDWTIFADVARRMGFAGFDYRSASEVFDEHARLSGVENDGARDFDIGGLAGLSEAEYDLMAPVQWPLPAGRVARETRFFAKGGFYHGDRRARFVAVKPPKPEETADFTLNTGRVRDHWHTMTRTGLSARLSAHIAEPFAEIHPADAERLGIAAADLVEVASPQGSAVVRALITDRQRPGNVFVAMHWTSRYAPSARIGAVAHSATDRASGQPALKSTAATVKRFEAAWHGFAILTSRPDLDAIGRHAAYTATARTEGGWRLELAGANPLGDAKAFALALFGEPEADIVGYRDARAGTERFAVFFAEKLLGALYLSPQPVAVSRNWAVAQLGLTDGAVGSRAELLAGRGPADRPDPGPIVCSCFAVGVNQISALVVSGEAVSVEAVGKALNAGSNCGSCRSEIKGIIENVRVKVPG

SEQ ID NO: 9767 - protein, 179 aa, Symbiobacterium thermophilum
MQQDIERVLITEEQIREKIKELGAQISEDFRGKDLVVVGILKGAALFCADLFRAISIPAELDFMRITSYGAATKSTGVHRVLLDLDYTLEGRHVLIVEDIVDTGLTIKFLKEYLSQRGPASLSVAALLDKPSRRKVEVTIDYRGFEVPDFFVVGMGLDYAEKYRNLRDICILKPEIYKS

SEQ ID NO: 9768 - protein, 322 aa, Pseudoalteromonas tunicata
MSKIFNDNSLTIGNTPLVKLNRVTTGNVFAKIEARNPSFSVKCRIGASMIWEAEKSGQLTKDKEIIEPTSGNTGIALAFVAASRGYKLTLTMPSTMSLERRKLLKALGANLVLTEGPKGMKGAIEKAQEIQQAEPNKFVLLQQFENPANPKIHFETTGPEIFEATDGNIDFFVAGVGTGGTITGVSRYLKLEKGLAVKAIAVEPVDSPVISQKLAGQEIKPGPHKIQGIGAGFIPGNLDLEMLDGVEQVSNEEAIATAHRLMKEEGILAGISSGAAVAAAIRIAEKPENAGKNIVVILPSSAERYLSSPLFSEEFSDQELVQ

SEQ ID NO: 9769 - protein, 487 aa, Oryza sativa
MEMEMEDNKAPSPPSPMESDVAGEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKGISYATAKKKKGMTVGFVTFENIEQLKNAIEVLTENQSGGKEIKIADANRRSHQKLHTEKPVSDNGVTTENGTSVDVPPGETSAPEAAISNKKSVRDAVTPLAHMSYNDQLEHKKNSVAQILKRLTRNARKACPTGIPLPDWVFKSKEIGGLPCKLEGILESPVINGYRNKCEFSVGFSLEGKKTVGFMLGNFREGVTAVEEPVDCPNVSEISCKYALMFQDFLQSSSLPVWNRVDNCGFWRQFTVREGRCQAQAVAQNAENQISEVMLIVQVCSTGVDDAVMKDEFDKLTVALQQGAATCSPPLPLTTIVVQVSLSSLSGSKTSIYSFLHCLNISACLN

SEQ ID NO: 9770 - protein, 211 aa, Photobacterium profundum
MSPNKHNLIAPETALIGRATSITPSLPHAVNGTILNDEKPSNYSEIIIGMGCFWGAERLFWNLPGIYSTAVGYSGGFTPNPTYEEVCSGKTGHSEVVRIIYDPLIISLEQILTLFWESHNPTQGMQQGNDIGTQYRSVIYTTTPNQLTYAQHSKQCYQQSLEQQQLESPITTEIEPAGTFYFAEDYHQQYLVKNPNGYCGLGGTGVCFIPL

SEQ ID NO: 9771 - protein, 542 aa, Clostridium thermocellum
MSMFCYQCQETAGGKGCTVRGVCGKNEEVAKLQDLLLYTVKGISYIVTKGNIDAAKLGNTNHEVLSSLFMTITNVNFDDGSIEKQIRKMLAVRDEMKKSVQAEGLHDAAVFSVDSRESMLKKADSVGVLSTQNEDIRSLREMITYGVKGMAAYAEHAKNIGKEDKEIYSFIYEALAATLDDSLSVDDLFALTLKTGEYGVKVMALLDEANTSRFGNPEITEVNIGVRKNPAILVSGHDLTDLEQLLEQTKGTGVDVYTHGEMLPAHYYPAFKKYDNFVGNYGNAWWKQVEEFESFHGPILFTTNCIVPPRSEEVRRRIFTTGSAGFPGCKHIEADENGKKDFSEIIELAKTLPAPDEIETGSIVGGFAHNQVMALADKVVEAVKSGAVKKFFVMAGCDGRMKSRSYYTEFAQNLPKDTVILTAGCAKYRYNKLGLGDIGGIPRVLDAGQCNDSYSLAVIALKLKEVFGLDDINKLPIAFNIAWYEQKAVIVLLALLYLGVKNIHLGPTLPGFLSPNVAKVLVEKFGIAGIGTVEDDIKLFMS

SEQ ID NO: 9772 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 9773 - protein, 887 aa, Clostridium thermocellum
MRLVNSLGRRKILLILAVIVAFSTVLLFAKLWGRKTSSTLDEVGSKTHGDLTAENKNGGYLPEEEIPDQPPATGAFNYGEALQKAIFFYECQRSGKLDPSTLRLNWRGDSGLDDGKDAGIDLTGGWYDAGDHVKFNLPMSYSAAMLGWAVYEYEDAFKQSGQYNHILNNIKWACDYFIKCHPEKDVYYYQVGDGHADHAWWGPAEVMPMERPSYKVDRSSPGSTVVAETSAALAIASIIFKKVDGEYSKECLKHAKELFEFADTTKSDDGYTAANGFYNSWSGFYDELSWAAVWLYLATNDSSYLDKAESYSDKWGYEPQTNIPKYKWAQCWDDVTYGTYLLLARIKNDNGKYKEAIERHLDWWTTGYNGERITYTPKGLAWLDQWGSLRYATTTAFLACVYSDWENGDKEKAKTYLEFARSQADYALGSTGRSFVVGFGENPPKRPHHRTAHGSWADSQMEPPEHRHVLYGALVGGPDSTDNYTDDISNYTCNEVACDYNAGFVGLLAKMYKLYGGSPDPKFNGIEEVPEDEIFVEAGVNASGNNFIEIKAIVNNKSGWPARVCENLSFRYFINIEEIVNAGKSASDLQVSSSYNQGAKLSDVKHYKDNIYYVEVDLSGTKIYPGGQSAYKKEVQFRISAPEGTVFNPENDYSYQGLSAGTVVKSEYIPVYDAGVLVFGREPGSASKSTSKDNGLSKATPTVKTESQPTAKHTQNPASDFKTPANQNSVKKDQGIKGEVVLQYANGNAGATSNSINPRFKIINNGTKAINLSDVKIRYYYTKEGGASQNFWCDWSSAGNSNVTGNFFNLSSPKEGADTCLEVGFGSGAGTLDPGGSVEVQIRFSKEDWSNYNQSNDYSFNPSASDYTDWNRVTLYISNKLVYGKEP

SEQ ID NO: 9774 - protein, 173 aa, Oryza sativa
MSRSVEPLVVGRVIGEVIDSFNPCTKMIVTYNSNKLVFNGHEFYPSAVVSKPRVEVQGGDMRSFFTLVMTDPDVPGPSDPYLREHLHWIVTDIPGTTDASFGREIISYESPKPSIGIHRFVFVLFKQKRRQAVVVPSSRDHFNTRQFAEENELGLPVAAVYFNAQRETAARRR

SEQ ID NO: 9775 - protein, 417 aa, Pseudomonas aeruginosa
MFSRDLTLARYDAELFAAMEQEAQRQEEHIELIASENYTSPAVMEAQGSVLTNKYAEGYPHKRYYGGCEYVDIVEQLAIDRAKQLFGADYANVQPHAGSQANAAVYLALLSAGDTILGMSLAHGGHLTHGASVSSSGKLYNAVQYGIDANGLIDYDEVERLAVEHKPKMIVAGFSAYSQVLDFARFRAIADKVGAYLFVDMAHVAGLVAAGVYPNPVPFADVVTTTTHKTLRGPRGGLILARANEEIEKKLNSAVFPGAQGGPLEHVIAAKAVCFKEALQPEFKTYQQQVLKNAQTMAQVFLDRGFDVVSGGTQNHLFLLSLIKQDITGKDADAALGRAFITVNKNSVPNDPRSPFVTSGLRIGTPAVTTRGFKEAECRELAGWICDILENMGDESVVNGVREKVKAICAKFPVYGN

SEQ ID NO: 9776 - protein, 729 aa, Legionella pneumophila
MAKITKEIVFGNHKLILETGEVARQADGAVMASMNGTQVLVTVVWKKDGGESNDFFPLTVNYQEKFYAIGKIPGGFNKREGRPSDNETLISRLIDRPIRPLFPDNFFNEVQIIATVLSLNPEVSPDIIAMIGASAALSISGVPFNGPIGAARVGYKDGVYLLNPSRKEQEESKLDLVIAGTKDAILMVESEAQELSEDIMRGAMLYGHEMMKNVIKSIEELARDVGKSKPEWKAPEIDTVLKARINDVARNEVEAAYLIKDKQQRYQRLGELREQTISALLAENDELNADVIANMFGELERSIVRNRILDGEPRIDGRDHRTVRPISVRTKFLERTHGSCLFTRGETQAIVVATLGNERDAQILDGISGESRDRFMLHYNFPPYSVGETGQVGSPKRREIGHGRLAKRALMAVLPDANEFPYVLRIVSEITESNGSSSMATVCGTSLALMDAGVPLKAPVAGVAMGLIKEGDRYAVLTDILGDEDHLGDMDFKVAGTEKGITALQMDIKISGITNEIMERALEQALEGRTHILGVMNNALAEHRTELSQHAPRITTMKVAEDKIRTIIGKGGATIKGLIESTGVSIDIDDSGVIQLFSPDKIALEEAQKQIKALIAEIEVGQTYQGKVSKIVDFGAFINLLPGKDGLLHISQICAARTQKVEEVLQEGQEIEVFVAGIDKQGRVKLEWKDKPQAEAKEVEDAPVSATFLTMEEQSEEINSGNKISEEEE

SEQ ID NO: 9777 - protein, 742 aa, Clostridium thermocellum
MKKMGLGRFSNKFVLTVLLFFLTAVLLPSSSFESKVQAASSPRYGGAYYNYGEALQKAILFYKANRLGDLPDDYILPYRADAAMTDGQDVGLDLTGGWADAGDGIKFTHPMSYAAGQLGWAVYEYRQAFEKAGLLDDILDEIKWATDFFIKAHPEPNVLYYMCGYNDSDHSVWVPHELLDYVTDRKSFVLNPSTPGSDVAGQTAACLAIASIIFEPTDPEYAETCLTHAKQIFEFGDKYRGKNPLDVLYPSGGYLDDLAWGAVWLYIKTGDSTYLEKAKSFLPVTSLGGGHTHCWDDVSYGAALKIAQLTHDEGYAAMVEKNLDFWLPGGGITYTPGGLAWLSPWGSLRYASTAAFLAFVWADDPTVGTPSKKETYRAFAEKQINYILGDNPRKGSYVVGFGENSPKHPHHRTAHGSWVSMLEVPSFHRHILYGALVGGPSSDDSWEDDISDYTRNEVATDYNAGFVGALAKMYDMYGGEPLENWPQPEDFRAPEDDIVEYFCRGWIIYEGYGTLNLLLQVNNRSGWPPTMKDKLSVRYFMDLTEVFESGGTVDDVQISLGQNEGAKLIGLKHYRDNIYYFTVDFTGTMIMPAEWEMCEKDAHVTIKYRDGITGSNENDWSYQNLRKDPDYDATSFAGLTPYIPVYDNGVLLWGEEPPAGGDDPGSSPPPTPTEPVIVYGDLNGDGNINSTDFTMLKRAILGNPAPGTNLAAGDLNRDGNTNSTDLMILRRYLLKLIGSLPI

SEQ ID NO: 9778 - protein, 559 aa, Unknown
  Nostoc sp. PCC 7120
MRKLTRWAFPNLWRRSLTDQRSSQPQSHSIAFFSVLLALILTLLLWQIQRLNSIYPPFLAAVMVSSWYGGFNSGLLATFLSAVVCSYFLLHPFYSLAVSGFSVVGLLQFVLVGLLISSLNSALRQARSQAQMNARVAQQNYERLLQSQYNLRRSEERYRLLVEGVTNYAIFMLDSNANFTTWNIGAERILGYQEAEIIGQPFELIFAPEAIERGQPQQVLKQALTEGFSRENRWHIRKDGTFFWAHCLITPLRDENGNLRGFSKIMQDITERKQAEEEKEQLLLREQAARAEAEAANRSKDDFLAIVSHELRTPMTAIIGWAGMLQTGALDEARASLALETIERNANLQMQLIEDLLDISRIVRGELSLSIDLVDLVEVITDAIEVVQSLADNKGIQIKSRPDTSIDKIWGDSDRLLQVVLNLLTNAIKFTPNGGRIEVCLSKELGTGDWGLGNRGDETNVSCPIPHYAQIQVIDTGQGISADFLPHIFERFRQADSSHTRSNKGLGLGLAIARHLVELHGGTIQAQSQGIGQGATFTVKLPITEESRGVNTIQHNHHC

SEQ ID NO: 9779 - protein, 302 aa, Thiomicrospira crunogena
MYKTLMDTVGNTPLVKIQRMVNPNTNSVVLAKLEGNNPAGSVKDRPALNMIVQAEKRGEIAPGDTLIEATSGNTGIALAMVSAMLGYRLKLIMPDNMSMERRASMAAYGAELILVSKESGMEGARDLAQRLQAEGQGKVLDQFANPDNPLAHYHTTGPEIWRDTEGQVTHFVSAMGTTGTIMGTSMFLKEQSDAVQIVGVQPTEGSSIPGIRRWPKEYLPEIYDDRRVDRVIDLSQDVAEDTMRSMATQEGIFAGVSSGGAMAAALQLAQEVENATIVTIVCDRGDRYLSTNVFPTGHVTHG

SEQ ID NO: 9780 - protein, 558 aa, Nostoc punctiforme
MATFTVGDYLLLRLEQIGIKHIFGVAGDYNMEFLDYIVNHNGIELIPTCNELNASYAADGYGRLNGIAALITTFGVGELSAINGVAGAYAEHVPVVAITGAPATKIQALGSLVHHTLGTGDFSMFARMYEQVTVAQAYLTNENATTEIDGVLGICLLKKLPVYISIPMDVALTEVSAPSDSFIPPVFQSDGATLAEIVDVCVNILEKASQPVILADIGVARYHLHEQLRKLLTATGYPYATMNMGKGLLEETHPQFIGIYNGAASEESVRKRIEQADCVLTIGALMTDFNTGKFSAKLDPSQTIEVHGQYVKVKHALYNNVAMADVLSALSQRLQRRDPQTLNFKSATENLDAGFITPIEGGSSAPITQQYFWHRFAHFLQEDDIIVAETGTCLFGASIVPLPKGATFVGQVLWGAIGYSVASLLGCALAKPTAGIAASQRRSILLVGDGSFQMTAQELSTILRYNLKPIIFLINNDGYTIERDIHGERMPYNDIQPWNYHQLPKVFGGNGWGIKVSTESQLDKALQTAQQNHDQLAFIEVVMDKMDSPEVLLKMLQQ

SEQ ID NO: 9781 - protein, 435 aa, Bradyrhizobium japonicum [sequence omitted]

SEQ ID NO: 9782 - protein, 221 aa, Thiomicrospira crunogena
MAKKMELISFKLCPFVQRAVIVLKKKNIDFDITYIDLGNPPDWFKDVSPLGKVPVLKVGNEVLFESSVIQEYVDEVTPPSLHPDDPLLKAKNRAWMSFGDELNVAMFKMGHAKSESAFEEIRDGMLKKLHQLEAVHSGKAFFNGADFCLIDAAYAPFFMRLDLMSLACGFSFLDGLPKMKRWSDNLLAEECVKSSVVTELPQMYVGMLKNIDGSYLSTLCQ

SEQ ID NO: 9783 - protein, 430 aa, Unknown
  Synechococcus sp. RS9916
MSDRASAPINAALADADPAIAALIGQEQNRQETHLELIASENFASRAVMQAQGSVLTNKYAEGLPHKRYYGGCEHVDAIEELAIERAKELFGAAWANVQPHSGAQANFAVFLALLQPGDTIMGMDLSHGGHLTHGSPVNVSGKWFNVVQYGVDQATQRLDMEAIRKLALEHKPKLIVCGYSAYPRTIDFPAFRAIADEVGAYLLADMAHIAGLVAAGVHPSPVPHCDVVTTTTHKTLRGPRGGLILCRDAEFAKRFDKAVFPGTQGGPLEHVIAAKAVAFGEALTDDFKAYSRQVVANAQALAKQIQARGIDVVSGGTDNHVVLLDLRSIGMTGKVADLLVSDVNITANKNTVPFDPESPFVTSGLRLGTAALTTRGFDTAAFAEVADVIADRLLNPNDDAVQARCKERVLTLCSRFPLYAGAAAVPALA

SEQ ID NO: 9784 - protein, 74 aa, Unknown
  Populus tremula x Populus alba
CMPGMTGYELLKKIKESSSFREIPVVIMSSENVMARIDRCLEEGAEEFIAKPVKLSDVKRLRDYYMASREVRSV

SEQ ID NO: 9785 - protein, 317 aa, Nitrosomonas europaea
MTTTRHCKLLILGSGPAGYTAAIYAARANLNPVLITGMAQGGQLTTTTDVDNWPADVAGVQGPELMERFLKHAERFQTEVIFDHIHTANLSEKPFELIGDQGTYTCDALIIATGASAKYLGLPSEEAFMGKGVSACATCDGFFYKNQDVAVIGGGNTAVEEALYLSNIARKVTVVHRRDKFRSEKIMIDKLMGKVKSGKIELALDHVLEEVKGDDSGVTGIRIRHVRDDTARDLELQGVFIAIGHHPNTDLFQGQLEMKNGYIITQGGNEGNATATSIPGIFAAGDVQDHIYRQAITSAGSGCMAALDAERYLEKSA

SEQ ID NO: 9786 - protein, 112 aa, Actinobacillus pleuropneumoniae
MKKIEAIIKPFKLDDVREALTDAGITGMTVTEAKGFGRQKGHTELYRGAEYAIDFLPKIKLEIVVADDQVDACIEAIIDTAQTGKIGDGKIFIYDVERVIRIRTGEENEDAL

SEQ ID NO: 9787 - protein, 178 aa, Rhodobacter sphaeroides
KPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGITGDEANALASMGIYVFK

SEQ ID NO: 9788 - protein, 317 aa, Actinobacillus pleuropneumoniae
MTVKHAKLLILGSGPAGYTAAVYAARANLNPVLVTGMQQGGQLTTTDEIENWPGEYEHTTGTGLMDKMLKHAEKFNTEIVFDHINSVDLSKRPFTLKGDINTFTCDALIIATGASAKYLGLPSEEAFKGKGVSACATCDGFFYRNKPVAVVGGGNTAVEEALYLANIASEVHLVHRRDSFRAEKILLGRLQKRVEEGKIILHTDRTVEEVLGDNMGVTGVRLASTKDESKEEIKVDGFFVAIGHAPNTAIFDGQLELDNGYIKVKSGLEGNATATSVAGVFAAGDVMDHNYRQAITSAGTGCMAALDAERFLDALEA

SEQ ID NO: 9789 - protein, 168 aa, Rhodopirellula baltica
MTERAVLAGGCFWGMQDLIRKLPGIESTRVGYTGGEVPNATYRNHGNHAEGIEILFDPEKTSYRQLLEFFFQIHDPTTPNRQGNDRGPSYRSAIYYVDEEQKQIALDTIADVNASGLWPGKVVTEVEPVSDFWEAEPEHQDYLEKVPNGYTCHFPRPNWVLPKRAATE

SEQ ID NO: 9790 - protein, 565 aa, Schizosaccharomyces pombe
MTVSLNTMMGVDGLEDQEQLREIRNCLLKCISECSERGLVYAVRWAAEMLNGMNPIEMEHIPFSSTPTGEFDLDPDMANEKLLEVEEKNIYLLAKSYFDCKEFERAAYTLQNCKSSKSIFLRLYSKYLAGEKKSEEENETLLNTNLTLSSTNREFYYISEVLESLHYQGNKDPYLLYLSGVVYRKRKQDSKAIDFLKSCVLKAPFFWSAWLELSLSIDSLETLTTVVSQLPSTHIMTKIFYVYASHELHQVNSSAYEKLAEAEIIFPNSRYLKTQRALLTYDSRDFDEAESLFENILTNDPYRLDDMDTYSNVLFVLENKSKLGFLAQVASSIDKFRPETCSIIGNYYSLLSEHEKAVTYFKRALQLNRNYLSAWTLMGHEYVELKNTHAAIESYRLAVDVNRKDYRAWYGLGQTYEVLDMHFYALYYFQRATALRPYDQRMWQALGNCYEKIDRPQEAIKSYKRALLGSQTNSSILVRLGNLYEELQDLNSAASMYKQCIKTEETEISPETIKARIWLARWELGKKNYREAELYLSEVLNGDLELEEAKALLRELRSRMEHSYD

SEQ ID NO: 9791 - protein, 386 aa, Symbiobacterium thermophilum
MDRLAKRDYYEILGVPRNATEAEIKKAFRNLARKYHPDANKDDPDAAEKFKEINEAYQVLSDPEKRARYDQFGHAAEQMGGAGGNPFEGFGGFGDFGGFSDIFEMFFGGAGRQRNPRGPVRGADLEYELELTLKEAAFGCTKELRVPRVEDCDTCHGSGARPGTQPVTCPKCGGTGQVQMTQHTVFGRFVNVMTCDRCRGEGKIVESPCPTCRGRGRVQKTQRVEVKVPGGVETGTRLRMPGYGEAGERGGPPGDLFIVMRVRPDRRFRREGDDLFTTTEISFIQAALGTEIEVETLDGPELIKIPEGTQPGDTIRLKGKGTHRLRGSGRGDLHVVISVKTPGRLSERERELLLEVAALRGERVAGMTENKEKSFLKKMKDALGGR

SEQ ID NO: 9792 - protein, 447 aa, Desulfotalea psychrophila
MEKSMKKSDIIIIGGGAAGIVAVNTIHALNPGLSLTLIKDEEALVNRCSIPYGMGREKGIENYIVPNSHITATGADLVIGRVEEIDTRKKEVILQTGESYAYGQLLLATGSRPILPQLPGIESERILVVRSLGDLERLRVSVRSGRRALVVGGGYVGVELATELQQLGLRVSLVEMRERILLATTEPEFITEVEQMLEGRGIHLMTGRQVTAFEDDGRERVGVRLDDGTVLEVDLVVFSAGVVPNMELAQRAGIATSSLGIITDKSLRTSVRDVFAAGDCAEKQAFVTGQPTRGDFGTNAVFMGSVAGQNMAGMAASFMGTINANVSMVYDTSFGSAGLTEAGARQAGIDVVVGFSETLDKYPMIDGAAPLRTKLIFTRSNGVLIGGSVMKEGRGVAPHIDLISLAIQKRTTIEEFLCHQYATHPQLAAVPTENSCLLATMAAMASR

SEQ ID NO: 9793 - protein, 625 aa, Chlorella sorokiniana
MVDDSAHGAKVAKGSPTFGDGAYSMGASTPRFSVPVDSENKSKVLKIWSFQRPHHLSFHLSWMSFMLAFFATFAAPPMMPVIRNNLDLTKPDIGGASIAAVTGAVFSRILLGAVCDSYGPRYGHGVLQLLCSAATFAMASITNAAGFIICRMVIGFSLATFVPCQFWCSVMFNAKIVGTANAVAAGWGNMGAGLTHLIMPYIFTGMASHQPDFIAWRCAYFVPGFAHIIIGLLVLMFGQDLPDGNYGALRKAGKKDKAKTHMELLVAVKNYRTWLLVLNYGYCFGVELTVDNNISPYLYDQFGIDLHLAGVLGAVFGLSNLFARALGGLASDYASRRFGMRGRLWTLWIVQSLGGVCSILMFYTSHSLGATMAIVVCWSIFVPMGCGATYGIAPFITRRGLGVATGLIGAGGNTGSAITQALFFTGTSMTTTEGFKWMGVMILAVTATLVLMHFPMWGGMLTRANPEVTEEEYYSRDYTAAEKEQGLHRAILNWASESRSNRGFKEQLAKLSADLTAAAPTTAAAVAQHAERACSLLQAACCRNCPLQAPLHPTLQIAPQLYHHRHPPPLSALTKPETSPFVALVCAPFIACFAGRPATPCSYLVSSSPVHQWYVPLTLLTRHFP

SEQ ID NO: 9794 - protein, 256 aa, Brucella suis
MALPDFSMRQLLEAGVHFGHQTHRWNPKMAPFIYGERNNIHILDLSQTVPLLNSALKVVSDTVARGGRVLFVGTKRQASDIIADAANRSAQYYVNARWLGGMMTNWKTISNSIQRLRKLDELLAGEAQGFTKKERLNLEREREKLDRALGGIKDMGSVPDLMFIIDTNKEAIAIQEAKRLGIPVVAVIDSNCDPDQIDYPIPGNDDAARAIALYCDLIARAALDGIARQQGAMGIDVGAQVEAPVEPALQAPAEGA

SEQ ID NO: 9795 - protein, 328 aa, Unknown
  Azoarcus sp. EbN1
MRIAVFGAGAWGTALALAFSARHDVVLWGRDAGHIDTLAATRHNERYLPGVPFPEELALTADFAAAARAADLHLVVTPLAGLRAAVGELNTLQPDTPLIWACKGLEAGTGKLPHEIVAEELGPAARCGVLTGPSFAAEVARAMPTAVTLAATDPAFARRWVPALHQPRLRIYANSDLVGAEIGGAIKNVLAIAAGVSDGMGFGLNARAALITRGLAEIARLAEALGGRPETLMGLAGMGDLILTCTGDLSRNRRVGLALAQGKTLAEILGELGHVAEGVSTAREVVKLAARHDVEMPLCEAVDTLLHDARLGPREVVEQLLSREPRRE

SEQ ID NO: 9796 - protein, 258 aa, Desulfotalea psychrophila
MKISAIQLAVVEDDKAASIARARTEIELCRESDLIILPEIWNTGFMNFAAYRSLAEERKGPTLSMVREMAVKTSSFIHSGSFVEKIEDKYYNSSYLISPDGDILGNYRKIHLFGFASLETEILSAGQEISVINTKLGIIGMATCFDLRFPELFRKMVDQGTEIFLICAAWPLARLADWALLNRVRALENQALLISANARGMSKGVQLAGNSMIVGPNGQILAQADDMDNSISAEINLNAVKEARCSFPALSSRKTFLN

SEQ ID NO: 9797 - protein, 191 aa, Brassica napus
EYKGHADNFICSVIPGAPFSSSQYTPGGLLFKMSDANMQYVTSTSFLLLTYAKYLTSARTVVHCGGSVYTPGRLRSIAKKQVDYLLGDNPLRMSYMVGYGPKFPRRIHHRGSSLPCVASHPAKVQCHEGFSILNSQSPNPNILVGAVVGGPDQHDRFPDERTDYEQSEPATYINAPLVGALAYFAHSYGQL

SEQ ID NO: 9798 - protein, 1008 aa, Chlamydomonas reinhardtii
MPHEFKTAVVWFRRDLRVDDNPALVAALAAAPNVIPVFIWAPEEEGQFQPGRCSRWWSKHSLVDLQQALAALGSRLVIRRSTDSTAALLQLVTELGAEAVFFNHLYDPISLMRDHDCKRGLTAAGVAHRTFNGDMLYEPWDVLDPNKQPYSTFDDFWNSVRAMPVPPPFPVSAPASMPAVPAAVPSMTVAEVDWFFTPEQEASSDQLKFKWKPGVGGAISELEHFLAERLTEFEHDRAKVDRDSTSRLSPWIHIGSISVRYIFYRVRQCQAEWLAAGTDRAQSCDDFLQQMGYREYSRYLAFHFPFIHERSLLGHLRACPWRIDQHAFKAWRQGQTGYPIVDAAMRQLWSSGWCHNRGRVVAASFLVKDLLLPWQWGLKHYWDAQIDADLECDALGWQYVSGGMSDAHPFSYMMDLEKEARRFDPDGEYVRRWLPALSRLPTEYIHAPWKAPASVLAAADVELGCNYPLPIITRSDAKANVDYACGVLEKSAVAPTGSESSGRYPYRAPTYPNAGGGGGASGGVDGAGSSGGNPTAAMGASGGAGPSSGTGTGGQGGAFRGRGDGGGSAPVSQQGGMLPPGVAVCVTAGTGGTQPDSRTVSGAHAGVSNSAGGVACDMPPPSHSHPRGGSSGVAAAGVGGVSGGPSSGGAAAPGATRKATAPGGAVFYHPGEASGEGHALLERILQQQRRQRGAANRQDGSGTNQPPPPVSMPGMLDAAGAAGGGGGGGGGLAGLPGVLQGLHGGAGATAAPAVAWAGRVAAGGVDDMDAVALWQQQQQLLQGGAAAFAFEQAMELLLARRRAGDGVSGFCGGDAPGRGGGDADEADGLMLEEDSEEVVSNTVDLHLSAFTGASCHRQSGTARGARAAERRLKKEAGSPEVTDGGGSAGAGCGEEDAMQCEDEEHGERGSPARRTADEEAQPPAEEGGAGSEDAGAAASEGDEAEGYGSESASEDNGGATPVEEADQMVVDGGGGGGGGGGGGGGRGGGQHKRRRSQLEGEQGDAAWE

SEQ ID NO: 9799 - protein, 132 aa, Kluyveromyces lactis
MSAKASKAPASKAPAEKKPAAKKTSSSTDPSKKRTKARKETYSSYIYKVLKQTHPDTGISQKSMSILNSFVNDIFERIATESSKLAAYNKKSTISAREIQTAVRLILPGELAKHAVSEGTRAVTKYSSSTQA

SEQ ID NO: 9800 - protein, 1003 aa, Arabidopsis thaliana
MKLFLLLLFLLHISHTFTASRPISEFRALLSLKTSLTGAGDDKNSPLSSWKVSTSFCTWIGVTCDVSRRHVTSLDLSGLNLSGTLSPDVSHLRLLQNLSLAENLISGPIPPEISSLSGLRHLNLSNNVFNGSFPDEISSGLVNLRVLDVYNNNLTGDLPVSVTNLTQLRHLHLGGNYFAGKIPPSYGSWPVIEYLAVSGNELVGKIPPEIGNLTTLRELYIGYYNAFEDGLPPEIGNLSELVRFDGANCGLTGEIPPEIGKLQKLDTLFLQVNVFSGPLTWELGTLSSLKSMDLSNNMFTGEIPASFAELKNLTLLNLFRNKLHGEIPEFIGDLPELEVLQLWENNFTGSIPQKLGENGKLNLVDLSSNKLTGTLPPNMCSGNKLETLITLGNFLFGSIPDSLGKCESLTRIRMGENFLNGSIPKGLFGLPKLTQVELQDNYLSGELPVAGGVSVNLGQISLSNNQLSGPLPPAIGNFTGVQKLLLDGNKFQGPIPSEVGKLQQLSKIDFSHNLFSGRIAPEISRCKLLTFVDLSRNELSGEIPNEITAMKILNYLNLSRNHLVGSIPGSISSMQSLTSLDFSYNNLSGLVPGTGQFSYFNYTSFLGNPDLCGPYLGPCKDGVAKGGHQSHSKGPLSASMKLLLVLGLLVCSIAFAVVAIIKARSLKKASESRAWRLTAFQRLDFTCDDVLDSLKEDNIIGKGGAGIVYKGVMPNGDLVAVKRLAAMSRGSSHDHGFNAEIQTLGRIRHRHIVRLLGFCSNHETNLLVYEYMPNGSLGEVLHGKKGGHLHWDTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELVTGRKPVGEFGDGVDIVQWVRKMTDSNKDSVLKVLDPRLSSIPIHEVTHVFYVAMLCVEEQAVERPTMREVVQILTEIPKLPPSKDQPMTESAPESELSPKSGVQSPPDLLNL

SEQ ID NO: 9801 - protein, 694 aa, Geobacillus stearothermophilus
MNKKWSYTFIALLVSIVCAVVPIFFSQNNVHAKTKREPATPTKDNEFVYRKGDKLMIGNKEFRFVGTNNYYLHYKSNQMIDDVIESAKKMGIKVIRLWGFFDGMTSENQAHNTYMQYEMGKYMGEGPIPKELEGAQNGFERLDYTIYKAKQEGIRLVIVLTNNWNNFGGMMQYVNWIGETNHDLFYTDERIKTAYKNYVHYLINRKNQYTGIIYKNEPTIMAWELANEPRNDSDPTGDTLVRWADEMSTYIKSIDPHHLVAVGDEGFFRRSSGGFNGEGSYMYTGYNGVDWDRLIALKNIDYGTFHLYPEHWGISPENVEKWGEQYILDHLAAGKKAKKPVVLEEYGISATGVQNREMIYDTWNRTMFEHGGTGAMFWLLTGIDDNPESADENGYYPDYDGFRIVNDHSSVTNLLKTYAKLFNGDRHVEKEPKVYFAFPAKPQDVRGTYRVKVKVASDQHKVQKVQLQLSSHDEAYTMKYNASFDYYEFDWDTTKEIEDSTVTLKATATLTNKQTIASDEVTVNIQNASAYEIIKQFSFDSDMNNVYADGTWQANFGIPAISTPKTRCLRVNVDLPGNADWEEVKVKISPISELSETSRISFDLLLPRVDVNGALRPYIALNPGWIKIGVDQYHVNVNDLTTVTIHNQQYKLLHVNVEFNAMPNVNELFLNIVGNKLAYKGPIYIDNVTLFKKI

SEQ ID NO: 9802 - protein, 324 aa, Dendrobium cv.
MESRSFPVINMELLEGSQRSDAMAVLRDACENWGFFELLNHGISHDLMNRVETVNKEHYRRFREQRFKEFAAKTLDSGENVVADNLDWESTFFLRHLPTSNISQIPDLDEDCRSTMKEFALELEKLAERLLDLLCEDLGLEKGYLKRVFCGGSDGLPTFGTKVSNYPPCPKPELIKGLRAHTDAGGIILLFQDDKVSGLQLLKDGEWVDVPPMRHSIVVNIGDQLEVITNGRYKSVMHRVVAQTNGNRMSIASFYNPGSDAVIFPAPELVEKEAEEKKKEVYPKFVFEDYMKLYVRQKFEAKEPRFEAMKTMDTVISSQLIPTA

SEQ ID NO: 9803 - protein, 563 aa, Unknown
  uncultured crenarchaeote
MCGIVGILSKKERNVAPLIGKMLSCMKNRGPDGMGLSTENQIVYSDTFDNPLFSQVEGHDVLGHSRLAIVGGSCGQQPFVSCDKKLILEHNGEIYNYKEIRKNLSAHHTFTTSTDSEVIVHLLEDHYQNTKGDLIEAIRRTVTQLDGIYVLAIREQSTGDIVLVRDGIGVRQIYYGESSDFIAFASERKALWKIAMSDQIKRLLPGYALVISRKEGSSNFKTTLFPISVNTKKSICEKYSILYTDIDSAVNAYGDTLVESMRKRVSDFKKIGIVFSGGIDSVIVAYLAKQMAPEVICYTSGIKGSSDILNSLEIAEKLDLKLEIEQMTESDVESTIPKIISIIEDDNMGQVEVAIPIYGAVKLAHEQGIRVMLTGQGADELFGGYSWYSKIVKKHGYEKIQGYLIEDIKLLYKETLEREDKITMSQSIELREPFLDTNLIDTVLRIDPRLNIQNNGNNYDNLGKRVHRKLAEKLGIPKEIAYRIKEAAQHGSGIHNTLNTLAMKNGFTESKVNSSYLDKLKKRELIGSSQRYGHLFEKEQIWSLEPHIQMYLENISKNILPRN

SEQ ID NO: 9804 - protein, 202 aa, Triticum aestivum
  misc_feature (35)..(35): Xaa can be any naturally occurring amino acid
  misc_feature (133)..(133): Xaa can be any naturally occurring amino acid
ARGTIVTELSNRDYDSYVLSEPSLLIYSQKIEINXLCGTTMLLLTIPRILELAEELCMPLAAATDSAGMIIFPGAQPAPHRSFSDEVDVLNRYLGHLKSGGHAYVIGDPTTPGQKRHIYYATELPEHPMATLXMCMTGLDKKKACVFFKTQADLHVFCAKEMTKLYGMCDVIPDMEVCDFDCDPCRYFMNAINGSDVCTIHV

SEQ ID NO: 9805 - protein, 161 aa, Brassica napus
MATSASALLAPTTFSTVISQKNPNSISFHGLRPLRLGGSSSALPKLSTTSGRRSSSSAVVRAELSPSVVISLSTGLSLFLGRFVFFNFQRENVAKQVPEQNGKTHFEAGDDRAKEYVSLLKSNDPVGFNIVDVLAWGSIGHIVAYYVLATSSNGYDPSFFG

SEQ ID NO: 9806 - protein, 385 aa, Triticum aestivum
MTPALKLSPAAFSVTNQRSKSALVPSVSILNTNFFASCSLRPLYLTRLDDPHTFELKPRRQLLDFRCAASAADDKESKAEVLPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPVYLSLLPIIGGCGLAAATELNFNMIGFMGAMISNLAFVFRNIFSKRGMKGKSVSGMNYYACLSIMSLVILTPFAIAMEGPQMWAAGWQKALADVGPNVLWWIGAQSVFYHLYNQVSYMSLDQISPLTFSIGNTMKRISVIVSSIIIFRTPVRPVNALGAAIAIFGTFLYSQAKQ

SEQ ID NO: 9807 - protein, 315 aa, Wolbachia endosymbiont
MKNYKFSTKVLIIGSGAAGYAAAIYAARANLEPIVVTGMQPGGQLTITTDVENYPGFVSIQGPELMEQMRFHAEKVGAKIIDDEIKSVEQLEDFNEYRFRSSGNINDYYSDAIIIASGAQAKWLGLESEKKFQGYGVSACATCDGAFFRNKVVAVIGGGNTAVEEAIFLTRFAKEVILIHRRDKLRAEKVMQDRLFKNDKIKVMWNHTVEQILGEENPKRVAGIAIKSAEIDKTQELKVDGVFIAIGHAPNTGIFKGFVEMDEQGYIITKPGTTLTSRAGVFAAGDVQDKVYRQAVVAAGTGCMAALDAEKFLES

SEQ ID NO: 9808 - protein, 477 aa, Unknown
  marine gamma proteobacterium HTCC2143
MWFRQDLRLADNPALCAACERGEIIPVYILDDQGAGQWKMGGASRWWLHFALADLNASLKQCLQIYQGDALTILGDLADQTGAATVVWNRCYEPWRIGRDATIKTSLKESGLDVQSFNGSLLWEPWQVLKKDGTPYKVFTPYYRRGCLSTVAPRRPMDPPKTLKVFVDSGDSLELDNLNLLPKIAWDESMKACWDISEAAAHARLDEFVMNELQDYREGRNFPAKQNVSRLSPYLHFGQISPNSAWYRAAEAGAFINNEQSLDTFMSELGWREFSYYLLYHWPKLPTENLQTRFDLFPWANNTDEDLSAWQQGKTGYPLVDAGMRELYSTGYMHNRVRMVVGSFLVKNLLIHWHRGEEWFWDCLVDADLASNSASWQWIAGCGADAAPFFRIFNPITQSEKFDKQGSYIRRYVPELKDMPEKYIHAPWLAPAEVLAVAGVNIGINYPEPVVDIKVSRARALEAFAVTKIQPPDAKEV

SEQ ID NO: 9809 - protein, 133 aa, Brassica napus
  misc_feature (7)..(7): Xaa can be any naturally occurring amino acid
  misc_feature (9)..(10): Xaa can be any naturally occurring amino acid
  misc_feature (12)..(12): Xaa can be any naturally occurring amino acid
  misc_feature (16)..(18): Xaa can be any naturally occurring amino acid
  misc_feature (21)..(22): Xaa can be any naturally occurring amino acid
  misc_feature (29)..(29): Xaa can be any naturally occurring amino acid
  misc_feature (34)..(38): Xaa can be any naturally occurring amino acid
  misc_feature (45)..(49): Xaa can be any naturally occurring amino acid
  misc_feature (51)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (62)..(63): Xaa can be any naturally occurring amino acid
  misc_feature (65)..(65): Xaa can be any naturally occurring amino acid
  misc_feature (82)..(82): Xaa can be any naturally occurring amino acid
  misc_feature (85)..(87): Xaa can be any naturally occurring amino acid
  misc_feature (91)..(91): Xaa can be any naturally occurring amino acid
  misc_feature (101)..(101): Xaa can be any naturally occurring amino acid
  misc_feature (103)..(103): Xaa can be any naturally occurring amino acid
  misc_feature (112)..(112): Xaa can be any naturally occurring amino acid
  misc_feature (116)..(116): Xaa can be any naturally occurring amino acid
  misc_feature (119)..(123): Xaa can be any naturally occurring amino acid
  misc_feature (127)..(127): Xaa can be any naturally occurring amino acid
  misc_feature (132)..(132): Xaa can be any naturally occurring amino acid
MASSMLXSXXGXTSPXXXTMXXPFSGLKXSAAFXXXXXGNNDITXXXXXGXXVXCMKXXXPXXKXKFETLSYLPDLTEVELXKEXXXLLRXKWIPCVEFEXAXMDLRTVSTXAHPXTMXXXXXPCGXFPCSXA

SEQ ID NO: 9810 - protein, 1307 aa, Streptomyces coelicolor
MPHSPVSPAESPAPQPGRPRPVVSRRRLLEGGAAVLGALALSASPLTAQAAVRRAAADEPPEWNDFGVFRLGTQPPHATLTPYADVEQALAGDRARSPYRLSLDGTWKFAYADRPEDRDADFHRTDVDDGDWGTIPVPSVWQLHGHDFPIYLNITYPYWGPNGQGEEPQPPAAPTRYNPVGQYRRTFTVPRDWRGRRTFLHFEGVKSAHYVWINGELAGYDEDSYTPSEYDVTDLLKPGTNQIAVEVYRYSDGDWMEDQDMIRLSGIFRSVHLYSTPAVHLRDFKLDTPLDDTYTGAELAVTASVRAYGEGGTGRYTVETQLYDARGHAVWSRPLQQPVDVGGARAGEDVTVRAAKAVPKPRLWSAEHPDLYTAVLRLRDPAGKVTETLSHRVGFREFALKDGLMRINGEPVSIRGTNRHEMHPARGTALTREDMVEDIKIIKRMNMNSVRTSHYPNNPYWLELADEYGLYLVDETNLETHGIRGEYPGDHPDWTAACVARAQNMVHRDKNHASVVIWSLGNEAGGGSTFSAMHDWIRSYDDTRVIQYEGDDRPGVSDIRSEMYDSPQRVEQRAKDTSDTRPYVMIEYAHSMGNSTGNFKKYWDVVRRYDVLQGGWIWDFVDQSLYTPVPARTLLTEAGPAGLRGEILATRGTLDRDEGLSGITVFERHDSLDLTGSLTLEAWVTPHVTGYHQPIIAKGDTQYALKQNGRTLEFFIHSEGQWITANWTVPEDWTGREHHLAGVFDADAGTLTLYVDGVERATRTTDRRPSSNTAPLALASDADNQVREFSGTVRRARVYARALGAAELASESRGPGDDGVRFWFDAATVKTSTRRPRDKTFLAYGGDWGDNPNDGAFVADGIVTADRGHTGKAAEVKRVYQAIDAARTPGGGPGAVTLTNEYLFTRLREFDGHWELVADGEVVRRGRLTRDQLDVAPRSSKDITVPVRLPGRPGPGTEYFLQLSFTTKESTPWAKAGFEVARRQLPVAADVPAVTPVRAASVPALRHEDRDREVEVTGRGFSVTVDKRTGTISSYEAKGTRLITSGPVPNFWRAPTDNDKGNGQHTRNQTWRDAGARRKVTGVIVRALGDRAVEIKVTGTLPTSVESTYGTTYTVFGNGEIKVDNTLHPGAANLPYIPEVGTMLFLPRGLDRVHWYGRGPEENHWDRNDGTDVGRYSGTVAEQWTPYIRPQENGNKTDVRWIALTDRHGVGLLASGEPLLEANASYFTPEDLSAGVRHDYQLTPRDEVVLRLNHRQMGVGGDNSWGAHTHDEFKLFADRDYAYTYRLRPLTDVRDATRASRRPTATE

SEQ ID NO: 9811 - protein, 306 aa, Unknown
  Dehalococcoides sp. BAV1
MSTLLYDVIIIGGGPAGLTAALYTGRSKLKTLVIERAFVGGQITRSEKVDNYPGFPEGITGFDLTQQMQIQAEKYGVEITSAEVNAIHKTKDHFEVVTETGGLSGRCIIICGGTERNKLEVPGEEEFSGRGVSYCATCDAPFYNDKVVAVVGGGNMAFYEALHLSEFAKKVYLIHRRQGFRADAVLMDKAKNKSNIELVLDTVVTSINGQDSIQSLSLNNLKTLKTSTLPIDGLFVAVGLQPNTTYLKGVVDMDKNGSILVNNQMETSVSGILSAGDIRSGSIRQVISAAGDGAVAALSAKRYLDL

SEQ ID NO: 9812 - protein, 1031 aa, Vibrio vulnificus
MTAFSEILQRRDWENPQSVNIHCLKAHSPLASFRDMAHARDGIHAQRQSLNGQWKFKLFDAPEQVDGQFTQADFNDAEWDEIPVPSNWQLHGYDKPIYANIKYPFDVNPPFVPSDNPTGCYRTRVSFSPEELANTQRIIFDGVNSAFHLWCNGTWVGYSQDSRLPAEFDLTSHLVAGENTLAVMVMRWCDGSYLEDQDMWWLSGIFRDVTLLSKPQHCIEDVFITPDLDACYRDGSLSIVTTIAAPETYQVQVQLFEGTQAVTEPNIARPHNRRIDERGTWNDVVFQTLHLREPKKWTAETPNLYRLVVSLLDENGTHLESEAYPVGFRKVEISEGQLKLNGKPLLIRGVNRHEHHPELGHVMTEEDMIRDICLMKQYNFKAVRTAHYPNHPRWYELCDQYGLYVCDEANIETHGMQPMSRLSSDPQWAHAYMSRYTQMVLRDKNHPSIIIWSLGNESGHGSNHNAMYAWSKNFDPSRPVQYEGGGSNTTATDIIAPMYARVNTLVADEAVPKWPIKKWISLPNETRPLILCEYAHAMGNSLGSFDEYWAAFREFPRLQGGFIWDWVDQGLSQWDENGQHFWAYGGDFGDEINDRQFCINGLIFPDRTVHPTLQEAKYCQRMITVSLQEQTQKACTLLVTNEKLFRTTDNEQLNWSLLENGQVIQTGSQVLSVEADSQTRLEIALNFTPKAQAQYHLNTDICLIEATSWAPAGHVVATEQMALRNHAGLAMPTLRTQPAPKLTQNGHAIVVSSLDEKHQWRWDSQSGLLMEWNVDGKAQMLAAPQDNFFRAPLDNDIGISEVDNVDPNAWVCRWEMAGIGQWERHCVQCESETLAHAVVVTTTFAYHFGGDVQAITQWTHTLSNDGEMLLDVDVTLADALPPMPRIGLELQLPLHQTDTPITWQGLGPFENYPDRLAAARFGLHTQTLAQMHTPYIFPTDSGLRCGTQWLQVNELAISGDFQFSVSQYAQQQLAEAKHTHDLLAQERIYLRLDHQHMGVGGDDSWSPSVHKEFQLTEKHYRYQLRFKPASR

SEQ ID NO: 9813 - protein, 296 aa, Unknown
  uncultured bacterium
MSRTRNVLAIVMAGGEGSRLHPLTDERCKPAVPFNGKHRIVDFVLSNLVNSEIYSIYLLVQYKSQSLIEHIRSSWTMTRFIPQHFVTVVPPQMRNGPEWFQGTADSVYQNIHLIESFQPDIVAVFGADHIYRMDVRQMVDFHRASEAHVSVATLPVPLSQCNQFGIVEVDAHHRIANFVEKPKNTRPMPGSSTHALASMGNYLFNADVLLDALKKAHATGHSDFGRDILPTMLQSHRLMAYDFTQNEIPGTASYEEHAYWRDVGTIDAYFDAHFDTLGATPRFRMTNRDWPIYASP

SEQ ID NO: 9814 - protein, 101 aa, Oryza sativa
  misc_feature (71)..(71): Xaa can be any naturally occurring amino acid
MAAPEVHHLFHHPIADHSFSADRSTLAVARDNVVDLYGRSGNGFKLQDELAGHDKTVTGVDIAPNSGKIVXCSQDRNAYVWEPSPSGWKPTLVLLRINRAA

SEQ ID NO: 9815 - protein, 561 aa, Oceanicola granulosus
MAQNNSMEEFEALLNESFEIDTPSEGSVVKGRVIAVEAGQAIIDVGYKMEGRVDLKEFANPGEAPEIGVGDEVEVYLRNVENARGEAVISREMARREEAWDRLEKAYADEERVEGAIFGRVKGGFTVDLGGAVAFLPGSQVDVRPVRDAGPLMGLKQPFQILKMDRRRGNIVVSRRAILEESRAEQRAEVIGNLHEGQAVDGVVKNITEYGAFVDLGGVDGLLHVTDMAWRRVNHPSEILSIGETVKVQVIKINKETHRISLGMKQLQDDPWDTVTVKYPLDSVHTGRVTNITDYGAFVELEPGVEGLVHVSEMSWTKKNVHPGKIVSTSQEVEVMVLEIDEAKRRVSLGLKQTMRNPWEVFAETHPEGTEVEGEVKNITEFGLFVGLEGDIDGMVHLSDLTWEGRGEDVIGDYRKGDVVKAKVLEVDTDKERISLSIKALDGDPFAEAVGGVKRGSVITVNVTKIEDGGIEVEYEGMKSFIRRSDLSRDRSEQRPERFQPGDKVDVRVTNIDPKTRRLGLSIKAREIAEEKEAVQQYGSSDSGASLGDILGAALKGGDDE

SEQ ID NO: 9816 - protein, 323 aa, Acidobacteria bacterium
MKIANDVTELIGKTPLVFLHKVIGGSQALIAAKLEGFNPCASVKDRIGVSMIEEAEKAGRITPGKTVLIEPTSGNTGIGLAFVAAVKGYRLIIVMPDTMSQERRVLLRAFGAELILTPGAKGMKGAIAKAEQLAKEIPDSLILQQFRNPANPKIHFETTGPEIWNDTDGKVDILISGVGTGGTITGVSEYIKPKKASFKAIAVEPTESPVLSGGAPGPHKIQGLGAGFIPEVLDTKTIDEVVQVNSEESVAMARRLAKEEGLLVGISSGAAVVAAVKVGSRPENAGKLIVVVLPSYGERYLSSILFQNLRDEVAAQQAVEVPV

SEQ ID NO: 9817 - protein, 284 aa, Arabidopsis thaliana
MTCSQTLGNNNTNKYQICEEIGRGRFGTVSRVYAPATGDFFACKTIDKASLSDDLDRACLDNEPKLMALLSYHPNIVQIHDLIDTDSTLSIFMELVHPSVSIYDRLVSSGTFFEPQTASFAKQILQALSHCHRYGVVHRDIKPENILVDLRNDTVKICDFGSGIWLGEGETTEGVVGTPYYVAPEVLMGYSYGEKVDLWSAGVVLYTMLAGTPPFYGETAEEIFEAVLRGNLRFPTKIFRGVSSMAKDFLRKLICKDASRRFSAEQALRHPWIQRAGETEERFI

SEQ ID NO: 9818 - protein, 384 aa, Pseudomonas aeruginosa
MSERAPLVIIGTGLAGYNLAREWRKLDGETPLLMITADDGRSYSKPMLSTGFSKNKDADGLAMAEPGAMAEQLNARILTHTRVTGIDPGHQRIWIGEEEVRYRDLVLAWGAEPIRVPVEGDAQDALYPINDLEDYARFRQAAAGKRRVLLLGAGLIGCEFANDLSSGGYQLDVVAPCEQVMPGLLHPAAAKAVQAGLEGLGVRFHLGPVLASLKKAGEGLEAHLSDGEVIPCDLVVSAVGLRPRTELAFAAGLAVNRGIVVDRSLRTSHANIYALGDCAEVDGLNLLYVMPLMACARALAQTLAGNPSQVAYGPMPVTVKTPACPLVVSPPPRGMDGQWLVEGSGTDLKVLCRDTAGRVIGYALTGAAVNEKLALNKELPGLMA

SEQ ID NO: 9819 - protein, 394 aa, Nitrosomonas europaea
MKTSDIHDVAIVGAGPAGLSAAYELIRTGFTPLVLERTPAVGDVWRNHYDGLRLNSGRFFSALPGSKFPLSAGGWPSRDEVVSLLETFPARGGFTVQTGIEVEKVSHDRERDIWLITSNDNRQFESRAVVIAAGANRIPIIPEWEGKNTFTGTIIHSSQFKSAQDYAGKHVLVVGSGNSAAEIASRLAKYADSVTMSVRTPPQILPKSIYGIPLIGIGVWTRYLPRALVDGLLNFLRRTMIGDLSVYGLPSPTISMSKQYAINNVVPILYGPFIDDVRSGRIKIVGPVQKISGGTVEVLSTVESALNGDQATTTLQPDIIVAGTGFRTGFPELIQVPGITDEKGRSKISGDQEFKGAPRLYFIGQINPLSGQLREIRLEAGRIARKLDKQLRAK

SEQ ID NO: 9820 - protein, 369 aa, Nitrosomonas europaea
MSQSDYYEVLGVGRDADENELKKAYRKLAMKYHPDRNAGDTKAEERFKNIKEAYEILSDPNKRAAYDQFGHAGLNGGMGGAGAQGFSDAFSDIFSDLFGMRGGGRSSVHRGADLRYNLEITLEQAARGAETQIRIPRQEVCDTCHGSGAKPGTSPKTCPTCNGHGQIRMQQGFFSIQQTCSHCQGSGKVVSDPCGDCHGAGWVKRQKTLSVRIPAGVDEGDSIRLTGEGEAGANGGQAGDLYIVIHLASHPVFQREGNHLHCEIPISFTVAALGGEIEVPTLDGHARIKVPAGTQTGKIFRLRSKGITGVRNQSTGDLLCHVAVETPVDLTARQKELLEEFESISQKDGSRHHPRAKSWMEKAREFFAE

SEQ ID NO: 9821 - protein, 169 aa, Oryza sativa
MASSATTVAPFQGLKSTAGMPVARRSNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 9822 - protein, 137 aa, Deinococcus radiodurans
MRRARQREDRMKLITAVVRPERVQQVKEALFQAGISGLTLSRVSGHGGEQELVEHYRGNRVMIEFRDKVEFRMAVSEPFVQPAIDAICRGARTGEVGDGKIFVQPLERVIRIRTGEEDSLALTPVTETRLAPLGGHS

SEQ ID NO: 9823 - protein, 135 aa, Brassica napus
  misc_feature (2)..(2): Xaa can be any naturally occurring amino acid
  misc_feature (12)..(12): Xaa can be any naturally occurring amino acid
  misc_feature (26)..(28): Xaa can be any naturally occurring amino acid
  misc_feature (33)..(33): Xaa can be any naturally occurring amino acid
  misc_feature (43)..(43): Xaa can be any naturally occurring amino acid
  misc_feature (45)..(45): Xaa can be any naturally occurring amino acid
  misc_feature (49)..(50): Xaa can be any naturally occurring amino acid
  misc_feature (55)..(55): Xaa can be any naturally occurring amino acid
  misc_feature (58)..(60): Xaa can be any naturally occurring amino acid
  misc_feature (62)..(62): Xaa can be any naturally occurring amino acid
  misc_feature (64)..(64): Xaa can be any naturally occurring amino acid
  misc_feature (67)..(67): Xaa can be any naturally occurring amino acid
  misc_feature (71)..(73): Xaa can be any naturally occurring amino acid
  misc_feature (79)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (93)..(93): Xaa can be any naturally occurring amino acid
  misc_feature (99)..(100): Xaa can be any naturally occurring amino acid
  misc_feature (104)..(104): Xaa can be any naturally occurring amino acid
  misc_feature (107)..(109): Xaa can be any naturally occurring amino acid
  misc_feature (122)..(122): Xaa can be any naturally occurring amino acid
  misc_feature (125)..(125): Xaa can be any naturally occurring amino acid
  misc_feature (130)..(130): Xaa can be any naturally occurring amino acid
  misc_feature (133)..(134): Xaa can be any naturally occurring amino acid
MXSSMLSSAAVXTSPAQATMVAPFTXXXSSAAXPVTRKANNDXTXIASXXGRVSXMKXXXPXAXKKXETLXXXPDLTEXXLXXEXDYLLRNKXIPCVEXXLEHXLVXXXHGSTPGYYDGRDXTMXKLPLXFGXXD

SEQ ID NO: 9824 - protein, 1143 aa, Eubacterium cellulosolvens
MRRKKRTATRAAACVLSLAMAFGGVSVMPANVAAAEKYDYGDALSKSLLFYQLQEAGTMSEETLSRCNWKGNSCEHDGQDVGLDLSGGWYDAGDNAKFNLPMAYSSMLLGWSYLNNPEAYKNSGQEKWMLHDLKWANDYFVKCNPDAHTYYYQVGNGGHDHAFWSAAECVEAALNTTAYASRPSYKVGDETANGGTGVTAEAASSLAVASMVFKDSDPELSEQYLEHARTLFTIANKARSEKGYTMANGYYSSFNGFWDELGMAACWLYEATGEKTYLNVAEECVPKFGTEDPGTKDQAYSWPLCWDDVHLAANLKLAEFTGKKEYYEILEKNIDFWIGRISGSHTITYSPKGLAVCDTWGSARYACNEAFLCFMYAELPDADAAYKKDATKFAEQQINYVLGDGGHSYQVGFGKDYPVNPHHRTAHGSWLGELTKLPKTNRHLLVGALVGGPASADDDDYEDTRSNYQTNEVACDYNAAFTGDLAIMYDKYSEGKRAEDASAIETPDGEEYLVTGLIQSQNSSDSGSSVELMIHFENRTAWPAVPTDSLVVRTYLDISDVLEKGYKPSDIKTSTNFAQGSAVISELKPTGKNGIYYCDLDLTGTYILPAGESLNNKEFTYKITAPCKWKYTNSPSLKDLLKTDYNHQADPVNIAFYNRGVLVHGQEYSGSGAATPTPTPRPTESAGGEDPVPEGDYGELEGTKIPGMTQDGKIQIFFKDDTGKYLDEHACVEGEAVEPAAWIISNTYHDKNGWSGEAERYEFIGWRSTLNGRYYASDKIPAATEPCSYYAIFRDTEAPATPTPTKKPTVTPKPTATAKPTVKPTATPKPTATVKPTTKPTATPKPTATPTKAPTQKPGKATVKIVGKNLELQGKIGAAVYADVTGVNAEDVYVVTTVNGEEISSEVEAYDDGLTVTTFVKPKELHDEITLEFRNAADDSVIKLKDGSTSLSYSVADIAKLYQSKTYSKETRELAEAIVNYGSYAQKLLKYNTSSAKVTDTLSDVTKDDVADYKAVTSGKVAGLSYMGPGLTLNADTVLDVYFRISDGYDLDDYSFTVDGKKIKPVDAGSGYCYVEIEGIKAKDLGKVYNVSVKKGSSTFTVKASVLSWSETVLGGKTGDAATVNMAKMVYRYSEKATAYFEK

SEQ ID NO: 9825 - protein, 418 aa, Mycoplasma mobile
MKKINLKDKEIEKIINNEQQRQEEHIELIASENYVSKDVLEATGSILTNKYSEGYPGARYYDGCEFVDQIETLAIERLKKLFNVKFANVQPHSGSSANSAAIAALVKPGGKILGMSLDAGGHLTHGYKISFSGTFYDPYFYGVNDEGLLDYDVIEKLAEKIKPELIICGASNYSRTIDFEKFSKIAKKVGAFLLADIAHIAGLIIADLHPSPVGHADVITSTTHKTIRGARGGIIMSNDETLMKKIDRWVFPGYQGGPLVHVIAGKAVAFGEALTPQFKKYQQQIISNAKAFSEEFKKVGTKIISGQTDNHLFTIDVKSSFNISGKEASELMHSINITANKNSIPNDTLGPKISSGVRMGTPAMTTRGFKEVEFKKLARIIIELLANSTSSNLESLKLKLKNEVLELTKAFPTKDYYL

SEQ ID NO: 9826 - protein, 353 aa, Glomus intraradices
MYNNNKSNTETLAKYLSLDQGGKVQAEYIWIDGDSGLRSKTRTLDFKPADVSEISEWNFDGSSTNQAPGDDSDVLLRPVAIFKDPFRGGDNILVLNECFNNDGTPNRTNHRHSCAKVMKTYTDQHPWFGIEQEYTLFESDGSVLGWPKGGFPGPQGPYYCSVGANVAFGRDVVEAHYRACLYAGVNISGINAEVMPGQWEFQVGPCEGIDMGDHLWIARFLLHRVAEDFGIIVSFHPKPIKGDWNGAGCHTNYSTQAMREEGGIKAIHAAIDKMAARHADHITVYGEDNDQRLTGRHETGHISQFSYGVANRGASIRIPRHVAAEGKGYLEDRRPASNIDPYRVTQIIVESSL

SEQ ID NO: 9827 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNFNNNAGSPIRPYKQRYLLKNRANSSTSSENPSLTPLISNLIMTAKFQKFLLMTKKKKKPDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRVKK

SEQ ID NO: 9828 - protein, 639 aa, Lactobacillus reuteri
MCGIVAFVDNEKPQIKDQLIQKMKDRIIHRGPDAEGQYVDDDVALGFRRLSFIDVKSGNQPIFNEDSSKAIEFNGEIYNFEELREELISKGHTFKTHADTEVILHGYEEWGKDVVNKLRGMFGFVIWDFKTKEMFGARDHFGIKPLYYAKMNGTFFVGSEIKAFLDHPNFKKELNKEALKPYMTFQYPVTQETFFKGVYRLPEGHYFTYKDGQFEMTQYWDENFEPEDETFDEAVNKIDEVVKNSVKAHTFADKGIKVGSFLSAGVDSSLVTALMRPDNTFSIGFDSTYDETKQARELAAKMGLKNTDEKLTNEEAFHAFPMIQYYLDEPDSNPSVVPLYFLNKLAKDNGYKALLSGEGADELFAGYIDYGFNTKVKFIRWVTDQLKKMPRERRYKFAKWLDGKHFHGQEHMYRNLAPARDTFIGQAYIFSPEEAADYLQPEFDCGPSIADILNPLFDKMEDKDIDEVAKKQYVDLHRFMPGDICLKADKMSMANSVEIRVPLLDKEVMKVAETTPTKYLFNYKDTKWAFRMAANRHLPEEWATRPKMGFPTPVRAWLREKKYYQEVRELFEQDFVKEFFDQEKLLKLADDNFEGKVDGRRKIWTIYTFLTWYKLYFIDNFKPDESGIDRAQKAATTEV

SEQ ID NO: 9829 - protein, 450 aa, Mycoplasma pulmonis
MKMLVKQIYENAKELDKSKIKIKGWVVTSRGNKKIQFIELNDGSSVLHLQLVLKSEKMDLNDIHFKTGSSIKAEGILNYTPKAEQSVELIVDKISLLAQSDEDFPIQTKKTTLEFLRTIPHLRHRSNTIKAVMLVRSSISFFIHEYFQKNDFSLVAAPIITSNDGEGAGETFIVDSEDKEPFFGNNVKATLGVTGQLHAEAYALGLQKVYTFAPTFRAENSNTKKHAAEFWMVEPEVAFFTLKELIQMSEEMLKYVIKKVLEKRRDELVFLDTHIKPGLIQSLEDFLESNLEIIEYRKVIEILEKNKVFFEEQNIEFGMDLKTEHERFIAEKYAKGPVGVINYPKKLKAFYMYQNDDNETVAAFDLLVPGIGELVGGSQRENRYEKLEQRIQELNIDQKDIQWYLDLRKYGYSGSAGFGLGLERLVMYITGIDNIRDSIPFPRTPNNLKM

SEQ ID NO: 9830 - protein, 638 aa, Unknown
  marine gamma proteobacterium HTCC2143
MCGIFAAMTRNGIASSCVDRALSSLNHRGPDGHGTWTSSDKRWILGHTRLSIIGLSNGEQPMTSPDGKVHTVVNGEFYDYREIRERLRHDGCQFASDSDSEIALHLYQRDGMQVAPQLRGEFAVIIADERENTMIAIRDRFGIKPLYYSVVNGDVFFASEIKALLALGVPAAWDLQGALGGMARPHEQTEFAGINAVPQGCYAVAKDGTVRIYSYWDWEIPTADDMKRDNRTEAEVIAEFRSVLMDAVQQRLVADVEVASYLSGGIDSCAVLGLAQQAMARPIRAFTLTFDNPLYDEAAIAEKQAKFVGASYHPIPVTGRDIADSYSDAIWHSETQMFNGHGVAKYLLSKAVRDAGIKVVFTGEGADEMLGGYPFFRVDAVKHNPALSEAQKSALFAEILGTNEASRAIMLPNEVNSPATDAVRRRLGWVPTVVHTMESMSNGLAPFFSNDYAAYIHGHSPIVAALDRLPIGQRMTGRDHLNQSLYLYSKTALPNFILSYLGDRMEMAHSVEGRVPFLDHRVAEAAARIPVDMKVKGIREKHVLREATRDVLIPEVYNRQKHPFTTPPTRDKNDPMLAFYRDTFASQAAKDQPIYDMQKVNKALDKLLDCPDDERIAVEGGLQRIASVVVMQKKFGMS

SEQ ID NO: 9831 - protein, 576 aa, Glycine max
MASVALTTTALPSLRLRRNTTATLKPNRHASISLKPNLHASISSFPNFSLKKPHLISTRKPSALTVRASAASITPAPAPVQPWQGAAIKPLIASIATGVILWFSPVPAGVNRNAWQLLAIFLGTIVGIITQPLPLGAVAILGLGVSVLTKTLPFAAAFSGFGDPIPWLIALAFFFAKGFIKTGLGNRVAYQFVKLFGSSSLGLGYSLVFSEALLAPAIPSVSARAGGIFLPLVKALCVACGSNAGDGTEHRLGAWLMLTCFQTSVITSAMFLTAMAANPLCATLTQNSINQTIGWLDWAKAAIVPGLASLVLVPLILYVIYPPTLKSSPDAPKLAKEKLEKMGPMTTNEKIMTATLFLTVGLWVFGGLLNIDAVSAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAIVLSFLSNLMGGLTHYGIGSAPVFFGANYVPLAKWWGYGFLISIVNIIIWLGLGGVWWKFIGLWRFRWDMDTVGHFRSRVEYLHYEM

SEQ ID NO: 9832 - protein, 787 aa, Ustilago maydis
MVKGSSNRRQHSASLQGLPSSQHCAPVISIPSPPPPAEDHAYPPSSFTIPLSKDEELAEAGPSRPGSSAISRRPVLSRRRTSKKEYVHPYLSGNFAPVTTECPLTDCLFEGTIPEEFAGSQYVRNGGNPLANSERDRDAHWFDADGMLAGVLFRRTPKGTIQPCFLNRFILTDLLLSTPEHSRLPYVPSIATLVNPHTSVFWLLCEIIRTFVLAMLTWLPGLGLGGNQKLKRISVANTSVFWHDGKAMAGCESGPPMRIMLPGLETAGWYTGEEDKEKETCDKNSGNSLTSSSSKGFGGGPPIVSMLREFTTAHPKIDPRTQELLLYHMCFEPPYLRISVIPASQSKKTDLPAHAKTIKGKAVRGLKQPKMMHDFGATATQTVIIDVPLSLDMMNLVRGKPILHYDPSQPTRFGILPRYEPERVRWYESAEACCIYHTANSWDDDGKFDASHEHATRSAIRGVNMLGCRLNSATLVYSAGNLLPPSHVLPPPNCPEKCQLYYWRFDLEHAETNTISHEFALSDIPFEFPTINEDYSMQQACYVYGTSMRDGTFDAGLGKAAKIDALVKLDAQALIRKGKAMWSQGRLKAGDSVDTRTVEEVLTAQRDGSASPEDPIKIFEMPRGWYAQETTFVPRRSSTNETSQEDDGWLVCYVFDEATGLHPSTGEVLPGASSELWIIDAKLMSRVVCRIKLPQRVPYGLHGTLFTEEQIASQKPIDPSQVRSWALSINLADPFSSSALGSTVYSAAGKAATSKFKNREETYAAFIKDPIRIGAWWVKRNIELLIA

SEQ ID NO: 9833 - protein, 398 aa, Arabidopsis thaliana
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSACDHMVPKKETRLKLTIRKKDHEDQPHPLHQNPTKPDSDSDKWLMSPKMRLIKKTITNNKQLIDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKRSNGGEKYNHSPPMVAKAKKCKIKEEEEKEMEAETVAGDSEISKSTTSSNSSISSNKFCFDDLTIMLSKSSAYQQVFPQDEKEAAVLLMALSYGMVHG

SEQ ID NO: 9834 - protein, 162 aa, Hordeum vulgare
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPAE

SEQ ID NO: 9835 - protein, 481 aa, Mycobacterium bovis
MPSPTVTSPQVAVNDIGSSEDFLAAIDKTIKYFNDGDIVEGTIVKVDRDEVLLDIGYKTEGVIPARELSIKHDVDPNEVVSVGDEVEALVLTKEDKEGRLILSKKRAQYERAWGTIEALKEKDEAVKGTVIEVVKGGLILDIGLRGFLPASLVEMRRVRDLQPYIGKEIEAKIIELDKNRNNVVLSRRAWLEQTQSEVRSEFLNNLQKGTIRKGVVSSIVNFGAFVDLGGVDGLVHVSELSWKHIDHPSEVVQVGDEVTVEVLDVDMDRERVSLSLKATQEDPWRHFARTHAIGQIVPGKVTKLVPFGAFVRVEEGIEGLVHISELAERHVEVPDQVVAVGDDAMVKVIDIDLERRRISLSLKQANEDYTEEFDPAKYGMADSYDEQGNYIFPEGFDAETNEWLEGFEKQRAEWEARYAEAERRHKMHTAQMEKFAAAETAGRGADDQSSASSAPSEKTAGGSLASDAQLAALREKLAGSA

SEQ ID NO: 9836 - protein, 405 aa, Cytophaga hutchinsonii
MTSHKKAGLGFVFVTLLIDVIGIGIILPVIPDLIKDLTGEGLSEAAKYSGWLTFAYAIMQFFFSPVLGALSDTYGRRPILLLSLLGLGFDYIFSAFAPTIGWLFVGRILAGISGASFTTATAYIADISTPENRTQNFGLVGVAFGLGFIIGPVVGGITGDWWGPRAPFMVAAVFTLLNVLYGYFFVPESLAQENRRKFEWSRANPIGSLLHLKKYPVVAGLIVSMFLFFIAGHSVQSNWSFFTEYRFNWDNKMVGYSLGFVGVIIAVVQGWLIRIIIPKTGQKWAVYLGLSLNALGLLLFAFASQGWMMFAILAPYALGGIAGPALQGITSAQVPATEQGELQGALTSLMSVTTIIGPLLMNNLFSYFTGANAPIELPGAPFLAGAVMVGVSVYLSVQTLRKYEG

SEQ ID NO: 9837 - protein, 634 aa, Unknown
  marine gamma proteobacterium HTCC2143
MSNPDKVLRNAIECANLPTLLAVMSHLSGDEKWLAAPYLPNPVPPELLADDSGGFNDEIASEIRISAFDVIKPYVDKTKALPPVPNLEKMNKIMSVSVGEPLPLEQTPMFLEEMGITNRDAVWRDKPPTSTLDAFLVTIIGAGMSGLCAAIKLEEAGIPYRIIEKNSEVGGTWHENTYPACGVDTPNYFYAYSFDKNPEWSGYFSKQPELFEYFDKCTDKYALRKNIKFNTEVTSAIYDEKNHHWQISTVDADGNENVFYSNALISAVGQLNRPKRPEIPGLENFKGPMFHSSNWQYEHDLKGKRVAVIGTGCSAVQFLPDTAEKAEQVFVFQRTPNWLLPNPDYYREVAEGHKWLLQHVPYYEAWNRFRAVRLFGDVTWPAVVLDPEWDDKGRSMNEASDAMREALTDHIKEGLGHRQDLLEKVVPTFPVWGKRLIIDNNWFSTITRSNVELVSDTIASLTDSGITMADGKHYEVDVVILATGFESNRFLWPMDIRGKSGVSLEQVWGDDPRAYLGITVPDYPNMFCLYGPNTNIVHGGSIIYQVECQVRYVMSCIMELAQTDIKSLECKEDVNVDYNNEVQRLSENLAWGHPDVDSWYKNSKGRVVNNSPFCFQEYWERTHDPKFENFIIER

SEQ ID NO: 9838 - protein, 179 aa, Alkaliphilus metalliredigenes
MDIEKKVWEVLCSEEDIENRLKELGEQLSIEYKGKKLYVISLLKGSFVFTADLVRQLTIPVKINFMTTSSYGHDEKSSGHVKIVTDVQEDLTGYDVLVADDITDSGLTMKEVMDHLKSKNPSSVKSCVLLDKPDRRKVDLEPDYVGFTIPDKFVVGYGLNFGDYYRNIPYVFVVTDQDR

SEQ ID NO: 9839 - protein, 603 aa, Escherichia coli
MLRPVETPTREIKKLDGLWAFSLDRENCGIEQRWWESALQESRAIAVPGSFNDQFADADIRNYVGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELYVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 9840 - protein, 443 aa, Unknown
  Polaromonas sp. JS666
MFSRFLQRAPENFLSRTQIQDVRAGRRGFLAKAFATAAAATAAGSVSAQGEGGDANILNLPPHSKGLGQPVAARGYGLPSEFEKNLQRRESPGLTRVGQSSVSFCPLQGLFGIITPSGLHFERHHQGWWDIDPSRHRLMVNGSDEGLLKRPMVFSMDDVMRLPSVSRMHFIECGANTGMEWGNAAVPTVQYTHGMLSCSEFTGVPLRTLLELCGADLRRAKFILAEGADGSGMTRTIPMSLIMSGEVLVAYGQNGEMLRPENGYPLRLIVPGVQGVSWVKYLRRIEVGDMPYGAKDETIHYVDLLPDGTHRQYTSIQEVKSVVTSPSGGQVLLQKGFHTITGLAWSGRGKVRRVDVSTDGGRNWAPARLQGPVLAKCLTRFNADFVWDGKPAIFQSRAVDETGQVQPTYAELRKVRASRSIYHNNAIQSWLLEENGEVKNVQI

SEQ ID NO: 9841 - protein, 485 aa, Arabidopsis thaliana
MSSPRSNKPKIVNGPGGYILQDVPHLIDYLPDLPTYPNPLQDNPAYSVVKQYFVHADDSVPEKVVVHKDGPRGVHFRRAGPRQKVYFESDEVHACIVTCGGLCPGLNTVIREVVSSLSYMYGVKRILGIDGGYRGFYAKNTIPLNSKVVNDIHKRGGTIIGTSRGGHDTNKIVDSIQDRGINQVYIIGGDGTQRGASVIFEEIRRRRLKVAVVGIPKTIDNDIPVIDKSFGFDTAVEEAQRAINAAHVEAESNENGIGFVKLMGRYSGYIAMYATLASRDVDCCLIPESPFYLEGEGGLFEFIERRLKDHGHMVIVLAEGAGQDLMCKSMESTPMDASGNKLLKDVGLWLSQSIKDHFKKNKMVMNLKYIDPTYMIRAVPSNASDNVYCTLLAQSAVHGAMAGYTGYTSGLVNGRQTYIPFYRITETQNNVVITDRMWARLLSSTNQPSFLGPKDTSEEKKELPETPLLDDGAVDIPPVTKEVTK

SEQ ID NO: 9842 - protein, 347 aa, Ralstonia metallidurans
MYLKNAWYVAGWNSEFQKDQLVSRRLLGQDIVFYRRGDGSVAALEDRCCHRAAPLSKGQQEGDQIRCMYHGLLFNCAGQCVEVPGQERISDKLKVRSFPTEVRDNLVWIWMGQPELADASEIKQVHWHNREGWRVEEGGYLRYASGVQLIVDNLLDFSHLGFVHNKSIGTRKQGNIRPETEFQGETVSVRFTTLGSPPPAFARELGQLPENVDRFNYYVWHIRGNLFVQDSVIAPVGEGYESLDPATMKLHTFIALTPCDENTAHYFWATAHNNFTSTTEDLTRRLTEQVAHAFDEDREIIEAQQAVISTAPDAPMVAIAADGTLLKVRRMLDALLLEERSPKAATQ

SEQ ID NO: 9843 - protein, 439 aa, Ralstonia metallidurans
MLSREDNELLVRVGPGTAMGTMMRLYWIPFLKSSEVTAGGQPYRVRLLGEDLVAFRDNSGNVGLVDHTCPHRGAPMVFGRNENDGLRCVYHGWKFKVSGQCEEMPCEPADSPMCKRMKIKAYPVKERNGILWAYMGPDAENAPELPDVEWNMVPEEQVAISMRVQECNWLQALEGELDSAHAAILHGRVGEGGVINQWRQAQDLSPTFECVQHDAGISIGARRKTPDGENYVRVNQFLMPFWTLVPPQSQFPELSGHAWVPIDDEHTLCLMFSYHPAKPFYERTRKLFKEGHNGRETGHHSDNAFEKRPVTEPYHTYWSKFNRGNAYQFDYQSQVEKYNSGMPGLWIQDAACQSGTTPILDRSKEHLGTSDTGVARMRRVLLEAVKKLVATGEHPVSSNAPAAFRWRAVSLTIPLGGDWTKLGEEAMRAEPGKDFGYTP

SEQ ID NO: 9844 - protein, 531 aa, Hevea brasiliensis
MEADPRKEPKLASSDHPLPPPPPPSSASIRKIVMVASIAAGIQFGWALQLSLLTPYVQLLGIPHTWAAFIWLCGPISGMLVQPIVGYHSDRCASRFGRRRPFIAAGSFAVAVAVFLIGYAADLGHLSGDPIAKSPKPRAIAVFVVGFWILDVANNMLQGPCRALLADLSGSNQKKTRTANALFSFFMAVGNVLGFAAGAYTHLYKIFPFTKTKACDVYCANLKSCFFISIFLLLTLTVLALTYVHEKQWSPEQGNAAAGDAEEEEDGPFESSPMPFFGEIFAALKNLQKPMWILLLVTCLNWIAWFPFLLFDTDWMGREVYGGDSNGTAEQVRLYDHGVRAGALGLMLNSVVLGFTSLGVEVLARAVGGVKRLWGIVNFILALCLFMTILITKMAESNRRFTTVRGGATVPLPPPGGVKAGALALFAVMGVPQAITYSIPFALASIFCNTAGAGQGLSLGVLNLSIVIPQMLVSVASGPWDALFGGGNLPAFVVGAIAAAASGIFAFTLLPSPPPDVPSAKASRAVTAAFH

SEQ ID NO: 9845 - protein, 396 aa, Desulfitobacterium hafniense
MSFKINDTITYVGKIDWELRNFHGEEYSTQRGSSYNSYLIRDEKTVLIDTVWEPFGREFIAKLKQEIDLNEIDYIVMNHNEVDHSGALPFLLEEIPNTPIYCTANGKKILQGSYHQDWNFVEVKTGDRLNIGSRELIFIEARMLHWPDTMFCYLTGDNILFSNDGFGQHFASEHMYNDLVDTGELYAEALKYYANILTPFSKMVTAKIQEIVKMELPISMICPSHGVIWRDNPLQIVHKYLEWAAEYQEEQVTILYDTMWNSTRKMAESLAQGIRMVNPNLTVKLYNTARSDHTEVIAQVFCSKAIAVGSPTVNNGYLSSIAAILEEIKGMKFKNKKAVPFGSYGWSGEVIKQLNEELKKAGFEVVDEGVRSLWTPSEENLLECVELGKRLAASLQ

SEQ ID NO: 9846 - protein, 709 aa, Magnaporthe grisea
MCGASVIVSLRRKHEETNGAAAAKTSDKESRLAKSLDALAHRGPDARGVWIDPTGEVGLAHTRLAIIDLSAEGNQPLHDDQDHIHAVITGEIYDHDRLRRECVEAGYRFKGHSDSEVVVALYQRYGAPGFLEHCRGEFSMVVYDDRSGEVFACRDRSGIKPLFYTIVQNELWFSSEVKGFLGMGWKPEWALESIAMGVTQVGSSTIFQGVNRIEPGFYMKVTADGDITHSKYWDFDYPDKTVVDNRSMEDMVQELREALVDAVRLRLRADVPVGIYLSGGLDSSMIAGIAKKLIDEEGATAGSQKASERMTTFTLAVNSDQDNSVYNEASIASRTAKFLGVKEKTLNADEQLLASTFEDACWHIEQPISTLSMCAKVALSKLARDSGVTVILTGEGADETFAGYPWMLPDLTAEADHSRPDAPINRDIDNLRGPIRKQLFDMWANLGSTEMPKLLQQVKPETWAKMNFVSTPVVSDGSSGVGLIHPKLRAKYNLDDRISKTQDCIGEDVLKKVREKWHPLNSSLYLNHKTLLANTIIPSNGDRTEMANSVEGRPPILDHKVLELASKLPPSVQVGYFPDGANLNSGKTVFRSNNADGELMARFREKFLLREAARPFVTDEIYSRPKHSFMASSNYHAGGPIHQVLKRLLTKENVEAVGFLDWPKIEAHLASAFDPQLAHVAGQNFAPCLQAASFVTISQKFGVARASVE

SEQ ID NO: 9847 - protein, 829 aa, Vibrio parahaemolyticus
MKMTRRAFVKANAAASAAAVAGITLPASAANLIASSDQTKITWDKAPCRFCGTGCSVLVGTQNGKVVATQGDPEAPVNKGLNCIKGYFLSKIMYGQDRLTQPLLRMKDGKYHKDGEFTPVSWDVAFDTMAEKWKASLEKKGPTSVGMFGSGQWTVMEGYAAAKMMKAGFRSNNIDPNARHCMASAVVGFMRAFGIDEPMGCYDDFENADAFVLWGSNMAEMHPVLWTRITDRRLSHPHVRVNVLSTYYHRSFELADHGYIFNPQSDLAIANFIANYIIENDAVNWDFVNKHTNFTQADTDIGYGLRDDDPLQKAAKNPNSGKLTSISFEEYKKSVAPYTVEKASEISGVEKEKLIELAKQYADPNTKVMSLWTMGMNQHTRGVWMNNLVYNIHLLTGKIATPGNSPFSLTGQPSACGTAREVGTFAHRLPADMVVANPKHRQIAEKIWKLPEGTIPPKPGFHAVLQDRMLNDGVLNCYWVQCNNNMQAGPNINTERLPGYRNPENFIVVSDPYPTATAQAADLILPTAMWIEKEGAYGNAERRTQAWYQQVGTVGDAKSDLWQVMEFSKRFKMEEVWPEELLAKAPQYRGKTMYDMLFKNGQVDKFPLEEARELNDDSHHFGFYVQKGLFEEYATFGRGHGHDLAPYDVYHTVRGLRWPVVDGKETQWRFKEGSDPYAKAGSGWDFYGNADGKAKIISAPYEAPPEVPDSEFDLWLCTGRVLEHWHTGTMTRRVPELYKAVPDAVCYMHPEDAKARNVRRGEEVVIANKRGEVRVRVETRGRNRPPKGLVFVPFFDARILINKLILDATDPLSKQTDFKKCPVKITKVA

SEQ ID NO: 9848 - protein, 900 aa, Dunaliella salina
MPALANNTAEPSSSPGEMMLSKLKANGSSGGDSANGVPQQNGKVVVESFVHKHLGAPYEPPLSPEDPDWALHVPASTVNDKDKGTADAWIPRDPRILRLTGRHPLNCEPPMHDLMAAGFITPPSIHYVRNHGPAPKIRWDQRRLEIGGLVERPMSLTMDEIVSMPSVTIPVTMVCAGNRRKEENMLKKSIGFNWGPCAVSTGYWTGVKLCDLLKHVGAKGPKQGGGYHVGFSGPKGELPAGDGTYGTSIPWGKAMNPAEDVLVAYKHNGRWLTIDHGFPVRTIIPGNIGGRTIKWLCKITVQEKESNNHYHYMDNRVLPAHVDQEIATKEGWWFKPEYIINDLNINSAVARPWHDEVVSFKDAKKMYTVKGYAYAGGGHKIIRCEISLDGAQTWRLANIRRFAEPNEYGKHWCWVHWDIDVPIFDFFGPREMLLRAWDETQNTQPATITWNVMGMMNNCHFRVLLHPFMDDKGNVGVRFQHPAPVEVGERGNIGWREEENLRMQALEAAGITTKEGPLPPNRDIAAAAAAKPATPKATGSGKEYTMEEVAQHTTHDSAWFVHEGKVYDATAFLDEHPGGSDSILTATGADATEDFNAIHSKKARNMLADYYIGELAASKPGAPPQPQANGHATANGHTSLITLNPREKVTLKLAERIEVSHNTRIFRFALPSPEHILGLPTGKHLFVYAHVNGELVARAYTPISSDKDKGRLDLLIKVYGPNQHPAFPQGGKMSQHLDKLKIGETIQVKGPVGHFTYEGKGNYMNGKSKGKASKLSMLAGGTGITPILQVLEAIFRDKEDQTCMSLIFANNSEPDILARDRLDKLAQENPERFKVYHVLSKAPEGWPQGKGYVTEHLMRERFFPAERTASPDVRSARPHQLSGGPGFEKMGYSKERTVSF

SEQ ID NO: 9849 - protein, 157 aa, Leuconostoc mesenteroides
MSIYDYFATLENGETYSLNKLANHPVVIVNTATKCGYAPQFGELEKLYKKYKDKGLVILGFPSNQFKQELETASQAAQACQLTYGVTFPMHQLVAVNGKNTDPLFKYLKENSKGMLGSSTIKWNFTKFLVDKEGNVVKRYAPKTEPKDLEEDIEDVL

SEQ ID NO: 9850 - protein, 273 aa, Mycobacterium avium
MRIIVTGGNSGVGKATAAALAAAGHEVVIACRTLTKAHQAAADMAGDVEVAELDLADLTSVRKFADSVEFVDVLVNNAGVLGLPLTRTADGFEAHMGTNHLGHFALTCLLGDRIRNRVVVVASSNHALATMHFDDLNWHRRRYNPWSAYGESKLANMLFVQELTRRGRTAYASDPGMTATDITRDGSGLLQWAGRALSPRIAQSPADGARSTIQAVTTDLPSGTYIAPRGLFHQWGRPKPTKLIAKVRDPESARKLWDLSAELTGCDWQGANA

SEQ ID NO: 9851 - protein, 421 aa, Unknown
  delta proteobacterium MLMS-1
MSYLASSDPEVYRAIGGEFDRQYHQLEMIASENIVSEAVLEAQGSVFTNKYAEGYPGKRYYGGCEYADVIEELAINRALELFGAEYANVQAHSGSQANMAVYFACLKPGDKVLGMDLAHGGHLTHGSSVNFSGQLYQFASYGVDRQSERIDMAEVERLALEHRPKMIVAGASAYPREIDFAAIGEIARKIGAYYMVDMAHIAGLVAAGVHPSPVPHADFVTTTTHKTLRGPRGGLILARGDYGKMLNSKIFPGIQGGPLVHVIAAKAVTFREAMEDSFKEYMRQVVKNTRALGEALVARGFRLVSGGSDNHLLLVDLTPKQITGKEADGLLEQAGITVNKNAIPFDTAKRFVTSGIRVGTPAVTTRGLKEPEMEQIAAWMDRALATAEGAGREAALAAIREEVRALCDRFPIYPGMQNGMV

SEQ ID NO: 9852 - protein, 483 aa, Neisseria meningitidis
MNYFPIFANLAGRPVLVVGGGAVAARKISLLLKAGAEVRVAAKHLNAELSALAAENKILWLAEEFRAEHIRTVFLIIAASSDQALNRRVFHLAESCQKPVNVVDDRDHCSFIFPSVIDRNPVQIAVSSSGSAPVLARLLRERLEALLPPSLGDMAEISGRWRDAVKGKLKSVTERRRFWEKQFNGRFAALVKNRQNTLAERELAGQLEQSRQNDQGGSVSLVGAGPGDAGLLTLKGLQEIQQADVVLYDALVSDGILSLVRRDAERIFVGKRARGERTPQEDTNALMVRLAREGRRVVRLKGGDPFVFGRGGEELETLARHQIPFSVVPGITAAVGATAYAGIPLTHRDYAQSAVFVTGHRKADAPDIEWQTLARSRQTLVIYMGALKAALIAERLQQHGRSPDTPAAVISQGTLPAQKTATGTLANLAELAETAPNPALIVIGEVVGLHEKLAWFGENGEGENRVGQTYPALGGLNAGQRAA

SEQ ID NO: 9853 - protein, 342 aa, Mycoplasma mobile
MIKENKTVNKTNKISIIGSGAMATAMAKVLYDSGNTNIFIYGIDEKELEDLKIGKNAKYFSTDIKLPSFNTTKDLKIALDKTDYIVLAIPSIFIQATFLEILKLLNSKVLVISVSKGFYPNSFLSIHEGLSKDSKSNEFVRGVVTVTGPSFAEEIIKEQLTTICAVDSNIKNAQEVQKLFSNKYFKLYVQSDVIGAEVGASFKNVLAIFSGIANQQGYGINTLASILSRGLKEMKLYNDKVGGKLSTLLGLTGVGDLILTATSPLSRNFSFGKEFVINKSKALETVKTVEGLKALENIYRSNKKYGLDLPIISSLYELIFENISLEEFKEKIWNRTLKSEFE

SEQ ID NO: 9854 - protein, 180 aa, Helianthus annuus
MATQTVFDFPDDVLQQPPMPADNAFSDKDVKGQDVELSKYKGKVLLIVNVASQCGFTNSNYPELTTLYQKYKDQGFEILAFPCNQFGGQEPGSNEEIQVFACTRFKAEYPVFSKVNVNGKEADPLYKFLKSSKGGFLGDSIKWNFTKFLVDREGKVVDRYAPTTSPLSIEKDIKKLLNVA

SEQ ID NO: 9855 - protein, 168 aa, Actinobacillus pleuropneumoniae
MANIREIYLAGGCFWGTEAFMQRINGVLDAQSGYANGNTENPSYQEVCAGSGHAEVVKVTYDADKISLAKLLDYYFKVIDPVSVNQQGEDKGIQYRTGIYYVDPQDIPVINQALADLQTQYEQPLVVENTMLEHYFPAEEYHQDYLDKNPNGYCHIDLQLMNEILRNQ

SEQ ID NO: 9856 - protein, 167 aa, Helianthus annuus
MATQSKKTLYDFTVKDAKGNDVDLSVYKGKVVLIVNVASKCGLTNNSYDELNQIYLKYKEKGFEILAFPCNQFGQQEPGTNEEIVDFVCTKFKSEFPIFDKIDVNGENAAPVYEFLKTGFYGILGGDIQWNFSKFLVDKNGQPVDCYYPTTSPLTVERDIQKLLGLL

SEQ ID NO: 9857 - protein, 113 aa, Arabidopsis thaliana
  misc_feature (38)..(39): Xaa can be any naturally occurring amino acid
  misc_feature (45)..(45): Xaa can be any naturally occurring amino acid
  misc_feature (48)..(49): Xaa can be any naturally occurring amino acid
  misc_feature (53)..(53): Xaa can be any naturally occurring amino acid
  misc_feature (58)..(58): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (75)..(75): Xaa can be any naturally occurring amino acid
  misc_feature (78)..(79): Xaa can be any naturally occurring amino acid
MASSMLSSAAVVTSPAQATMVAPFTGLKSSAAFPVTRXXNKDITXILXXGGRXSCMKXWPPXGKXKXFETLSYLXDLXXFIRKSLLVYSFVIILLAFFIFFLFFLLSFYSYYC

SEQ ID NO: 9858 - protein, 448 aa, Unknown
  marine gamma proteobacterium HTCC2143
MECDIENVVVHGEIPKDLDISYFRNGPDPQFAPRGKHHWFGGDGMVHGFHIQNGKVSYRNRWSRTQKWSLEREAGKSLFSAFNPMDCDPSVAGLQTDGTANTNIVWHGDKLLALEEGHAPFELDSRTLDSKGAWDFAGEYSDRMTAHPKIDPKTGEMLFFGYMVGEPLGNGMSYQVVDSGGKLTRSDHFNAPIASMVHDFITTDEHVIFPIFPLTGSLDRAMSGQPAFAWEPNKGAHIGVMRRTDSIDKIRWYDIDPCYVFHALNAYTKGNTIVAHMMQFEEAPLFPHVDGSRADPKKANARLCEWTIDLSENGGIKRRYLDDITGEFPRLDERFVGLENRFGYYAASTVADGGLGFDAIAHQDLKLDKRTLFQLPDGDKTGEPIFVPKSKTAEEGEGYLISVIYRANQNRSDLVIFDAENISDGPIATAELPHRVPHGFHGNWKYNS

SEQ ID NO: 9859 - protein, 238 aa, Jasminum nudiflorum
MARRYWNINLEEMMVAGVHFGHPTKQWNPKMAPYIYAKVKRKGIHIPNLTRTARFLSEACDLVFDAASRGKEFLIVGTKPKAAGSVVRAAIRARCHYVNKKWLGGMLTNWFTTKTRLHTFRDLRMEQKTGRLNRLPKRDVAMLKRQLSRLQAYLGGIQYMTGLPDIVILVDQHEEYTALRECITLGIPTICLIDTNCDPDLADLPIPANDDAKPSIRLILNKLVFAICEGRSSYIRNP

SEQ ID NO: 9860 - protein, 635 aa, Dechloromonas aromatica
MCGITGIFDTRSKRDIDRAVLHRMNESQIHRGPDEGGTHVEPGVGLGHRRLSIIDLSTGQQPLYNEDNSVCVVFNGEIYNYQELIPELQALGHVFHTRSDTEVIVHAWEAWGESCVDRFRGMFAFALWDRNRETLFLARDRLGVKPLFYALLDDGTFLFGSELKSLLAHGGLKRDIDPCAVEEYFALGYVAEPRSIFKQALKLPPASTLLVRRGQPVGTPREYWDVRFTLDNPISDADAQAELTHRLEESIKLRMISEVPLGAFLSGGVDSSAVVALMAGLSQKPVNTCSIGFSDPAFNESEFAKMVADRYQTNHHLDIVESDDFDLIDTLARLYDEPYADSSAIPTYRVCQLARKHVTVALSGDGGDESFGGYRRYRLHMMEEKMRSALPLGLRRPLFGALGKLYPKADWAPRVFRAKTTFEGMARNSVEAYFHSVSILRAPMRDRLFSTQFKSALSGYDALKVFTDHAAKADTTDPLALIQYLDLKTYLIGDINTKVDRASMAHSLEVREPLMDHKLVEWLATLPSTLKIRGQEGKYLLKKSMEPHLPNDVLYRPKMGFSVPLARWFRGPLKTRVQESILGSRLADTGWFNRDYLQKLVTDHNNGSRDYSASIWTILMFEAFLRNVMEQGEAA

SEQ ID NO: 9861 - protein, 464 aa, Clostridium thermocellum
MKTTLVKSLYRNTKDYVGKEIVVAGWVRTVRDSKAFGFIELNDGSFFKNLQIVFEEKNLPNFKEIAKLSVGSAIIAHGELVETPGAKQPFELKATKIEIEGASTPDYPLQKKRHSFEYLRTIAHLRPRTNTFSAVFRVRSLLAYAIHKFFQERGFVYVHTPIITGSDAEGAGQMFKVTTLDINNPPRKEDGTVDFSKDFFDRETNLTVSGQLEGETYSMAFRNIYTFGPTFRAENSNTARHAAEFWMVEPEIAFADLEDDMELAEDMLKYIINYCLENAPEEMEFFNNFIDNTLLDRLNNIVSSDFAHVTYTEAIDILSKADQKFEYPVKWGNDLQTEHERYLTEKVFKKPVFVTDYPKDIKAFYMRLNDDNKTVAAMDLLVPGVGEIIGGSQREERLDYLENRMKELGLKMEDYWWYLDLRRYGSTRHAGFGLGFERAIMYITGMSNIRDVIPFPRTVHSAEF

SEQ ID NO: 9862 - protein, 396 aa, Unknown
  Candidatus Desulfococcus oleovorans Hxd3
MAAFEIAKGIYSVGAVDWNGRDFHGYSTLAGTTYNAFLIVDEKIALVDTVKSGFTDQLLANIAQVVDPKKIDLVISNHTEMDHSGGLPRVMHYIGEDKPLYLSKMGLKNHSLHFRQKWNYQVVENGQELSLGKRTVQFLETRMLHWPDSMFSYLKEDKILFSSDAFGQHYAGPERFDDEIGDAIFPHAKKYFANILLLYTEKIKKLIDTVTQMGLEFKMICPDHGIIWRKDPGAIISAYAKWSDHPADNKAVVVYDSMWHSTQSMAEKIAEGLAAEGVVAKPMHLRASDRSEVMTEVLDAGAVIVGSPTLNNNVFPTVMDFLVYMKGLKPKNKIGAAFGSYGWSGESVKDIHDTLESMKFAMPEPGLKIQYVPDEDGLAACVEFGRKIAKALKAGQ

SEQ ID NO: 9863 - protein, 132 aa, Brassica juncea
DPYQRAQARFWVDFIDKKMYEAQRKVYATKGEEQETGKKEFIEILKTLETELGDKPYFGGDDFGYVDIGLIGFYTWFPGYEKFGNFSIEAECPKLIAWAKRCMQRESVAKSLPDPEKVVEFMAMLRKKFGVE

SEQ ID NO: 9864 - protein, 709 aa, Pseudoalteromonas tunicata
MQAIIKKFQLGQHTVTLETGAIARQADAAVLASIGDTSVLITVVGKKEAAPGQDFFPLTVNYQERMYAAGRIPGGFLKREGRPSDAETLIARLIDRPIRPLFPDGFVNEVQVIATVVSFNPEIQPDIVTLIGTSAALAISGIPFNGPVGASRVGYINGQYVLNPSVKELEESQLDLVVAGTENAVLMVESEANILSEDVMLGAVMYGHEQMQSIITAVAEFKAEAGKPTWNWSAPEKNVDLATQIANIAEAKIGAAYLITDKVARKDALSAAKAEVVETLTAQLAEGESLDKNEVGDLFGSLEKTIVRGRIIAGEKRIDGREPDMIRALDVMTGVLPRTHGSAIFTRGETQALVTATLGTERDSQMLDALSGTSNSRFMLHYNFPPFCVGETGFVGSPKRREIGHGNLAKRGIQAVMPSLTEFPYSIRVVSEITESNGSSSMASVCGTSLALMNAGVPVKASVAGIAMGLVKENENFVVLSDILGDEDHLGDMDFKVAGTSNGITALQMDIKIEGITREIMQIALNQAKAARLHILGVMDQAISAPQAELSEFAPRIYTMNIPPKKIAEVIGKGGATIRALTEETGTTIEIEDDGTIKIAATNGDSAKAAIARIEQLTAELEVGTIYTGKVVRLVDFGAFVNVLPGKDGLVHISQICEERVNNVADHLSIGQEVKVKVVEVDRQGRVRLSIKEASAPATPAAVESEEQA

SEQ ID NO: 9865 - protein, 431 aa, Unknown
  Synechococcus sp. CC9605
MSQASGRAIDADLAQSDPDIAAFINQERQRQETHLELIASENFASRAVMQAQGSVLTNKYAEGLPSKRYYGGCEHVDAIEELAIERAKQLFGAAWANVQPHSGAQANFAVFLALLQPGDTIMGLDLSHGGHLTHGSPVNVSGKWFNVVQYGVDKETQRLDMEAIRQLALEHKPKLIVCGYSAYPRTIDFAAFRAIADEVGAYLLADMAHIAGLVAAGVHPSPVPHCDVVTTTTHKTLRGPRGGLILCRDAEFAKKFDKAVFPGSQGGPLEHVIAAKAVAFGEALQPSFKAYSQQVVANAAALAEQLIARGIDVVSGGTDNHVVLLDLRSIGMTGKVADLLVSDVHITANKNTVPFDPESPFVTSGLRFGTAALTTRGFDSQAFREVADVIADRLFNPEDDAIRQRCLDRVGALCERFPLYADSKHKQPVLV

SEQ ID NO: 9866 - protein, 224 aa, Unknown
  Candidatus Desulfococcus oleovorans Hxd3
MEEKSRLKDGEKGVVLQRDKETYAIAPHLACGVVTPEVLRKLADAAEKYNAAAVKVTSAARIALVGIRPEDIDNIWRDLGIAPGHAVGMCVRSVKACPGTAFCRLGQRDSLGMGMKLDEIYHGMDLPSKTKMGVSGCKNQCAENCIKDVGLHGTKNGWVLTVGGKGTSRPRLADTLAEGIESDEQALELVAKVVDFYKTNAEKPERIGAMLDRIGLDAMKAAVL

SEQ ID NO: 9867 - protein, 410 aa, Ralstonia metallidurans
MENRVRRRRFLKQAGALTANAVVGTTALNALAASGDKQVQLPFDNGARELVAFPQKRPLILLTSRPPQLETPFSVFNEGILTPNDAFFVRYHWSGIPTSVDPQTYRLRIGGKVKTPLELSLADIKAIAQPMEVVAVNQCSGNSRGFLAPRVNGGQLANGAMGNARWTGVPLKAVLERAGVQPGAVQVSFNGLDRPPLDNSPDFVKSLDIDHALDGEVMLAWSMNGEDLPMLNGYPLRLVVPGHYGTYWVKHLSDITVLDKPFDGFWVQSAYRIPDNAGANVEPGSAPARTRPIGRFNVRSFITSLTEGATVPSGRETVVRGIAFDGGYGIAEVAFSADGGRSWTEATLGQDLGKYSFREWRAAFRPPRKGAYDLRVRAVNRIGQSQPMTALWNPAGYMRNVVETTRVKAV

SEQ ID NO: 9868 - protein, 310 aa, Streptococcus thermophilus
MNMTIYNSITELVGRTPIIKLNSIVPEGSADVYVKLEAFNPGSSVKDRIALRMIEDAEKAGIIKPGNTIIEPTSGNTGIGLAWVGAAKGYKVVIVMPDTMSVERRKIVQAYGAELVLTPGSEGMKGAIAKAKEVAAERDGWVPLQFANPSNPAAHADTTGQEILEDFGADGLDAFVAGIGTGGTISGVSKTLKAANPNIKVYGIEADESAVLNGDKPGPHKIQGISTGFIPDTLNTKSYDSVIRIPSDEAISTSRTLGSKEGFLAGISSGAAIAAALKVAAELGEGKKVLTLLPDNGERYLSTTLYDFQN

SEQ ID NO: 9869 - protein, 423 aa, Unknown
  Acinetobacter sp. ADP1
MSLSYEIENNGAWQTYLAQVDRVAPYLEADLIPYINTLKRPKRALIVDVPIVMDDGAIQHFEGYRVQHNLSRGPGKGGIRYHPDVELNEVMALSAWMTIKTAVLNLPYGGAKGGIRVDPKKLSARELERLTRRFTSEISPIIGPQNDIPAPDVGTNADIMGWMMDTYSSIKGHTVTGVVTGKPVHLGGSLGRVRATGRGVFVTGLEVAKKINLSIENSRVAVQGFGNVGSEAAYLFNKANAKVVCAQDHTGTIFNDDGLDVKSLQEHVAQTGGVAGFPDSSKIEDAEFWNVEMDILVPAALEGQITAERAQTLKAKLVLEGANGPTYPDADDVLGQRNIIVVPDVLCNAGGVTVSYFEWVQDMSSYFWTEDEINARLDKLMIQAVDDVWKKAQEKSCTMRTAAYILACERILKARKERGIFPG

SEQ ID NO: 9870 - protein, 506 aa, Oryza sativa
MADELVLQRSEQLRELYDSLLSGECGHRARRPVAALLPEDLGDTEWYYVVCMTYAFGPRQGCVWLPGKSFASNEFVWLTNAQSADRKLFHRALIAKTIVCVPFIMHGVLELGTTDPISEDPALVDRIAASFWDTPPRAAFSSEAGDADIVVFEDLDHGNAAVEATTTTVPGEPHAVAGGEVAECEPNSDNDLEQITMDDIGELYSLCEELDVVRPLDDDSSSWAVADPWSSFQLVPTSSPAPDQAPAAEATDVDDVVVAALDSSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHRVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDVLSVQASTSDGLLGLKIQAKVVISAAK

SEQ ID NO: 9871 - protein, 112 aa, Thiomicrospira crunogena
MKLIKAIINPYKLDSVRESLSELSDFGLTVTDVKGYGRQKGQQEIYRGAEYEISFVPKVSLEVAVSDDIVDRVVELIVEQAKTGNIGDGKIFILPLEEVIRIRTSETGEDAL

SEQ ID NO: 9872 - protein, 604 aa, Triticum aestivum
  misc_feature (12)..(13): Xaa can be any naturally occurring amino acid
SARGNVWHVSLXXSVEGYGSYGFRCGLFGMGHPLLDPYAKVIGDLVAANPLHVKGITAPSMSCLGSLATPPSYNWGRDKWPRLPLEKLVVYRANVALFTKDKSSGLPDNVAGTFSGVASRAQRVPRLRVNAVLLEPVFQFDQVKGPYFPYHFFSPMDSYGGEGCSASAITAMKDMVKAMHRNGIEVLLEVVFTHTAEGEADGQMISISGIDNSSYYIADEIAGCKSGILNCNSPVTQNLILDSLRHWVIDFHVDGFGFINAPFLVRGPRGEYLSRPPLLESIAFDPVLSKTKIIADPWSPLGISNVQFPFPHWKRWAEMNTRFSIDVRNFLKGEALISDLATRLCGSGDLFSNRGPAFSFNYVSRNSGLTLVDLVSFSNGDLASESSWNCGEEGPSEDSVVLQKRLRQIRNFIFILFVSLGIPVLNMGDECGHSSAGSTSYKDRVPLNWKALKTSFVKEVTGFISFLAALRSRRGDIFQRREFLKLENISWHGNNLSEPRWEDPTSKFLCMHIIAENDVNTPELTKGDLYICFNANEEPASATLPAPAEGSVWLRLVDTSLALPGFFTTESNLKVHQVLGYSSYEVKAHSCVLFESKRDLPQFL

SEQ ID NO: 9873 - protein, 112 aa, Prochlorococcus marinus
MKKVEAIVRPFKLEDVKLALVNAEIIGMTVSEVRGFGRQKGQVERYRGSEFTVEFLQKLKVEVVVDDDKVEAVVNAIAEAAKTGEIGDGKIFISPVDSVVRIRTGERDSKAL

SEQ ID NO: 9874 - protein, 78 aa, Unknown
  Populus tremula x Populus alba
CASFRFALPSEDQVLGLPVGKHIFLCATVNDKLCMRAYTPTSTVDVVGYFDLVIKVYFKGVHPKFPNGGQMSQHLDSL

SEQ ID NO: 9875 - protein, 686 aa, Prochlorococcus marinus
MGKVKVGSAWPLGSSVTLDGVNFSIAAPHATNLELLIFQSADDEYAKETISLDQKNRSGDYWHVEIEGLAEGTLYGYKVSIDGQKAAEDHIVLDPCARAITGWENYIRNHKEKVNRGYAHCLKGVVTKRDYFDFKSHPRPKHSWNKTIIYELHVGGFTKSNDSSISESKKGTFLGLIEKIPYLKSLGITTIELLPVFAFDSNDAPEGLVNYWGYSPINWFTPHQDFVDSCNPLEARRQFKKLVEVCHDNELEVLIDVVYNHTTEGNQNGPSISWKSFGPKTYYHQDDKENYQDVSGCGNSIAANRPLVRKLILESLRCWAIELGVDGFRFDLGIALSRGENLIPLDKPPLFEEIEADPKLSDVKLISEPWDCGGLYKLGDFPAKQFRTWNGHFRDDIRRFWKGDKGTIWPLKDRLIGNKSLYNDNNLANIFSINFITSHDGFTLKDLVSFNKKHNLANGENNRDGENNNNSYNYGVEGPTTDKEINNLRQKQQRNLLATLLLSPGIPMILMGDELGRSQGGNNNTWCQDNPLGWMDWNHNNCDHDLKEFVLKLISLRKQLSEFFSPDIIYDCQKDNTKVKTSHFWIQWHGIKVNKPDWGDWSHTLGFSINKNNDGSAIWLGFNAYKESMLFDLPTPISPWKKYIDTSILKTKNVSKKPLANQSNVRIESNSLVLMVSSEYSKKIKL

SEQ ID NO: 9876 - protein, 421 aa, Oryza sativa
MEQTLDVPRSLRLPTPKAQQQMDEFWRDRQKEIETTKDFSEHAIPMARLKKIASSQKGNMMMSFDMPAFLSKMCELFVQELAVRAWASAQSHNRCIILDTDIAEAIASTESYDFLVDILHNHREKHKSTPCSTLTTKRCRLVDQPSTSRPPYQHQLPLFAPTYTPAIPITPSLMPPISHYIPFQYPSLSQEVSTMMASAPIVNRSMLLIHNIARGLGLQGNNISTFANNNIPDNIIGCSSPAVLASMMSPALLDVAGASLNPPNSHSICTMNMINSSDPSGSSIGDINVANQASLAPSEHFNPAILQESSCPSFLYNNNNDTIVVVPEGVDISGTMDVAGLVINGQEEEHERKTNVEQNEIYESIDIGIINASVADGNKCSIRWDELGTADDSLLDKFLEEFQARNDGVLHSGIVLHEDHS

SEQ ID NO: 9877 - protein, 150 aa, Nicotiana tabacum
QDGILKYMLKMMEVCKAQGFVYGIIPEKGKPVTGASDNLKEWWKDKVRFDRNGPAAIAKYQADNAIPGKNEGSNPIGPTPHTLQELQDTTLGSLLSALMQHCDPPQRRFPLEKGVPPPWWPTGQEDWWPQLGLSKDQGPPPYKKPHDLKK

SEQ ID NO: 9878 - protein, 673 aa, Rhodospirillum rubrum
MSIRARLDAGEPWPLGAMAREGGVNIAVFSEAATQIDLCLFDGDQETRLPLPARTGDIWHGFLPGGGPGLRYGLRAHGPYDPGRGQRFNPHKLLIDPAARRLDGPVVWDKALFGFDPDHPERDLSFSIRDSAAFVPKAVVEADPATRALRSPPDPGRLLIYEAHVKGLTRTHPQVAPEARGTFDGVAGSAVIAHLKHMGVTALELLPVWAFADEPHLPPLGLTNYWGYNPVCLTAPHAAYGPPDSFRRMIDCLHGADIAVILDVVLNHSGEGDEYGPTLSFRGLDNAAYYRLDPTDPRRYLNDSACGNTLRMEHPQVLRLAMDALRYWVGVMGVDGFRFDLAVTPARHKGAFDPSGPFLSAIAQDPLLSRALVIAEPWDVGPGGYQAGRFPKSWMEWNDLARDGLRRFWLANGRSGDLAAVLAGCAARYAPSGRGPRAGVSYISAHDGFTLADMVSYGHRHNNANGESNRDGSAIELSANHGVEGPTNDLAIRSLRDRQRRNLLACLLLSLGVPMIRGGDELGQTQQGNNNVYCQDNPLNWLDWGGADANFAAFAARAGALRARLPQLGRASFLNGFPDAKGKRDVVWLRPDGGEMSPADWDALPRLLAMRLTGAEKASDLLVLINGQPHEQSFRLPPGPAWTIALRSAGDDAPAAAGSSLVVPEMSLVALTS

SEQ ID NO: 9879 - protein, 208 aa, Haemophilus ducreyi
MGKKRSASSSRWLAEHFKDQFVQKAHKQKLRSRAYFKLDEIQQSDRLFRPGMTVVDLGAAPGGWSQYAVTQIGNQGRIIACDILDMNPIVGVDFLQGDFREVSVLNALLARVGDEMVDVVMSDMAPNFSGMPSVDIPRAMYLVELALDMCRQVLAPKGSFVVKVFQGEGFDDYLRDIRSMFTTVKVRKPEASRDRSREVYIVATGYKG

SEQ ID NO: 9880 - protein, 176 aa, Deinococcus radiodurans
MSLPPGNGPVQISAEQIKARIQELAAQIRSDYAGQRPHLICVLNGAFMFHTDLVRALDMPATIDFMQASSYGTAKQSSGEVRLVKDLAFPISDRHVIMVDDIVDTGITMSYLLHYLQGRGPASLKVAALLSKPSRRKVEVPVDYLGFTIPDAFVYGYGLDRAQLDRNLPFITSQEE

SEQ ID NO: 9881 - protein, 373 aa, Mycoplasma mobile
MKKDYYEILGLTKSASKDEIKKAYRTLAKTYHPDVNKETNAEEKFKEITEAYEILNDDVKREQYNQFGHAAFDPNAGGFGGQNPFTNAEGFSGFSDFSGFGSIFTDFFGGFGNSQRANPNRAQRGEDRHAVIKISFIDSVLGKEIVEPLEKFETCNTCNGSGAKSQSDIITCTQCSGMGEQIKITKTFLGQMQQNVICSKCNGIGKEIVEKCLICKGKTHTKTTKNITIKIPAGIQNGQTLRVENYGNAGLNGGSNGNLILSIKVSPHKHFVRKNNDIILRLPVSIKSVIGSEKVEVPTPYGFEIIKIDPNIKTGDELIIKNKGIITKYESGKMIVIFEIFIPKLTSFEKKEISTILEKNADKFYEKWIKEFE

SEQ ID NO: 9882 - protein, 393 aa, Oryza sativa
  misc_feature (293)..(293): Xaa can be any naturally occurring amino acid
MLIPILSCLVKMQIFVKTLTGKTITLEVEFSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGXRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGL

SEQ ID NO: 9883 - protein, 264 aa, Leuconostoc mesenteroides
MTLKIAIAQIDIALGKPAINEQTVIEYAQKAAAVEADILVYPEMWNTGYDLLNLETVSDPQGQRSVNLLRDLAKKYHLNIVGGSVATAQAENKFYNTMFVFNDKGEQVSEYNKLHLFGLMNEEKFMSAGNKTNLFNLADVPSAGAICYDIRFPEWLRTMMSQGPQEILYIVAEWPIQRIKQWQLLLQARAIENQTFVVAANRVGRDNDNTFGGRSLIIDPLGNIVQQASDDKVELLVAEININDEKAIRGEIPVFSDRRPELYR

SEQ ID NO: 9884 - protein, 249 aa, Variovorax paradoxus
GGNKPRKLEYLIPEALEGGYDTLVSIGGIQSNQTRQVAAVAAHLGLKCVLVQENWVNYSDAVYDRVGNIEMSRIMGADVRLDSAGFDIGIRKSWEEAMDDVRKAGGKPFPIPAGCSEHPRGGLGFVGFAEEVRQQEAELGFKFDYIVTCSVTGSTQAGMVVGFAADGRADRVIGIDASAKPEQTFDQIVRIAKGTAEPVELGRDITDKDVVLDRRFGGPEYGLPNEGTLESIRLCARLEGMLTDPVYPG

SEQ ID NO: 9885 - protein, 1006 aa, Actinobacillus pleuropneumoniae
  misc_feature (574)..(593): Xaa can be any naturally occurring amino acid
MILPNYFQDPNTLHVNTVEHHAYFIPHQQNETALSGKREQSDYFTLLNGQWDFNYFQSYHDLPDNFLDIAFEHKIPVPANWQNHGFDHHHYTNINYPFPFDPPFVPHQNPCGVYHRTVQLTPKSNKRYLLNFEGVDSCLFVYVNKQFVGYSQISHNTSEFDVSDYLQAGTNHLTVVVLKWCDGSYLEDQDKFRMSGIFRDVYLLEREQNYLQDFFIQYELDDELRHANLKVETLFSRQPQAIEYQLLNPKGFTVFNQTDTHLNIEVEDIQLWNAEKPQLYTLILRTAEEVIVQKIGFRKVEIKDGILLFNQQPIKFKGVNRHDSDPKTGYAISYAQAHKDLQLMKQHNINAIRTAHYPNAPWFSELCDQYGFYLIGESDVESHGASMLTVKMPEPSILLNHQNDLQTERIRQDMIDNYCYFARDPLFKKAILDRQQANVERDKNRTSIIIWSLGNEAGYGANFEAAAAWIKQRDKSRLVHYESSIYQHSADNNDLSNLDFYSEMYGSTEDIDRYCATAQAKPFVLCEYSHAMGNSNGDAEDYWQAFHRHPQSCGGFVWEWCDHAPYRANGQFGXXXXXXXXXXXXXXXXXXXXSPDRIPHSNLLELKNVNRPARAELIDNQIVIHNYLDFTDLADYLTIDYEFVENGVVTSGGNLSVSCQPHGSVVLPIELPKNNGHLWLLNLNYRLNTAVELLDEAHSLGFEQLNLFSENKLVLPKFTIENSAFEVQEDRFHINVHNGQFSYQLDKQKGIFNRIEKAGKAIIQQSLDFNIWRAPTDNDRLIREAWQNAGYDKAYTRAYEIQWQQSEQAVEFSVKSAIVSISRGRILTLDIRYRIFNDGQISVEINAIRPTELPYLPRFGLRFWLAKAENTVEYFGYGEQESYVDKHHLANLGIYHTTAKQNHTDYVKPQENGSHYGCEYLKSENLFVSASQPFSFNLSPYTQEELTAKKHCYELQESDYSVLCIDYKMSGIGSNSCGPNLKDQYRLMESEFKIRFDLIFDKTIRQ

SEQ ID NO: 9886 - protein, 427 aa, Mycoplasma pulmonis
MRRIRLNLQNAINEEKLKEYVSEVEQINTKMNNLSLEGFEYLGWKDLPENINKNEIDKIIETANFFKKEGIEVLVVIGIGGSFLGAKSAMDFIQGNYPTKKNMEIIFAGTSISSTELTQLLYYVENKKFAINVISKSGTTLEPAIAFREFRNLLNSRLGENNAKRYIVATTDANKGLLFEMAKEKGYARFVVPDNVGGRFSVLTPVGLLPLACAGIDIEKLLEGAKEANALYKNSNLLENDAYKYAVARFLLQKKFPVEMLVSYEPNHMFLLEWWKQLFGESEGKQGKGILPHSAIFTRDLHSLGQFIQDGSKIMFETVIWVDKPIFDLKIEKEIEDLDKLNYLTNKSLHQINKAAFEATVEAHTKVGLVPNIILELEDSSEKTLGALFMFFERAVAMSGYLLKVNPFNQPGVEVYKSNLFKILEKK

SEQ ID NO: 9887 - protein, 229 aa, Arabidopsis thaliana
MASSAFAFPSYIITKGASTDSFKSTSLSSSRSLVTDFHLLFSRPISSGPKYQSAKSAKPESPVAINCLTDAKQVCAVGRRKSMMMGLLMSGLIVSQANLPTAFASTPVFREYIDTFDGYSFKYPQNWIQVRGAGADIFFRDPVVLDENLSVEFSSPSSSNYTSLEDLGSPEEVGKRVLRQYLTEFMSTRLGVKRQANILSTSSRVADDGKLYYQVEVSQSQVPNYILLL

SEQ ID NO: 9888 - protein, 946 aa, Mycobacterium smegmatis
MSDQPKARNPQFVDRHIGPDESAVATMLDVIGVSSLDELAAKALPTGILDALDAAGRAPGLAELPPAATEEEALAELRALADTNTVAVSMIGQGYFDTLTPAVLRRNILENPAWYTAYTPYQPEISQGRLEALLNFQTMVCDLTGLEVANASMLDEGTAAAEAMTLMHRATRSKVNRLLVDTDVYAQTAAVLATRARPLGIEIVTADLSKGLPDGEFFGVVVQLPGASGAVVDWAPLIEQAHERKALVAVGADLLALTLITPPGEIGADVAFGTTQRFGVPMGFGGPHAGYLAVHANHARQLPGRLVGVSVDSDGSPAYRLALQTREQHIRRDKATSNICTAQVLLAVIAAMYASYHGAPGLTAIARRVHAHADAIASALGDAVVHDKFFDTVLVRVPGRADEVVAAAKAKNINLWRVDDDHVSVSCDEATTDAHIDAVIKAFGATRTDGAGTDIATRTSEFLTHPAFHRYRTETEMMRYLRSLADKDIALDRSMIPLGSCTMKLNAAAEMEPITWTEFSRQHPFAPASDTPGLRKLIADLQSWLTAITGYDEVSLQPNAGSQGEYAGLLAIKAYHEARGDADRDICLIPSSAHGTNAASAALAGMRVVVVACRENGDVDLDDLRTKVKEHADRIAALMITYPSTHGVYEHDVADICAAVHDVGGQVYVDGANLNALVGLARPGRFGGDVSHLNLHKTFCIPHGGGGPGVGPVAVRAHLAPYLPGHPLADELSDDHTVSAAPYGSASILPITWMYIRMMGADGLRAATLTAIASANYVARRLDEYFPVLYTGENGMVAHECILDLRGITKATGVTVDDVAKRLADFGFHAPTMSFPVSGTLMVEPTESESLAEVDAFCDAMIAIRGEIDRVGSGEWPVDDNPLRGAPHTADCLLVADWNRPYTREEAAYPLGKGWRPKVWPPVRRIDGAYGDRNLVCSCPPVEAFA

SEQ ID NO: 9889 - protein, 253 aa, Brassica napus
MATSSAMSLQSISKTSLGNLSHNHHFHRSSFLGFSRSFQNLGISSNGPDFSSQSRSTSKNLSPTRAFFWNWGKSENARPSKVQELNVYELNEGDRNSPAVLKLGKKPELCLGDLVPFTNKLYTGDLKKRVGITAGLCVLIQHVPEKNGDRFEATYSFYLGDYGHLSVQGPYLTYEDTFLAVTGGSGIFEGAYGQVKLRQLVYPTKLFYTFYLKGIADLPLELTGTAVSPSKDVKPAPEAKATEPGATIKNFTN

SEQ ID NO: 9890 - protein, 149 aa, Arabidopsis thaliana
  misc_feature (109)..(109): Xaa can be any naturally occurring amino acid
GPPALKAGKEGAEYLGTGPPKFHFSGQDGIDAKKDGIYPVGTLDGAPFKASPPVFLMSRKIKSLGGKRVLSGEGAAEIFGGALFFHKAPTKKKFPQKTWRRGFISPPKXRHHQFFLLTLIRRAGDNLQIKALPKYDCLKANKSTSAFGL

SEQ ID NO: 9891 - protein, 486 aa, Saccharomyces cerevisiae
MVHLGPKKPQARKGSMADVPKELMQQIENFEKNFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVSTRYPGFKEKAANALKDIYGWTQPHLDDYPIKVVPAEDGSGPGAAVIAALAQKRIAEGKSVGIIGA

SEQ ID NO: 9892 - protein, 358 aa, Unknown
  Acinetobacter sp. ADP1
MFIKNAWYVACRPEEIQDKPLGRTICGEKIVFYRGKENKVAAVEDFCPHRGAPLSLGYVEDGHLVCGYHGLVMGCEGKTIAMPAQRVGGFPCNKAYAVVEKYGFIWVWPGEKSLANEADLPTLEWADHPEWSYGGGLFHIQCDYRLMIDNLMDLTHETYVHSSSIGQKEIDEALPVTKVDGDHVVTERYMENIIAPPFWQMALRGNHLADDVPVDRWQRCHFFAPSNVHIEVGVAHAGHGGYNAPKTRKSLQWLSIVVTPETETSHWYFWGMARNFQPENQQLTDQIREGQGKIFTEDLEMLEQQQQNIVRNPQRQLLMLNIDAGGVQSRKIIDRLLAKENSPSPQDTQRKFPNIRVI

SEQ ID NO: 9893 - protein, 485 aa, Saccharomyces cerevisiae
MVHLGPKKPQARKGSMADVPKELMDEIHQLEDMFTVDSETLRKVVKHFIDELNKGLTKKGGNIPMIPGWVMEFPTGKESGNYLAIDLGGTNLRVVLVKLSGNHTFDTTQSKYKLPHDMRTTKHQEELWSFIADSLKDFMVEQELLNTKDTLPLGFTFSYPASQNKINEGILQRWTKGFDIPNVEGHDVVPLLQNEISKRELPIEIVALINDTVGTLIASYYTDPETKMGVIFGTGVNGAFYDVVSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFVFLEDTDDIFQKDFGVKTTLPERKLIRRLCELTGTRAARLAVCGIAAICQKRGYKTGHIAADGSVYNKYPGFKEAAAKGLRDIYGWTGDASKDPITIVPAEDGSGAGAAVIAALSEKRIAEGKSLGIIGA

SEQ ID NO: 9894 - protein, 473 aa, Triticum aestivum
MARADDAADRRRVIGHGSVDDDGKPKRTGTVWTASAHIITGVIGSGVLSLPWSMAQLGWVAGSVTLFLFAVVTYYTSALLADCYRCDDAVTGKRNYTYMEAVESYLGSRQVWFCGLCQYVNLVGTAIGYTITASISAAALYKADCFHKNGHSADCGVYTTMYMAVFGISQVVFSQLPNLHEIAWLSILAAVMSFSYSAIGVGLALAQTISGPTGKTTMGGTEIGVDVTNSAQKIWLTLQALGNIAFAYSYSMVLIEIQDTVKAPPAENKTMRRANLLGVSTTTAFYMLCGCLGYAAFGNAAPGNMLTGFGFYEPFWLIDFANICIVVHLIGAYQLYCQPIYAAVEKWAAARWPGSDFVVRQYHPFAGGNFSFSMFKLVWRTAFVAVSTVLAILMPFFNAILGLLGALAFWPLTVYFPVEMYKRQSKVERFSKKWVVLQSLSFTCFAVTVAVTVASVQGITQSLNNYVPFKTKL

SEQ ID NO: 9895 - protein, 486 aa, Saccharomyces cerevisiae
MVHLGPKKPQARKGSMADVPKELMQQIENFEKNFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIHIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVSTRYPGFKEKAANALKDIYGWTQPHLDDYPIKVVPAEDGSGPGAAVIAALAQKRIAEGKSVGIIGA

SEQ ID NO: 9896 - protein, 420 aa, Chlorobium tepidum [sequence omitted]

SEQ ID NO: 9897 - protein, 151 aa, Glycine max
  misc_feature (114)..(114): Xaa can be any naturally occurring amino acid
GGGPLTKVLKKKWTREGGRPFVFPVGGQTFWEPGGILKPDRKMDQKIKKGPGMAKLEDLVVVGGRGGPMAGLQLEPQWMAWKEGVHAFFVGKDQNSFTTFVKGWLDELKVAVGXKNMANIKNPRGLGYARIPSKELNLEKKMAAPTGVVLD

SEQ ID NO: 9898 - protein, 493 aa, Unknown
  Frankia sp. EAN1pec
MTSTTDVRPVETVTTSHSPTTPQVAVNDIGSAEDFLAAVDKTIKFFNDGDIVDGIIVKVDRDEVLLDIGYKTEGVIPSRELSIKHDVDPHEVVTVGDHVEALVLQKEDKEGRLILSKKRAQYERAWGTIEKLKEEDGVVTGTVIEVVKGGLILDIGLRGFLPASLVEMRRVRDLQPYVGRELEAKIIELDKNRNNVVLSRRAWLEQTQSEVRSEFLAQLAKGQIRKGVVSSIVNFGAFVDLGGVDGLVHVSELSWKHIDHPSEVVEVGQEVTVEVLDVDLDRERVSLSLKATQEDPWRQFARTHAIGQVVPGRVTKLVPFGAFVRVDEGIEGLVHISELAERHVEIPEQVVNVGDEILVKVIDIDLDRRRISLSLKQANEASSLVAEGESFDPSQYGMEAKYDEQGNYVYPEGFDPETGEWLPGFEEQQAEWERQYAEAQTRFEAHQAQIRAAQEADAAAAAPSSYTSSQSEQPASAIDEEALRRLREQFGRE

SEQ ID NO: 9899 - protein, 463 aa, Arabidopsis thaliana
MAEEGFIGIGESEEEAAEIGAFSYSHHQISDLRRRSSAVKDDSAQTSTPSSPPPPLPIHAGGSAVGATGKAKKKTGGARLWMRFDRTGAMEVVECDKSTIIKRASVPARDLRILGPVFSHSSNILGKNFDLLIPGLAREKAIVVNLEVIKAIVTAEEVLLLDPLRPEVLPFVERLKQQFPQRNGNENALQASANVQSPLDPEAAEGLQSELPFEFQVLEIALEVVCSFVDKSVAALETEAWPVLDELTKNVSTENLEYVRSLKSNLTRLLARVQKVRDELEHLLDDNEDMADLYLTRKWIQNQQTEAILAGTASNSIALPAHNTSNLHRLTSNRSASMVTSNTEEDDVEDLEMLLEAYFMQLDGMRNKILTVREYIDDTEDYVNIQLDNQRNELIQLQLTLTIASFAIAAETLLASLFGMNIPCPLYSIHGVFGYFVWSVTALCIVLFMVTLGYARWKKLLGS

SEQ ID NO: 9900 - protein, 348 aa, Phaseolus vulgaris
QIGVCYGMMGNNLPSANEVINLYRSNNIRRMRLYDPNGAALGALRNSGIELILGVPNSDLQGLATNADTARQWVQRNVLNFWPSVKIKYIAVGNEVSPVGGSSWYAQYVLPAVQNVYGAVRAQGLHDGIKVSTAIDMTLIGNSYPPSQGSFRGDVRSYLDPIIGYLLYASAPLHVNVYPYFSYSGNPRDISLPYALFTSPNVVVRDGQYGYQNLFDAMLDSVHAAIDNTRIGYVEVVVSESGWPSDGGFGATYDNARVYLDNLVRRAGRGSPRRPSKPTETYIFAMFDENQKSPEIEKHFGLFKPSKEKKYPFGFGAQRMQRLLLMSSMQHIPLRVTCKLEPSSQSLL

SEQ ID NO: 9901 - protein, 203 aa, Glycine max
WRIVCPSPIIETRNNNLEMQSVNNKSLIEELDKLLERLRVPSEYATNLTGGSFDEARMLQNVEACEWLTSALRGLGVPNLDPSYANMRTVKEKRAELEKLKSTFVRRASEFLRNYFASLVDLMISDKSYFSQRGQLKRPDHADLRYKCRTYARLLQHLKSLDKNCLGPLSKAYCSSLNLLLRREVCCTSCWFYLFLNCLAFLL

SEQ ID NO: 9902 - protein, 128 aa, Oryza sativa
MQTAASSVVGLSAVLPAAVKGRSLQIQAPRRVALRVRAAAAAVAVEAAEVDYSSNISVFPMEACDLIGGEACNVQMYPEAKLSSSAAVAVSRAAAEEVDRDYLSYDEPTTVFPEEACDDLGGEFCKAT

SEQ ID NO: 9903 - protein, 734 aa, Unknown
  Synechococcus sp. RS9916
MSKSKRKSSGFSNTPKSHTSRKKLGQSSEDHFIKEEEAVALMDQGRLQEAESIYRELIAAGTNNHIVYGNLAALCGMQGRFSELIKLLRRTLEIKPNYPEAHYNLGLALKEQGDLTAAIASYNKALQLRPNYPEAHNNLGNAYKDQGDLTAAIASYNSALQLNPNDPETHNNLGVVLKKQGDPTAAITSYHQALQLQPNYPEAHYNLGIAFKEQGDLTAAIASYNKALQLKPNDADTYNNLGNALKEQGDLTAAIDSFNKALQLKPNFPDAQWNSALTMLLGGDYKSGWEKYEWRTKGEKEHAKPHAIPKCKQRSGKFDLRQSDPLLLVTEQGLGDTLQFMRYAIALRDKGISISLCAQPKLHPLIKASGIDPSPLTPKQANQVTEGEWMPLLSVPGQLEVSPSNPVFTNPYINTKKELTKKWADILGEKAHPVIGINWQGNPKAEKAGLRGRSLALEAFAPIANNTSISLLSLQKGFGSEQLDTCSFKERFVSCQDQINETWDFLETAAIIGNCDLVITSDTAVAHLAGGMGKTTWLLLHKVPDWRWGLEGDTTFWYPSMRLFRQKEQGNWHELMERVAEALQKQFGSTAMPTEPTPPPQPSAKPQPIQDILAPISLGELIDKITILQIKTQHLQGAALVNVKAELNALETTLNKLQLNLDPTHVQRLKQVNQDLWQIEDEIRDQERRNNFDETFIRLARSVYQQNDQRAAIKKEINTTYGSVFVEEKSYQQY

SEQ ID NO: 9904 - protein, 164 aa, Schizosaccharomyces pombe
MASADHTRDPCPYVILNDFGAAFSMGTIGGAIWHSIKGWRNSPPGEKRISAIAAAKTRAPVLGGNFGVWGGLFSTFDCAVKGVRRKEDPWNAIIAGFFTGGALAVRGGWRATRNGAIGCACILAVFEGLGIALGRMNAEYNRPVAPVIPDAPASGSTSAAPAAV

SEQ ID NO: 9905 - protein, 574 aa, Kluyveromyces lactis
MCGIFASFRNPDVQAYKPKALQLSKRIRHRGPDWSGNIVKNSTILVHERLAIVGLDSGAQPITSEDGSYTLAVNGEIYNHIMLREECASYPFKTLSDCEPIIPLYEKYDIDAPKHLDGMFAWCLYDSKKDRIIAARDPIGITTLYMGRSSASPKSVWFSSELKCLTDDCDEIIAFPPGHVYDSETDKLTRYFTPDWLDESRIPTTPVDFKAVRESLEKAVRKRLMAEVPYGVLLSGGLDSSLIAAIAARETEKTNAELDPVVYDSDPHQLAGLDEQGHLHAAGWSRLHSFAVGLPNAPDLQAARKVATFIGSIHHEHTFTLQEGLDALDDVIYHLETYDVTTIRASTPMFLLSRKIKAQGVKMVLSGEGSDEIFGGYLYFAQAPSAAEFHVESVKRVKNLHLADCLRANKSTMAWGLEARVPFLDRDFLQLCMNIDPNDKMIKPAEGKIEKYILRKAFDTTDEPDLKPYLPEEILWRQKEQFSDGVGYSWIDGLKDAAESTISDEQFAQPKAEWGDDIPTTKEAYWYRLKFDALFPQKTAASTVMRWIPKADWGCAEDPSGRYAKIHEQHVDKK

SEQ ID NO: 9906 - protein, 505 aa, Coccidioides immitis
MDQSVPAAVADAGPSAENRSRRESFASQNSHTAAEFINAQLQLELDAREALPYSFDSCTRPLGPLRQSLFSCLTCNPPPADSNTPYNPAGVCYSCSISCHGEHTLVELFTKRNFVCDCGTTRLPPTSPCTLRTDPKTGAKSVHSDEPSSENKYNQNFRNRFCCCAEVYDPHREKGTMFQCLGLGSVETGGCGEDWYHPECLVGLPRSWNEKNPEDQAKDKEKVNNNSEENADNSDPPLPPGFPGEDEFESFICYKCLDSNVWLKRYAGTPGFLPPVYKNRSNPAQADITVLTPNAPAKDDSGRKRKLDIDLDSEPGLKRAKSDSTNEEPLKISTPPALVREKHNSLPQDIPSGTFSLFVKEDFRDYLCHCAACFPSLIPHPQLREEEETYEPPLSEPGDGAQGAPSAGSQHTGSLLERGEAALSNLDRVRAIEGVMVYNHLKNKVKEFLQPFAESGTPVGAEDIKAYFEKLRGDDEAIREAGSKRNGSYEDNNDEGDSRREQSGK

SEQ ID NO: 9907 - protein, 262 aa, Brassica napus
MDSRWSLRGMTGLVTGGTKGIGYAIVEELAGFGARVHTCARDQTLLDECLNEWKAKGYQVTGSVCDVSSRPQRDELMKTVSSLFSGKLNILINNVGTLTSKPATEFTAQDFSSQIATNLESAYHLSQLAHPLLKASGFGSIVFMSSVLGVVSAGPVSIYSLTKGGMNQLARNLACEWASDGIRANSVAPWVTRTPPAQDRLDAKKYAEAICSRTPLGRTCEPSEVASLVTFLCLPAASYITGQTIFIDGGLTVNGFSYKPEV

SEQ ID NO: 9908 - protein, 411 aa, Mycobacterium tuberculosis
MASSTTFVIVGGGLAGAKAVEALRRSDFGGRIILFGDEEHLPYDRPPLSKEFLAGKKSLSDFTIQTSDWYRDHDVDVRLGVRVSSLDRSAHTVELPDGAAVRYDKLLLATGSAPRRPPIPGSDAAGVHYLRSYNDAVALNSVLVQGSSLAVVGAGWIGLEVAASARQRGVDVTVVETAIQPLLAALGEAVGKVFADLHRDQGVDLRLQTQLEEITAADGKATGLKMRDGSTVAADAVLVAVGAKPNVELAQQAGLAMGEGGVLVDASLRTSDPDIYAVGDIAAAEHPLLGTRVRTEHWANALKQPAVAAAGMLGRPGEYAELPYLFTDQYDLGMEYVGHAPSCDRVVFRGNVAGREFLSFWLDGDSRVLAGMNVNVWDVVDDVKGLIRSGNPVDVDRLVDPQWPLADLTTN

SEQ ID NO: 9909 - protein, 134 aa, Vibrio parahaemolyticus
MSELEKTLLNIRSLRALLRELTNAELEEAYSKFKTVVEERRLEEEAIRAEQIKKEEKLADIARQIKEQGLDVYELLSALSSTTPKKKGKRKPRPAKYKYIDTNGVEKTWTGQGRTPLVIQKALDEGKKLLDFAL

SEQ ID NO: 9910 - protein, 645 aa, Sinorhizobium meliloti
MCGFGGYLGSIRDGKPLLERMTAAIGHRGPDERGIFTAPGAGLGHVRLSIVGLGDGQQPMSNPSGELTIAFNGEIFNYVELRDELRARGRQFRTSSDTEVILHLYEEMGEDCLSLLNGDFAFAIWDARRRRMMLARDRMGVRPLFHTLKGGTLYFASEVKALLEVPGVSAEIDPIALDQIFTLWAPIAPRTPFRDIHELEPGHLMIADQNGTTTRPYWQLDYPDRDERPAYAEESRAAEELRALLTDATRIRMRADVPVGAYLSGGLDSSIISALAAGMTSQGLRTFSVTFDSAEHDESAFQEEMAAALGTEHRAVACRAGDIARDFPDVIRFTEKPIIRTAPAPLYKLSGLVREAGLKVVLTGEGADEVFAGYDIFKEARVRRFCGRQPGSRIRPHLFRKLYPYLPGLQQQSAEYLAAFFGAGDVALDDPLFSHRPRLKGTAATKMFFSSDLRAELTGYDAAEELVSRLPAAFGRWHPLHQAQYLESRFLLPGYILSSQGDRMAMAHGIEGRFPFLDHRLVEFAAKLPPEMKLRGLVEKHILREATKDLLPPAIGRRTKQPYRAPDSHSFSGAGELDYVRSAMSEDAVAAGGLFNAKAVTKLYEKCQSRPASGFRDNAAFVGVLSTQLWLQTFTGTSLRKAEAA

SEQ ID NO: 9911 - protein, 160 aa, Pseudomonas fluorescens
MSAFHDLKLTALDGQELPLAPFKGQVVLVVNVASKCGLTPQYAALENLYQQYKGKGFSVLGLPCNQFAGQEPGSEQEIQEFCSLNYGVSFPLSKKLEVNGHDRHQLYRLLAGEGAEFPGDITWNFEKFLLGKDGRVLARFSPRTAPDDPSVITAIEKALS

SEQ ID NO: 9912 - protein, 84 aa, Haemophilus influenzae
MRIKNRLFLEDTMAKEDCIEMQGTILETLPNTMFRVELENGHVVTAHISGKMRKNYIRILTGDKVTVEMTPYDLSKGRIIFRSR

SEQ ID NO: 9913 - protein, 220 aa, Candida albicans
MARRPARCYRYCKNKPYPKSRYNRAVPDAKIRIYDLGRKKATVDEFPLCIHLVSNELEQLSSEALEAARICANKYITKVSGRDSFHLRVRVHPFHVLRINKMLSCAGADRLQQGMRGAWGKPHGLAARVSIGQIIMSARTKDSNKDVVIEGLRRARYKFPGQQKIIISKKWGFTPLNRDEYIAKKTNGEVIDDGAYVKFLSRKGNLEANLQQFPNYQYSA

SEQ ID NO: 9914 - protein, 320 aa, Pseudomonas fluorescens
MSEFRHSRVIILGSGPAGYSAAVYAARANLKPLLITGMQAGGQLTTTTEVDNWPGDVHGLTGPVLMERMREHAERFETEIVFDHINAVDFASKPYSLTGDSGTYTCDALIIATGASARYLGLPSEEAFMGKGVSACATCDGFFYRNKPVAVVGGGNTAVEEALYLANIASKVTLIHRRETFRAEKILIDKLNARVAEGKIELKLNATLDEVLGDNMGVTGARLKNNDGSFDEIKVDGVFIAIGHTPNTSLFEGQLELKDGYLVVQGGREGNATATSVEGIFAAGDVADHVYRQAITSAGAGCMAALDTERYLDGLQNASF

SEQ ID NO: 9915 - protein, 178 aa, Triticum aestivum
  misc_feature (165)..(165): Xaa can be any naturally occurring amino acid
  misc_feature (171)..(171): Xaa can be any naturally occurring amino acid
  misc_feature (176)..(176): Xaa can be any naturally occurring amino acid
  misc_feature (178)..(178): Xaa can be any naturally occurring amino acid
RGSRRLPRAAVAMGRRPARCYRQIKNKPYPKSRYCRGVPDPKIRIYDVGMKKKGVDEFSHCVHLVSWEKENVSSEALEAARIACNKYMTKHAGKDAFHLRVRVHPFHVLRINKMLSCAGADRLQTGMRGAFGKPHGVCARVAIGQVLLSVRCKPNNAIHATEALXRAKFKXPWPPXDX

SEQ ID NO: 9916 - protein, 149 aa, Lotus japonicus
MGSIAVKLFLILGLLATSCVAQAPGAAPTQAPTTTPPPPPAAAPAPPPATPPPAATPAPTTTPPAATPAPSASPPAPTPTASPTGAPTPSASSPPAPIPSGPASGPGPAAGPGPNSADTPPPPSAAFSLNQPIIAGTALVATFFAMVLA

SEQ ID NO: 9917 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQQQLVPLVWPSSADSNLSAPKVLPDGRGSVSLKSRYQRSV

SEQ ID NO: 9918 - protein, 160 aa, Brassica napus
DAWADAWAATPRPSNLTNAEIYSLQSSRNPTPRGSSFNHTDFYSMMGAAGGGRNSNFGPGEAVFGSKGPTPRPSNYEEDGGAKPPAGGGAGRFHHQSGGSGAHYPAPNPGMFSPQTGGGAAAAKGSAPVGGGKRGSGQDGNGRDPHMCVWSSSASPVSAL

SEQ ID NO: 9919 - protein, 402 aa, Oryza sativa
MASLAQHVAGLASPPLSGAPRRRPAAPTRPSALVCGTYALTKEERERERMCQLFDEASERCRTAPMEGVSFSPEDLDSAVESTDIDTDIGSLIKGTVFMTTSNGAYVDIQSKSTAFLPLDEACLLDVNHIEEAGIRAGLVEEFMIIDENPGDETLILSLQAIQQDLAWERCRQLQAEDVVVTGKVIGGNKGGVVALVEGLKGFVPFSQVSSKSTAEELLDKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLTLSSEGILGPLSSDTPSEGSGEGQTTDE

SEQ ID NO: 9920 - protein, 329 aa, Escherichia coli
MARFVTCRPDKTRKRRIRQHHVWIEIVSTLEQTIGNTPLVKLQRMGPNNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPAEYLPGIFNASLVDEVLDIHQRDAENTMRELAVREGIFCGVSSGGAVAGALRVAKANPGAVVVAIICDRGDRYLSTGVFGEEHFSQGAGI

SEQ ID NO: 9921 - protein, 567 aa, Shigella flexneri
MLRPVETPTREIKKLDGLWAFSLDRENCGIDQRWCESALQESRAIAVPGSFNDQFADADIRNYVGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDISVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAGNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNN

SEQ ID NO: 9922 - protein, 659 aa, Arabidopsis thaliana
MSAYTSLNFLFLLTFFIGSLRVSAQLQDPTYVGHVCTNRISRNSIYFSNLQTLLTSLSSNNAYFSLGSHSLTKGQNSDMVFGLYLCKGDLSPESCRECVIFAAKDTRSRCPGGKEFLIQYDECMLGYSDRNIFMDTVTTTTIITWNTQKVTADQSDRFNDAVLSLMKKSAEEAANSTSKKFAVKKSDFSSSQSLYASVQCIPDLTSEDCVMCLQQSIKELYFNKVGGRFLVPSCNSRYEVYPFYKETIEGTVLPPPVSAPPLPLVSTPSFPPGKGKNSTVIIIAIVVPVAISVLICVAVFSFHASKRAKKTYDTPEEDDITTAGSLQFDFKVIEAATDKFSMCNKLGQGGFGQVYKGTLPNGVQVAVKRLSKTSGQGEKEFKNEVVVVAKLQHRNLVKLLGFCLEREEKILVYEFVSNKSLDYFLFDSRMQSQLDWTTRYKIIGGIARGILYLHQDSRLTIIHRDLKAGNILLDADMNPKVADFGMARIFEIDQTEAHTRRVVGTYGYMSPEYAMYGQFSMKSDVYSFGVLVLEIISGRKNSSLYQMDASFGNLVTYTWRLWSDGSPLDLVDSSFRDSYQRNEIIRCIHIALLCVQEDTENRPTMSAIVQMLTTSSIALAVPQPPGFFFRSNHEQAGPSMDKSSLCSIDAASITILAPR

SEQ ID NO: 9923 - protein, 494 aa, Vibrio vulnificus
MTIHVKNNIHWVGQRDWEVQDFHGTEYKMTKGTSYNSYLIREEKTVLIDTVDHRFSQQFIQNLQMEIDLQSIDFIVINHAEEDHSGALSALMEKIPNTPIYCTEAAIDSIVGHHHHPEWNFKTVKTGDSIDIGNGKQLVFVEAPMLHWPDSMMTYLTGDAVLFSNDAFGQHYCDERLFNDEVDQAELMEQCLRYYSNILTPFSALVTAKIQEVLSFNLPVDMIATSHGIVWRENPTQIIEQYLAWANDYQEDRITIFYDSMSNNTRMMADAIAQGIHDVDPSVAVKVFNVSKQDKNEILANVFRSKGILVGSSTMNNVMMPKIAGMLEEITGLRFKAKKAAAFGSYGWNGGAVDRIHARLTDAGFETAISLKTKWRPDGKAMRECREHGQQIAKLWAVKDKSTLSTPVNAFQSATPIEGIEAQQPLTETTPTADAAHSADCQCMVCTVCNWVYDPAKGEPNQGIEVGTTWADVPDYFLCPECHLGKDVFVEYQG

SEQ ID NO: 9924 - protein, 567 aa, Clostridium acetobutylicum
MSMFCYQCQETAGCKGCTVKGVCGKDESVAKAQDLLIYVTKGLAVVSNEGMKVGVKDSKVNKYIVENLFTTITNANFDRDSILDRVRETLRIREDLKAKVVKAGGKVGEVKVSGGFFKKLFGIAKEEMVGPDAATWTADNVIEFDAKAEKVGVLSTENEDIRSLRELITYGLKGLSAYMKHAMNLKYDDETVHEFMAKALAATLDDSLSVDQLVALALEAGKFGVNGMALLDKANTETYGNPEITTVDIGVRKNPGILISGHDLRDLEMLLEQTEGTGVDVYTHGEMLAGQYYPKFKKYKNFAGNYGNAWWKQKEEFEKFNGPIVMTTNCIVIPKASYKNRLFTTGATGMPGCPHIEAKADGTKDFSEVIKMAKKCSAPTEIEKGQIVGGFAHNQVIALADKVVAAVKSGAIKRFFVMAGCDGRANSRNYYTEFAEKLPKDTVILTAGCAKYKYNKLNLGDIGGIPRVLDAGQCNDSYSLVVIALKLQEVFRLKSVNELPISYNIAWYEQKAVIVLLSLLHLGVKNIHLGPTLPAFLSPNVAKVLVDNFGIGGITNVEDDMKMFMQG

SEQ ID NO: 9925 - protein, 382 aa, Vibrio vulnificus
MSDPIIIIGSGFAAYQLVKSVRRLDAHIPIQIFTADDGAEYNKPDLSHVFSKRQTAADLVVKSGEAFAEEYNVQLHAHTQVERVLTQQQQVVANGRCYPYSKLVFATGAQAFVPPMRGDGLAKVMTLNSLQEYQAAEQPLSRAQHVLVIGGGLIGVEIALDLATSGKQVTVVEPNARLLANLLPEFIALPLEQQLMKHGIQLALNSRVESVTEQGQTLAIALHDGREFAVDAVLCAAGLKANTAVAREAGLSVERGICVDHQLNTSDPHIYALGDCAQIEGRMLPYLQPIVLSANVLAKQLVGQEARLTLPPMMVKVKTPSYPIQLAGDFSPESHWQVQLSPEGIVAKAQSPLGDFTGFVVTGEYVTQAFPLLRELSQRANG

SEQ ID NO: 9926 - protein, 511 aa, Zea mays
  misc_feature (415)..(415): Xaa can be any naturally occurring amino acid
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLXITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 9927 - protein, 674 aa, Arabidopsis thaliana
MSSLISFNFLFLFSFLTSSFTASAQDPFYLNHYCPNTTTYSSNSTYSTNLRTLLSSLSSRNASYSTGFQNATAGKAPDRVTGLFLCRGDVSPEVCRNCVAFSVNQTLNLCPKVREAVFYYEQCILRYSHKNILSTAITNEGEFILSNTNTISPNQKQIDGFTSFVSSTMSEAAGKAANSSRKLYTVNTELTAYQNLYGLLQCTPDLTRADCLSCLQSSINGMALSRIGARLYWPSCTARYELYPFYNESAIETPPLPPPPPPPPPRESLVSTPPISSSSLPGKSGNSTVLVVAVVVLAVLLFIALVGYCFLAKKKKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQIQLDWMQRYNIIGGIARGILYLHQDSRLTIIHRDLKASNILLDADINPKIADFGMARIFGLDQTQDNTSRIVGTYGYMAPEYAMHGQFSMKSDVYSFGVLVLEIISGRKNSSFGESDGAQDLLTHAWRLWTNKKALDLVDPLIAENCQNSEVVRCIHIGLLCVQEDPAKRPAISTVFMMLTSNTVTLPVPRQPGFFIQCRAVKDPLDSDQSTTTKSFPASIDDESITDLYPR

SEQ ID NO: 9928 - protein, 483 aa, Yarrowia lipolytica
MGSKSATKDISKIKKADKKDSKKAVKATEPASESGASTSSDESTSSDDSSDSDSDSSDSDSSGSDSSDSSDSSDSDSSDSDSDSDSEDEKPVKKEETKEENESSSSDSDSDSDSDSSSSSSDSDSDSDSDSDSDSADENEKKETKEVKEVKEDKKEAKKEAKKEAKKEESSDSGSSESSDSDSDSDSDSDSSSSDSSSSDSDSDSDSSSSDSDSDSDSSSSDSDSDSDSDSDSDSDSDSDSDDEKETKKETKKETKKETKKETKKEDAKDVEMKDASSDSSDSSDSSDSSDSSDSSDSSDSSDSDSSSDSDSSSSDSDSSSDSDSSSSDSDSSSDSDSSSSSDSDSSDSDSSSSSDSDSDSSDEEEQPPAKKRKAEEIEVESLVIKKPKTDSPVDNSYVEATFEEEGGRKFFSRIDRTKISFEDQSLMDNTYKGAAGTWGEMANDKLMKVRGKDFTKGKNKMKKGAYKGGSITMSSGSYKFTD

SEQ ID NO: 9929 - protein, 394 aa, Thlaspi caerulescens
GSICGYDSLHQLLSANLKPELYEEVSRLLRGSNCGRWLEQIVLPDAAKDLSSKHDFDLQAVSFSADKEQMRKPRVVRVGLIQNSIALPTTAPFSDQKRGIFEKLKPIIDAAGFAGVNILCLQEAWTMPFAFCTREKKWCEFAEPVDGESTKFLQELAKKYNMVIVSPILERDIDHGEVLWNTAVIIGNNGNIIGKHRKNHIPRVGDFNESTYYMEGDTGHPVFETVFGKIAVNICYGRHHPLNWLAFGLNGAEIVFNPSATVGELSEPMWPIEARNAAIANSYFVGSINRVGTEVFPNAFTSGDGKPEHNDFGHFYGSSHFSAPDASCTPSLSRYRDGLLVSEMDLNLCRQYKDKWGFRMTARYEVYADLLASYVKPDFKPQVVSDPMLHKNSS

SEQ ID NO: 9930 - protein, 178 aa, Unknown
  Frankia sp. EAN1pec
MTVHDFTVEATDGTSRSLRDYAGKTLLIVNVASKCGLTPQYEGLEALYRDLKGRGLEILGFPCNQFGGQEPGTDAEIQEFCSTNFDVTFPVFSKIEVNGPGAAPLYDYLRSEAPGDFGPESGFLYEHIKRSRPEAIGTDEVKWNFTKFLVDGEGKVVRRFEPTVTPDELRGELDTSLA

SEQ ID NO: 9931 - protein, 337 aa, Acidobacteria bacterium
MSRIAVIGAGAWGTALAIVLGRRGGHAVRLWAYEQEVVASILARRTNDLFLPEASIPATVTVTDSLTDALNGAEIVLSVMPSHHVRRLFTQMLPHLSDDMVFVSATKGVEDQTYLRMTEVIEEVVTPRFSPRLVAVSGPTFAKEVAKGDPTAITAASSDEDLARTVQHEFSDPRFRVYTNRDVVGVELGGALKNVIAIAAGICDGLELGHNSVAALVTRGLAEITRLSLACGGHIETMAGLAGLGDLVLTCTGGLSRNRTVGVELGKGRKLADIIAGMRGMVAEGVLTTNAAIGLANKHGVEMPITQQMHAILHQGKSPSDAIRELMSRPSTTEVWL

SEQ ID NO: 9932 - protein, 394 aa, Haemophilus ducreyi
MIEKIQKFLKLEAAGGILLLIAALLAMLCANSVFSPYYFEFLQTQVAVKLGAFSIDKPLLMWINDGFMAVFFILVGMEVKRELLEGSLSSYQKAIFPAFAAIGGMVVPALIYWFINRDYPEYQQGWAIPMATDIAFALGIVALLSKQVPATLKVFLLALAIIDDIGAIIVIALFFSNELSMLALIIASIAIMILITMNRYKVTGIIHYVIVGTILWASVLKSGVHATLAGVIIGFCIPLRGKKGETPLHDLEHTLAPWCAFAILPLFAFSNAGVSLAGMSLAKLTSPLPLGITLGLLIGKPVGVFSFCYLAVRAGLAKLPEGINFKQVFAIAVLCGIGFTMSVFIAGLSFGEEHPDETILALSRLGILIGTSIAAIVGYILLKKTTNKPLVQAG

SEQ ID NO: 9933 - protein, 804 aa, Unknown
  Magnetococcus sp. MC-1
MNPRLEEWLNSFMAAPLESWQHYVTGARRIPGSERLDPADSLKQLYVELPDNHAAFALLDKTLTQWLPRFVEWDSPTRQQFGLSRYVYWIAEIMVAATMLPLPQLRQHLMDNFFTYRGRLTPLQLAPSRDALAEFLRVMAGSREFASNVPNFWMGLCQKAGYSIPEYYLHIGIRGLRNCPKPINEQAPLWVGGLVAWLPNASSKEQFINTFYMIKVLYPSTPSRWEKLIQPIIATLESREKVPTDRIAWLRALVREGKQSPDRSQSRPKPSALYAPHKTPYRDELQPLLKTIEDDRQAWPQVEKPLHKLLERHQHYYAQTAESYFFVRAVNFTIQKLLKCPPAYPFAQRWIEQVLEIDPWDPANWNLQGRLLVAMGKRERAEWVFWESTRRFPDNSLNYTELGQLLLKQPGREDEAEQILREAMALDSNNIPPRTELGRLYMQQGKLEEAEQVLREVIGLDSNDIHVRTELGRLYMQQGKLEEAEQVLQEAMALDSNNIPPRTELGRLYMQQGKLKEAEQVLQEAMALDSNNIPPRTELGRLYMQQGKREEARWVLEQVLDIESEDHVARGLLSRLERGEQPAARDLSQPKQSHGSVQRVAAPPQVQESDPVALVGVLVRADFRLRISEDHIPVLKKQGQQDLQGMLKQHAGMAVVSFYASRHGLTEEPLEGESLNRWAMQLDRLLLAEGVSVEARQEGLQEVARHLSGRLVKDWLKAAAGEAEAWQRLRQAVLGEAKDAGMPDDQFVKGQIGQIFKAPALQHDSPPPPWAEQRPGLQNLAARLVEANTDLFLHKVKDGEEVAA

SEQ ID NO: 9934 - protein, 385 aa, Phaeodactylum tricornutum
MKVATTLTLAFICCASAFGLNGQTTSVMKKVGFGAGSKPMVQAIDVQGNRLGSNMQPLKSAVANEDAPRGGATKSPVDIGLLLYFGLWYLGNYYYNITNKLALNAAGGKVGFPMTISSLQLGVGSIYALFLWLAPDARSRPKISMDDIVKMLPVALCFMGAHSASVFAMGMGAVQFAQIVKASEPAFAAVLSQFVYGKKSRRHKWLCLPIVIGGVILASVKELDFAWSALIAACIANMFAAVRGNENKKLMETPGLKDRIGTVGNQFAITTVLGFILSLPVLFLREGSRFGEFVQLAKTTPAIWMNLVASGLWFYGYNECATMTLKKTGAVTQSVANTAKRVIVIVGVALVLGESLSPIKLIGCSIGIGGVFLYSIIDNLVKPKK

SEQ ID NO: 9935 - protein, 610 aa, Ustilago maydis
MVRIMKSLGFLSCLAALLSSNVTAAARIDSANRQIKMAVGARTNGSWDSAPAPAPAPARPGSYLETQDGYAASTSTATGSSAQAQIDGVLTTSSGIGGPARIELPLDAISSAAFGSADVEQIIASANGEFTVLSHRDFPSVSVRIKQLYSPRPASQLREHEVDPDAFCDPTVTSWSGYIDTAYGGKSLWFYFFESRSNPAKDPVILWTNGGPGCSSSLGLFMELGPCRVPERGGKLTPGPPINGTKWHAQSWTNRANVFFIDQPVGVGYSYSKTDQKVYTTEEAAKDVYAFLRVFFSAFDRFKKNEFYMAGESYGGRYIPIFASEVADRNHDVERKALKAGKQVDHDQLINLKGVLIGNGLTDVSKQISGYYDMTCTRRGGVEPILSIETCKRMHTYVPVCREQLGKHCVESYNPDLCDLWLAKCSDEIEAPYFYTGQNPYNIKDDCKSGLEPNLCYDVTDDIRKYLDRDDVRELVGAASKDQIGKFASCNNDVASGFSRMLDMAHDNGFNVAGLLERGIKALVYVGTLDWICNFNGNFEWVKTLDWSGSQSFSEAKNYEWVVDGEKAGRTQSGGGLTWVTVYEAGHMVPYDQPDAALAMLNRWIDGQDL

SEQ ID NO: 9936 - protein, 407 aa, Kluyveromyces lactis
MSFPDVLDRGDEFLSQYPRTNPFWQIASHGTCLLAVGISKFMLNTFYNVKLNNLEKLQEAVARTKTENRGLMTVMNHMSVVDDPFIWGVFPWSMYWDLDQIRWCLGAHNVCFQNKFLATFFSLGKVLSTERFGGGPFQGSIDASIRLLSPDDTLDLEWTPHHIEPLKKEIEKQPTLEGNNKIFDKLSVKDGHVVKYVAPVARSKPSWIHVYPEGFVLQLQPPFSNSMRYFRWGITRLILESTKSPIVVPMFSTGFEKIAPESSAGTMIERYLPRNMGAEINVTIGNPIDDAIIDGYRKEWLALCDKYHDPKNPTDLSWELKYGKEVQDLRSRLAAELRAHVAKIRHEERRFELEDERFKSAAWWGRYTETEGASDPDVKFIGQNWAIRRLQKFLNDYDDAENPGKHE

SEQ ID NO: 9937 - protein, 484 aa, Haemophilus influenzae
MSVKGDIGVIGLAVMGQNLILNMNDHGFKVVAYNRTTSKVDEFLQGAAKGTNIIGAYSLEDLASKLEKPRKVMLMVRAGDVVDQFIDALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYDEMQAIFAEWKNTELDSYLIDITTDILGYKDASGEPLVEKILDTAGQKGTGKWTGINALDFGIPLTLITESVFARCVSSFKDQRVAANQLFGKTITPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 9938 - protein, 198 aa, Capsella rubella
MASSSSPQAFLLLALSMVLVPFSLAQAPMMAPSGSMSMPPMPSGGGGSMIPPPAMTPPPMPMMTPPPMPMMTPPPMPMMTPPPMPMMTPPPMPMMTPPPMSMTPPPMPMMTPPPMSMTPPPMPMASPPMMSMGPSPSPLTVPGMASPPMPSGMESAASPGPMPPPMAASPDSGAFNVRNNVVAVSCVVGVVAAHLLLV

SEQ ID NO: 9939 - protein, 447 aa, Mycoplasma mobile
MTSIKHLLINAKKYDQKEFEIKAWVASNRGNTNIRFVEINDGSTIKNLQVVIKKEIMSFLEVDKIRLGAAIHVKGVLKYTPGMAQEIELNADKFILLKNTDEDFPIQKKETSLEALREIPHLRHRTTTLRAIMLIRSTLALEIHKFYNERGYLWVSSPIITGNDGEGAGESFVVDDESKDFFFNKKATLGVTGQLHAEAYALGFSKVYTFAPTFRAENSNTTKHAAEFWMMEPEVAFFDLKDLIKMSDDMLRQVIKRTVEAHPHEFEFFEKNKPGLLKNLNLFLNNKLSILEYREAIKILEKVKDRFEDKNIFFGKDLATEHEKYLAEKHIQGPVAVINYPKSFKAFYMFQNEDNETVAAYDLLVPGIGEVIGGSKRETRYEKLVQRVKDLKINQEDLQWYLDLRRFGQASSAGFGLGFERLIMYITGTENIRDTIPFPRTPKNMKM

SEQ ID NO: 9940 - protein, 105 aa, Brevibacillus choshinensis
MAIVNGTDQNFSQEVEQGGTVLVDFWAPWCGPCKMIAPVLEQMDSEVGSKLKIVKVNVDDNPDSAGRFGVMSIPTLIVFKDGQPVDKVIGFQPKEALMATVGKHL

SEQ ID NO: 9941 - protein, 126 aa, Impatiens sodenii
MVVTVRCGHCTSLLSVNMTKSTFLPLHLLASMSPDEPKFDVSPTVLKEGTENDQNPTDKRNSSHIMSSDDEDDDLIPLNHVVNKPPEKRQRAPSAYNNFIKEEIRRLKVRNPSMSHKEAFSAAAKN

SEQ ID NO: 9942 - protein, 311 aa, Desulfitobacterium hafniense
MSKIARSLTDLIGNTPLLELSNYNRTTELEAKVIAKLEYFNPLSSVKDRIGYAMIKDAEEKGLLNKDTVIIEPTSGNTGIALAFVSAARGYRLILTMPETMSVERRNLLKALGAELVLTPGPAGMKGAIQKAEELAAEYQNSFIPQQFNNPANPEIHRQTTAEEIWRDTDGEVDIFVAGVGTGGTVTGVGEALKKKKPGVKVIAVEPADSPVLSGGTPGAHKIQGIGAGFVPGVYNSEVIDEIFQVKNEEAFETSRKLSKTEGLLVGISSGAAAYAATQIAKRPENKGKNIVVLLPDTGERYLSTVLFQEG

SEQ ID NO: 9943 - protein, 374 aa, Hevea brasiliensis
MAISSSTSGTSSSFPSRTTVMLLLFFFAASVGITDAQVGVCYGMQGNNLPPVSEVIALYKKSNITRMRIYDPNRAVLEALRGSNIELILGVPNSDLQSLTNPSNAKSWVQKNVRGFWSSVLFRYIAVGNEISPVNRGTAWLAQFVLPAMRNIHDAIRSAGLQDQIKVSTAIDLTLVGNSYPPSAGAFRDDVRSYLDPIIGFLSSIRSPLLANIYPYFTYAYNPRDISLPYALFTSPSVVVWDGQRGYKNLFDATLDALYSALERASGGSLEVVVSESGWPSAGAFAATFDNGRTYLSNLIQHVKGGTPKRPNRAIETYLFAMFDENKKQPEVEKHFGLFFPDKRPKYNLNFGAEKNWDISTEHNATILFLKSDM

SEQ ID NO: 9944 - protein, 1274 aa, Ajellomyces dermatitidis
MTRGDETLLAVAGILQGLAKDVPDSASLPFNSYKSNNATNGDVAKINLPGENSDGKAVLERELEDLIRRIGTMQCFVPPSRRSTRAAISSGQDTNSHGSPKPLPGSDVNYEDDIHFLQNRVQLQAQEIQLQKDVISRVREELKEQEKNTEKALGKVKKEDVGILERELRKHQQANEAFQKALREIGGIITQVANGDLSMKVQIHPLEMDPEITTFKRTINTMMDQLQVFGSEVSRVAREVGTEGILGGQAQITGVHGIWKELTENVNIMAKNLTDQVREIATVTTAVAHGDLSQKIESRAKGEILELQQTINTMVDQLRTFATEVTRVARDVGTEGVLGGQAQIEGVQGMWNELTVNVNAMAENLTTQVRDIAMVTTAVAKGDLTQKVQANCKGEILALKTIINSMVDQLKQFAQEVTKIAKEVGTDGVLGGQATVHDVEGTWKDLTENVNGMAMNLTTQVREIADVTTAVAKGDLTKKVTADVKGEILDLKNTINGMVDRLNTFAFEVSKVAREVGTDGTLGGQAKVDNVEGKWKDLTDNVNTMAQNLTSQVRGISEVTQAIAKGELAKKIEVHAQGEILTLKVTINNMVDRLANFAHELKRVARDVGVDGKMGGQANVEGIAGRWKEITEDVNTMAENLTSQVRAFGEITDAATDGDFTKLITVNASGEMDELKRKINKMVSNLRDSIQRNTAAREAAELANRTKSEFLANMSHEIRTPMNGIIGMTQLTLDTDDLKPYPREMLNVVHSLANSLLTIIDDILDISKIEANRMVIEKIPFSMRGTVFNALKTLAVKANEKFLSLAYQVDSSVPDYVTGDPFRLRQIILNLVGNAIKFTEHGEVKLAISRSDREECKDNEYAFEFSVSDTGIGIEEDKLDLIFDTFQQADGSTTRKFGGTGLGLSISKRLVNLMGGDVWVTSEYGLGSSFHFTCVVELADQSISMISASLMPYKNHRVLFIDKGQTGGHAEEITEMLKQLDLEPIVVKDESQVPPPEIQDPTGKDSGHAYDVIIVDSVDTARNLRTYDEFKYIPIVLLCPVVSVSLKSALDLGITSYMTTPCQPIDLGNGMLPALEGRSTPITTDHTRSFDILLAEDNDVNQRVAVKILEKCNHGVTVVSNGLQAVEAIKKRRYDVILMDVQMPVMGGLEVLRTPIIALTAHAMLGDREKCIQAQMDEYLAKPLKQNQMIQTILKCATLGGSLLEKSKEPRMSSSGEPPHHVPNSNGMKSLDTKNQRPGMDSQATSASGGPNPNQKSDVVSTRQTRVASSWTKD

SEQ ID NO: 9945 - protein, 469 aa, Oryza sativa
PNSGTEVNPKPPTASLAAAAAAAAAHRRRRRGQEEEEEEEGGAMAPEPEDDIMNEKNPRPLDEDDIALLKTYGLGPYSTSIKKVEKEIKEMAKKINDLCGIKESDTGLAPPSQWDLVSDKQMMQEEQPLQVARCTKIISPNTDDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 9946 - protein, 350 aa, Bacillus halodurans
MESIKVVIVGGGQAGIAMGYYLVKEKVPFMILDANEQVGDSWRNRYDSLVLFTPRTYSQLPGFPMDGAPNGFPTKDEMASYLQQYANHFNLPMRHHTKVDRVTRQQNGRFHLKTTNGWIEAEKVVIATGAFQKPYLPPVLDSANNEMSQVHSSAYRNPAQIPGKSVLVVGGGNSGAQIAVELAKERNVTMAISHPFRFLPLKLLNKSMFSWLEWGGLLYAGIDTTRGRWFKKQKDPIFGKELKSLIKKGQIHLKPRVMNVQGKEVEFADHSRLSFDRIIWSTGFSPSYEWIDIDGVIATNGWPIHNRGITNIRGLYFLGLPWQYQRGSALVCGVGRDAEYLVPFIKHGDK

SEQ ID NO: 9947 - protein, 362 aa, Solanum melongena
WDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFTFSDFPLLNLPDEFRGSFDFIDGHEKPVKGRKINWMKAGILESDRVVTVSPYYAQELVSAVDKGVELDNVLRKTTITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9948 - protein, 433 aa, Clostridium tetani
MYKKWKCLVCGVIFDGDVPPNPCPVCGASSDNFEEVLVARNDFADDSKLNFVIIGNGAAGFYAADSVRNRNKNCNITMISKEKTYSYYRPLLSEYLNKEKLPSNFYLSKENWFEEKNINLILNTAVNNINPVDKKVLLSNGKTLNYDKLILANGGYNFIPPIEGKDKKGVFTLRGLEDSENIKDYAKKIKHATVIGGGLLGLEAAWELRNIGLDVSVIEFFDRLLPRQLDEKAGKLFQDSIKQSNVDIILGDSLVEILGDNSVESIKLKSGKEIKTDMVLFSIGIRSNKELAENCGLKTDKAVIVNEKMETNIDDIYACGDVAEFNGKNYGNWPAAVQMGKVAGANASGDNLNFKDFVSAIIFRAMNTKMFTCGNCDDNMVNVAYEDPKNGTYKKLFFEKDILVGATLLGDISSSGKLVEQIKNKTSINDIIK

SEQ ID NO: 9949 - protein, 154 aa, Arabidopsis thaliana
MGNHCTRIPCCKKVCSCICCCNRRNKTQARSQKGSYFIKGKVHPVSRMEKWEEKITEANSHGKILVVNFKASWCLPSKTILPIYQELASTYTSMIFVTIDVEELAEFSHEWNVDATPTVVFLKDGRQMDKLVGGDAAELQKKTAAAANLLLRQS

SEQ ID NO: 9950 - protein, 362 aa, Solanum myriacanthum
WDTSVAVEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9951 - protein, 346 aa, Nicotiana tabacum
MKTAQAQSATTLTMEVARVQAIASITKCMDTIPSEYIRSENEQPASTTLHGVLLQVPVIDIDDKNVVKLISDASKEWGIFQVINHGIPDEVIANLQKVGKEFFEVVPQEEKEVIAKTPGSQNIEGYGTSLQKELEGKRGWVDHLFHKIWPPSAINYRYWPKNPPSYREANEEYAKRLREVAEKIFKSLSLGLGLEAHEMMEAAGGEEIVYLLKINYYPPCPRPDLALGVVAHTDMSHITILVPNEVQGLQVFKDDHWYDVKYIPNALIIHIGDQVEILSNGKYKSVYHRTTVTKDKTRMSWPVFLEPPSEHEVGPIPKLVNEANPPKFKTKKYKDYVYCKLNKLPQ

SEQ ID NO: 9952 - protein, 362 aa, Solanum palinacanthum
WDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSADDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9953 - protein, 461 aa, Treponema pallidum
MAHLPKEYDFSIESLGESKIPSPIYLSHTLGDFIPNYVSDNEYISHELSARLGETVGPFTHKNLMERAGPRQKIFFNPHHVHAGIVTCGGLCPGLNDVIRAIVRCLWGRYGVKRISGIRFGYKGLLPDYNFDILPLTPEVIDNCHKTGGSLLGTSRGGGNRVVDIVDGIERLNLHILFIIGGDGSQKGAKEIADEIKHRNLKISIIGIPKTVDNDISFVQKSFGFDTAIVKATEAVAAAHMEARSQINGIGLVKLMGRESGFIATYTAIASHETNFVLIPEVSFDLDGPNGLLAHLEKRIALRKHAVLVVAEGAGQDLMVNADGVPSGDSQGGSLRVSSGTDASGNKRLADIGLFLKEKIGVYFKEKRIHINLKYIDPSYLIRSAVAAPIDSIYCERLGNNAVHAAMCGKTKMIIGLVHNKFVHLPIDVVVCQRKHVNPEGSLWRDALDATGQPIVMKNII

SEQ ID NO: 9954 - protein, 362 aa, Solanum platense
WDTSVAIEVKVGDSIEIVRFFHCYKRGVDRVFVDHPMFLEKVWGKTASKIYGPKAGQDYLDNELRFSLLCQAALEAPRVLNLNCSKYFSGPYGEDVLFIANDWHAALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9955 - protein, 351 aa, Solanum pseudocapsicum
WDTSVAIEVKVGDSIEIVRFFHCYKRGVDRVFVDHPMFLEKVWGKTGSKIYGPKTGQDYLDNELRFSLLCQAALEAPRVLNLNCSKYFSGPYGENVLFIANDWHTALIPCYLKSMYQSRGMYLNAKVSFCIHNIAYQGRFAFSDFPLLNLPDEFRGSFDFIDGYEKPIKGRKINWMKAGILESDRVVTVSPYYAQELVSAADKGVELDNVLRKTSITGIVNGMDTQEWNPATDKYTDVKYDITTVMDAKSLLKETLQATVGLPVDRKIPLIGFIGRLEEQKGSDILVAAIHKFIGLDVQIVVLGTGKKKFEQEIEQLEVLYPNKAKGVAKFNVPLAHMITAGADFMLIPSR

SEQ ID NO: 9956 - protein, 1108 aa, Acidobacteria bacterium
MDLISTQTWFKDAIIYEVHVRAFYDSVTDGIGDFGGITQKLDYLEDLGVTAVWLLPFYPSPLKDDGYDIADYNNVHPSYGSLREFQRFLREAHRRGIRVITELVLNHTSDQHIWFQRSRRAEPGSRWRNFYVWSDTPDRYQDARIIFKDFETSNWTWDPIAKAYFWHRFYSHQPDLNWENPEVREAMFDAMDFWFDMGVDGMRLDAVPYLYEREGTNCENLIETHGALRELRKHLDEKYKDKMLLAEANQWPEDAVAYFGKGDECHMAFHFPLMPRLFMSLRMEDRYPVTDILRLTPPIPETCQWALFLRNHDELTLEMVTDEERDYMYRTYAHDRTARINLGIRRRLAPLLENDRRKIELMNALLFSLPGTPVVYYGDEIGMGDNIYLGDRNGVRTPMQWSADRNAGFSKANPQKLYLPVNIDPEYHYEAVNVESQQNNPHSLLWWMKRVIAQRTQFKAFGRGTLEFLYPSNRKVVAYIRQYEDETILVVANLSRFTQCAELDLSRFNGLAPVEIFGRARFPNITEQPYFFSLGPHAYYWFHLQPREVTHESLTTNAAAPSVPTILVESTADVFAPATRDAFFRLLPAMLVSRPWFQGKSKTIRSLDLGDAIPLPQTGAYVVLLNVDYADGDPETYLTPLSIASGEKADAILRDRPDAVLAKLDDGKRQVLLYAGVYDREFADSLLRAIVKRKRFKGEIGELVAGHTRSFRKAWENQRAGLEPNTQPGERNTVTITYGENFNLKLYRKLDAGPNPDREMEEFLTEETSFTQIPRALGWLEYRRGEEESLEQTTIGLLVGYARNATNGWTYALDTLGIFFERALAIPQNDPRLKDLTDGSVLAMANQPLPPIMGELLGSLADNMRLLGQRTADLHVALASRPDIPTFAPEPFTEFYRHSLYHGMLGQSSRAMDTLRARLRSLPTASQDDAQALINRENELRARLLRLRDTRISGTRIRHHADYQLSNIQYTGSDFLVSNFEGNPERPIGERRIKRSPLRDIASMVRSFHYVSHAVLFDQVPGIVLSRDAYPQLERWATAWYQWVSALFLKGYLERAGTAAFLPRSQEERAVLLESYTLEKALIEIEYELTHRPNWVRIPVHGILEQLH

SEQ ID NO: 9957 - protein, 463 aa, Bacillus cereus
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPCWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIIATAIVLLVGVILNYLVPAKVFTWLTSISTFGAIWTWGIILVAQIKFRKSLPAQNKQKLSYKMPLYPISSYFSLAFLALVLCIMAYSEDTRIALIVGPIWLIGLAIVYYMKGFHKIDETPNSKIS

SEQ ID NO: 9958 - protein, 148 aa, Pseudoalteromonas tunicata
MKQLIQRIFTKQPAQNKPVEAPSPEKTPYELMGGEAGARALANRFYDIMAQEAYTKPLYDMHPQPLDRIRQVFFEFLSGWLGGPDLFVEKHGHPMLRKRHMPFPIDQDLRDQWMFCMNKALDEQVDNPLLREGLRQSLAQLASHMINQ

SEQ ID NO: 9959 - protein, 462 aa, Ralstonia metallidurans
MHAPDNQGTLKRGLKNRHIQLIALGGAIGTGLFLGIAQTIKLAGPSVLLGYALAGVVAFFIMRQLGEMVVDEPVAGSFSYFANKYCGHFAGFMSGWNYWVLYILVSMAELSAVGIYVQYWWPGIPTWISALAFFLIINAINLASVKSFGEMEFWFSIIKVAAIVGMIGFGGYLLATGTAGPDASIANLWQHGGFFPNGFSGLVMAMAVIMFSFGGLELVGITAAEADSPEKSIPKATNQVIYRILIFYVGALAVLLSLYPWEKVVTGGSPFVLIFHAMNSNVVATVLNIVVLTAALSVYNSGVYCNSRMLLGLAQQGNAPRSLMRVNRRGIPLTALAVSAIATGICVVINYFMPGEAFELLMGLVVSALIINWAMISIIHLMFRRAKAAAGKTTRFQSLGYPLTNYVTLAFLAGILVVMFLTPGLRISVYLIPVWLGVLGVSYRLRQKKAGSAMPAASAQIQ

SEQ ID NO: 9960 - protein, 113 aa, Acidobacteria bacterium
MMTKVEAVIQPSKLDAVKDALLAIGIDGMTVLEARGHGRQKGHTEFYRGREYTVDLLPKIKIELVVPDERTEEVVKAIADASRTGKIGDGKIFLSRIDDAIRIRNDERGPGAL

SEQ ID NO: 9961 - protein, 628 aa, Chlamydomonas reinhardtii
MDVFQYTTLDKGAGSALFRAPRLTYIGAADVQTRRARMSTGVDYLGHGAVKATEGPPVNPSGRKYPYELDSEGKAKSIPVWRFTNPHMGAFHLSWFAFFISFLATFAPASLLPIIRDDLFLTKAQLGNAGVAAVCGAIAARVLMGVFVDIVGPRYGTAATMLMTAPAVFCMALVTDFATFAAVRFFIGLSLCMFVCCQFWCGTMFNVQIVGTANAIAGGWGNMGGGACHFIMPLIYQGIKDGGVPGYQAWRWAFFVPAVFYIATALATLALGIDHPSGKDYRDLKKEGALKSKGAMWPVIKCGLGNYRSWILALTYGYSFGVELTVDNIIVEYMFDQFGLSLTVAGALGGMFGMMNLFSRASGGMISDLIAKPFGMRGRICALWIIQTLGGIFCVILGRVHNSLTSTIVIMIIFSIFCQQACGLHFGITPFVSRRAYGVVSGLVGAGGNTGAAITQAIWFAGTAPWQLTLTKYQGLEYMGYQTIGLTLALFFIWFPMWGSMLTGPREGATEEDYYIKEWSAEEVADGLHHTSLRFAMESRSQRGTRTSTQTKVMSVGDGAGSNKAEVVVVAAAQQGAVPMASVEEGSSGRSSSSGGHQQQDAHILHCIRTVVQKAPRVGERESERERD

SEQ ID NO: 9962 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 9963 - protein, 563 aa, Gibberella zeae
MAVIYIDEEAGSDLPEIQGTESAPFKSLLEAYFRHGAESEYQVKKKDDEEYKPAAKSALKKAVAYAAGQKKKLDAAAKRAEKDAQDEAARLAVLEEAKKIKITNDPSLPEPVSISLHQTDSSVIGTLRKSKDEPTEGVKRVSVQGRVNRVAKQGGLIFVTLRRGVNYMQCLLSGDLSKTYDALTLSRETSLEIIGELWEVPAGAHAPLDRELRADYFRVIAKAPGGDDAFTNIVPVDGDNNTLMNLRHLTLRHEKPAAVMFVRDVVEDAFHTVYKELDIKKVSPPALVQTQVEGGSTLFKFDYYGETSYLTQSSQLYLETVLPVLGDCYCIEKSFRAEKSLTRRHLSEYSHVEAELDFITFDNLLDHLEHVICRVIDLTLENPTAAEAIKKYNPDFQKPTRPFLRMRYSDAIDWLRERGIKNEEGNDHTFGDDIAEAAERKMTDEINRPIFLTHFPVEIKSFYMSKAKDDPRVTESVDVLMPGVGEIVGGSMRIWDYEELMAGYKREGIDPTGYFWYTDQRKYGSTPHGGYGLGAERFLAWLLKLWTVREACLYPRYMGRCTP

SEQ ID NO: 9964 - protein, 99 aa, Prochlorococcus marinus
MTSFKITFINELSGLKEIIDIPDDKYILDAACEQNIELPASCREGTCSTCVAKLEKGNVDQQDQSFLDDDQIEKGYILICKAYPLSDCIIRTHAEDQLY

SEQ ID NO: 9965 - protein, 185 aa, Debaryomyces hansenii
MTTSVSSALKTTPTSSLITLAAGCFWGVEKVFRRYFGNQGIIDIKVGYANGVPTVGNVNYEKVCSGSTDFVESIQISYEPSQVTLEKLLDTFFRMHDPTTVNAQGPDVGTQYRSAIMTHDEKAQKIAWDVKEKMQTEWYPNHKIVTIIEPIKIWYDAEEYHQEYLKKNPGGYECPSHFLRTKPKV

SEQ ID NO: 9966 - protein, 584 aa, Acidobacteria bacterium
MAKLVADLLIERLIHWGVDTVFGLPGDGVDGLFEALRTHQEKLRFIQVRHEEAAAFAACGYAKYTGRLGVCIATSGPGGIHLLNGLYDAKCDGQPVLAITGHTFHDLIGTSYQQDVDLDKLYMDVAAYNQRIMGPGHVESALDEAVRTALSRRTVAHLTIPKDIQEWRASNFHRSPANVPDHSGAIFEPAYPQPPQELLRRAADILNQGRKVAILVGQGCLAARAEVEQVAELLAAPVAKALLGKAVLPDRSPYTTGGLGLLGTAPSQDAMEECDTLLIVGTSFPYLEFYPKPGKAKCVQIDIDATRIGLRHPADVGLVGDSRTALRALVPLLKRREDRSFLETAQKRMESWNELMKERGTRTDLPMKPQVVTHTLNQLLRDDAIVSTDSGTITTWTARYIEMRGTMQFSVSGTLATMANGLPYSIGASVAHPGRQVVCIIGDGGLTMLMGEPATLVKYKLPVKIVVIKNNVLGQIKWEQMVLDANPQFGVELQPIDFAKVAEACGVAGFKLENPADAERVLRSALEHDGPALVEATVDANEPPLPGNVSLKQALHFAEALASGQKDAAEIIKTVVENKVREVI

SEQ ID NO: 9967 - protein, 791 aa, Medicago truncatula
MDTPERNQINTTLSKFEDSPVFNYINNLSPIKPVKSAHITQTFNSLSFSSPPSVFASPHVTSLKESRFLRRHNQPEESKAKDSYEDVNKLYSNDGAIEEPTLSRHNSRELDESAEQLISVGDVSIELSNEETKFTDELPQSLQYNCGSPGYDPTLCGDEDNTLLELSGEAVSDDAYPQGGCVTDSVEAELHFQGTSQIDRKGESSDCDWDGLIPNSANMLIEAEAFKGMMQKSSGSPIRLSDFVPLLQQCTRNDDQKIYMVDSVASSSQHEIENHCSELVAATDTDHTQDNLANGSSMTGNSNEKMDNELVSVTHRGIRRRCLDFEMASVRRKIADDNSNTNSSTQQSETMNAANENQLLPAKRNANSQRCILPGIGLHLNALASVKDHKGKEIENLTSGRQLSLTSSTSLLLSACQEHQHLSVVSVSISSERELVPSDNGVQPTEDCPQPIAYMATEDFNQNSPKKKRRKSEPVGEIEGCKRCNCKKSKCLKLIDLKMTILVLELTILFFFSYCECFAAGVYCIEPCSCQECFNKPIHEDTVLQTRKQIESRNPLAFAPKVIRSADSVPETGIDPNKTPASARHKRGCNCKKSNCLKKYCECYQGGVGCSISCRCEGCKNAFGRKDGSASIGIEGETEEETETSDKGAEEKAIQKTEIQNIEDHPDSAGVSTPLRLSRSLLPMPFSSKGKPPRSFVTTLTGSGYLTSQKLAKPNSLWSQSKTFQTVPDDEMPEILRGGDSSPIACIKTSSPNGKRISSPNCEMGSSPSRRGGRKLILQSIPSFPSLTHHP

SEQ ID NO: 9968 - protein, 692 aa, Unknown
  Synechococcus sp. WH 5701
MSSIQLGHPWPLGAALTARGVNFSLVAPSASRVELLLFARGSSPEPFRIIPLDLRHRSGDHWHVEVEGIGAGTCYGYRVYGPLHPGGHGFNPSKVLLDPCARAISGWDVYRRGDAIGAIPNTAACLKGVVTERDHFDFVAAPRPRHSWQTTVIYELHVGGLSRGQGSPVAPERQGSLLGVIDCLPYLRSLGVTALELLPVMAFDPQDAPHGRQNYWGYSPLSWMAPHQGYLVGDDPLAGRQQVRQLVTACHQAGIEVLLDVVYNHTSEGNQAGPTLSWRGLADRLYYHQNSRGDYLDVTGCGNTIAANRPLARRLLLESMRCWALELGIDGFRFDLGIALSRGEELAPLDKPPLFEEIEADPELSDLKLVSEPWDCGGLYRLNDFPARRMGTWNGRFRDDVRRFWKGDDNGSWLMAQRLSGSPDLYGGKPATAGRSITFITAHDGFTLADLVSYDRKHNLANGEDNRDGDNHNNSWNHGVEGPCSDLQINELRNRQIRNMLGTMLLAPGVPMLLMGDEVRRSQGGNNNTWCQNNPLGWMHWRPDEDDQRLHRFLSRLVRLRRRLERLLNPEIPHADSPPSKPGERDLIWREWHGVELLQPDWGSWSHSLAWSLHDMRHGPLLWCGMNAYYQPMVFKLPEASAGWLRVIDTGAPDGDDVMASPQPWIAEEAALESRSLMLLLASHLGEKAVEA

SEQ ID NO: 9969 - protein, 1465 aa, Adiantum capillus-veneris
MATPGGPKTKHSVSVAQTRADARLHAAFEGSGDAGAGGSRAPFDYSKSGMDASSVTSVAPEAITAYLQRMQRGGLTQAFGCMLVVAGQKIVAFSENAPEMLEVAAGLGTDLRMLFTQGSTAALDQAVKEEDLSSVNPLVLQSCGGSAKQFYAMLHRIEDVAGVVIDLEPIENGVVEKKSSAEMAVKPIARVQSLPGGEIGRLCQVVVEEVQEMTGYDRVMAYKFHEDGHGEVVAEVRRPDLEPYLGLHYPSTDVPQASRMMFMKNGVRMIGDCTLPPVRVVQAKELAQPISLAGSTLRAPHGCHAQYMSNMGSAASLTMAVAIDDYDDDSSLSCGSRKLWGLVVCHHPSPRTVSYPLRCACEKLMVAFGVQLNIELDLAAQLRENHILTTQALLCDMLRRIRGAPIGIVSRSPSIMDLVKCDGAALYYGGRFWPLGTTPSEFQIRDLAEWLLGASEEIASTGVTCTDSLAEMGYPGAALLGDAVCGMAAAMITPNSDFLFWFRSHTAKEVYWGGAEHDPQSRDDDSWMQLPRSSFKAFLEIVKRRSLPWEEVEVDAIRSLQLILREDLEQFCAAVGAVKASDGDDEDSLVPSAKKLSLKETEENGGADNSKKLERMHSAAAGGGGGGGRWEKMRLPSSLAQEWMEAIRGTGDGGASGGGGGGPFDWDLISAFQHNSFIVVDALKPDFPIIYASTGFFNLTGYTSREVIGGNCRFLQGPDTNPADVASIREALAQGTGTFCGRLLNYRKDGSSFWNLLTIAPIKDDLGSIVKLIGVQLEVSKYTEGIRANNRRPNGMPQSLIRYDVRHQDKVSAFIAQLVAALTKPDKVETPRLSSAMRFSLTGQTIESLPQPTAIPREGGGRTRRPRSSSFLSLLGMEKEKDIPEEDELQELEVIMLEDASVGRPGSLDDPERTRRGIDLATTLERIGKSFVITDPRLPDNPIIFASDRFLELTEYTREEVLGNNCRFLQGRGTDRKAVQLIRDAVKEQRDVTVQVLNYTKGGRAFWNLFHLQVMRDENGDVQYFIGVQQEMVAPRPVHQPPELPDILPDRVEQEKAEVVRATAQRVDAAARELPDANLVPDHLFAPHSKVVTPLPHSKTNSSSWFAIRRVQRRLRRGERLGLKHFRPIKPLGSGDTGSVHLVELRGTGQVFALKAMDKSMMLQRNKVHRARAEREILAIMDHPFLPTLYASFQTKTHVCLITDYCPGGDLFLLQDKQPTQTLSERTASFYAAEVVVALEYLHCMGVIYRDLKPENVLLQKNGHILLTDFDLSFLTSCRPQLILQGGKGRSRRSKRRRRVTFCAEPRVSSNSFVGTEEYIAPEIISGEPHSSAVDWWALGILLYEMLYGRTPFVGRNRQKTFYNVLNKELIFPTSIPVSLAGRQLIAGLLQRDPTIRLGTLRGASELKKHPFFREINWPLIRWRKFSANQAHNANNVSSLDEGESDSGNAWEANGGSTQSFQDTF

SEQ ID NO: 9970 - protein, 1175 aa, Gibberella zeae
MASAYNVRITTSQTTPHRTISSLIMTSSLSIEEFLEPLSVDIDKIEQLSQNFLETFEKLASDSENQGGTNLRVGFVQLGNDASSATSDQLNGHVGNGPDEGATTRQVRRLLEKSWPIDEHLKNENPDSLFLWIGQCIAEVVQDGCKTLQLKADQPMPLGVTFSFPMVQHSISQATLMPMGKGFAISSDQDLGGRLTDGYNRAKSPDLPPIRVEAIANDSVSTLVSFIFNFHEASNRRACMGLILGTGCNATIPLKLSQLSPSKRPPSVVARPEERAEDVNIAINTEWSINGTAPPLYDVGLVTRWDRALDQQGELNSFQPLEYLTSGRYLGELGRLMLVDYLTEHLGIAAGTLPKALLQRHNLTTTYLSHFKPLQPSTLMTSLQQEFPESSGSPPFEWTEEIATALYRIAKAIEVRAAGIVAAATLALLTLAGDVPMDGAHALDRDCELGVGYTGGCIVHFQNYLQDCQDFLDELLSKRFGDESPLRVRQELFSRDSLGLLGFQQPLQFNHLQVACADDSSYLRGGYSIVVMSPQKTSPVSDAPTTRPVPVPVRTNSRGSESDQDVVDPTAYEALSRSFTTGAHFLQPESLESAMLRPSSYKASLHLHRGVDEEDQGAVTEGDDESEISTDLDDEGPNEETPLVRHQSRRLSLTGRSTISVDVTPSPFLNNTSPTRFWFIFSQILAAYFISCFDGTIMASSHPVVSSYFNASNSASWFSTAFLLTSSAFQPLLGRLSDALGRKPLFVGAMGIFAASITWSSLAGSIESFILSRAFCGIGAGGVMTLGSIIVSDLVPIENRGAYQSYINMNYGVGSSLGAATGGAIADSLGWRWEFGIQVPPLLICMVVAWIAIPDDLGIQGQRKSVWQALREFDFRGSLLLTTAITSVILGLTLGGNVMPWSHPIVIASLVLFAITFPLFIWVESWVHKPIMPLHLIYKAPRANLVASNAIAALIANSILFNIPLYFQAVLLTTATSSGLRLIIPTIAASATGTFTGFAVTYTGRLKWPVQIGTICTLIGTIGLASLQRDLPSWVYLFILMPSSIGQGFQFPGTFMAILAASDQSEQAVVTSTLMLWRSLGQVLGVASSSLVVQNALFHYLKQFVTGEDRDEIIRHVRESVEEIIKLEPKYREQVILSYEAALRLTFICCIVVALASALIVVPIKLPRLGVRKHK

SEQ ID NO: 9971 - protein, 315 aa, Magnaporthe grisea
MFGFFETKFNPTKDIPDLSGKVILVTGGNIGLGQSSVLELARHNPKHIFLAARNEEKARKAIESVSWELGTDKASVVSFLPLDLSSFDSIRKAAETVNSKTDELHILLNNAGIMMTPATTTKEGYEEQFGTNHMGHALLTRLLLPVLEKTAQGGKVDVRIVNLSSAGEGLAPTNAFDDLSRYKSPMEDVASHTRYGVSKLANIYHAQMLARKYPSIKAVSVHPGVVNTNLTRGLKETYPWIVPYVAPIAGALFFKTPAEGAKNQLWASTNEKVISGEFYWPVGLLGKGSEKSKDTEAAEKLWDWTEKELDAYLKQ

SEQ ID NO: 9972 - protein, 530 aa, Oryza sativa
MCGILAVLGVADVSLAKRSRIIELSRRLRHRGPDWSGIHCYQDCYLAHQRLAIVDPTSGDQPLYNEDKSVVVTVNGEIYNHEELKANLKSHKFQTASDCEVIAHLYEEYGEEFVDMLDGMFAFVLLDTRDKSFIAARDAIGICPLYMGWGLDVCRIKILVLIYVPSKKFKVFVTGHEVGFFFDVISGSLFKAIIKRLMTDVPFGVLLSGGLDSSLVASVVSRHLAEAKVAAQWGNKLHTFCIGLKGSPDLRAAKEVADYLGTVHHELHFTVQEGIDALEEVIYHVETYDVTTIRASTPMFLMSRKIKSLGVKMVLSGEGSDEIFGGYLYFHKAPNKKEFHEETCRKIKALHLYDCLRANKSTSAWGVEARVPFLDKNFINVAMDIDPEWKMIKRDLGRIEKWVLRNAFDDEEKPYLPKHILYRQKEQFSDGVGYSWIDGLKDHANEHNAARLTVPGGPSVACSTAKAVEWDAAWSKNLDPSGRAALGVHDAAYEDTLQKSPASANPVLDNGFGPALGESMVKTVASATAV

SEQ ID NO: 9973 - protein, 362 aa, Solanum pseudolulo
WDTSVAIEVQVGDSIEIVRFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSREIYLNAKVAFCIHNIAYQGRFAFSDFPLLNLPDEFRGSFDFIDGHEAPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9974 - protein, 316 aa, Agrobacterium tumefaciens
MIIGSGPAGYTAAIYAARAMLKPVLIAGMEQGGQLMITTDVENYPGFADPIQGPWLMDQMLKQATHVGAEIVSDLVTEVETNVRPFVVRTDSGQVWTADTLIIATGAKAKWLGIESEQHFQGFGVSACATCDGFFYRNKDVIVVGGGNSAVEEALYLAHIAKSVTVVHRRDSFRSEKILQERLFAKENVKILWNTEIAEITGAPAKPPMPPSVSGVRLRDTKTGAISDTPIDGVFVAIGHAPAVELFKGKVKLKDNGYMWTAPDSTATDVEGIFAAGDVTDDIYRQAITAAGMGCMAALEAERYLTAQQPLAVAAE

SEQ ID NO: 9975 - protein, 92 aa, Zea mays; identical to SEQ ID NO: 376

SEQ ID NO: 9976 - protein, 362 aa, Solanum quitoense
WDTSVAIEVQVGDSIEIVRFFHCYKRGVDRVFVDHPMFLEKVWGKTGSKIYGPKAGQDYLDNELRFSLLCQAALEAPRVLNLNCSKFFSGPYGEDVLFVANDWHTALIPCYLKSMYQSRGIYLNAKVAFCIHNIAYQGRFAFSDFPLLNLPDEFRGSFDFIDGHETPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9977 - protein, 715 aa, Dechloromonas aromatica
MFNVVKKTFAYGDHQVTIETGEVARQAGGAVLVSMEETVVLVTVVAAKNAKPGQDFFPLTVDYQEKTYAAGRIPGGFFKREGRPSEKETLTCRLIDRPIRPLFPDGFYNEVQVIATVMSLNPEIDSDIPALIGASAALAISGVPFNGPIGAARVGYIDGQYVLCPTLSQLKGSQLDLVVAGTEAAVLMVESEADQLSEEVMLGAVVFGHTEMQKAINAINELVEEAGKPEWEWEAAPKDEALVASLSALVSAKLEEAYNITVKQTRSQAVKAIRAEAVAALCTGAEGAPDENTVGNLFHEIEASIVRGRILSGAPRIDGRDTRTVRPITMRSGVLPRTHGSALFTRGETQALAVATLGTNRDEQIIDALAGEYRDRFMLHYNMPPYATGECGRVGTPKRREIGHGRLAKRALLAVLPKPEDFSYSMRLVSEITESNGSSSMASVCGGCLALLDAGVPLKAHVAGIAMGLIKDGNRFAVLTDILGDEDHLGDMDFKVAGSTTGITALQMDIKIQGITKEIMQVALAQAKEARIHILNLMQESAAGPREEMSAYAPRLYTFKINPEKIRDVIGKGGAVIRALTEETGTTIDIQDDGTITIAATSGEAAAAARSRIDAITAEVEIGKIYEGTVLKILDFGAIVSVLPGKDGLLHISQIAQERVNKVEDYVKEGQIVRVKVLETDDRGRVKLSMKAAAADEGTVAQPVAAPEAAVQQQQ

SEQ ID NO: 9978 - protein, 387 aa, Medicago truncatula
MAIAAAAVVVPLGLLFFASGLIVNFFQAICYVLVRPLSKNLYRRINRVVAELLWLELVWLIDWWAGVKVEIYTDRETSRLMGKEHALVICNHRSDIDWLVGWVLAQRSGCLGSTLAVMKKSSKFLPVIGWSMWFSEYLFLERSWAKDENTLKSGIRRLNDFPLPFWLALFVEGTRFTNVKLLAAQEYATSTGLPVPRNVLIPRTKGFVSAVSHMRSFVPAVYDITVAIPKSSPAPTMLRLLQGKRSVVQVHIKRHLMNELPETDEAVAQWCRDIFVAKDALLDKHVAEDTFSDQELQDSRRPIKPLAVALSWGFVVVAGSVKFLQWSSLLSSWKGVAFSTFGLAVVTGLMQVLILFSQAERSNPAKVAPAKPKNKEEQPEAINDKQQ

SEQ ID NO: 9979 - protein, 362 aa, Solanum robustum
  misc_feature (5)..(8): Xaa can be any naturally occurring amino acid
WDTSXXXXVKVGDSIEIVRFFHCYKRGVDRVFVDHPMFLEKVWGKTGSKIYGPKTGQDYLDNELRFSLLCQAALEAPRVLNLHCSKYFSGPYGEDVLFIANDWHTALIPCYLKSMYQSRGIYLNAKVAFCIHNIAYQGRFAFSDFHLLNLPDEFRGSFDFIDGYEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9980 - protein, 1399 aa, Vibrio vulnificus
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADGDGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAISLIADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYSLDKVELVTGVKANDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVADITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 9981 - protein, 510 aa, Ralstonia metallidurans
MSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFPALPEIEKDDSPVTRPLAPASAE

SEQ ID NO: 9982 - protein, 362 aa, Solanum sisymbriifolium
WDTSVAIEVEVGDSIEIVRFFHCYKRGVDRVFVDHPMFLEKVWGKTGSKIYGPKTGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9983 - protein, 362 aa, Solanum stagnale
WDTSVAIEVKVGDSIEIVRFFHCYKRGVDRVFVDHPMFLEKVWGKTGSKIYGPKTGQDYLDNELRFSLLCQAALEAPRVLNLNCSKYFSGPYGEDVLFIANDWHTALIPCYLKSMYQSREIYLNAKVAFCIHNIAYQGRFAFSDFHLLNLPDEFRGSFDFIDGYEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 9984 - protein, 399 aa, Bacteroides fragilis
MEQKTRIKGNVHYVGVNDRNKHLFEGMWPLPYGVSYNSYLIDDEMVALIDTVDICYFEVYLRKIRNIIGDRPINYLIINHMEPDHSGSIRLIKQHYPDIVIVGNKQTFGMIEGFYGVTGEQYLIKDGDFLALGRHKLRFYLTPMVHWPETMMTFDETDGILFSGDGFGCFGTLDGGFVDTRMNIDHYWGEMVRYYSNIVGKYGSPVQKALQKLGGLPISAICSTHGPVWTENITKVVGIYDKLSRYDADEGVVIAYGSMYGNTEQMAEAIAAELSAQGIKNIVMHNVSKSNPSYILADIFRYKGLIIGSPTYSNQIFPEVESLLSKILVRELKGRYLGYFGSFTWAGAAVKRMAEFAEKSKFELVGDPVEMKQAMKEITYQQCENLARAMAGRLKKDRV

SEQ ID NO: 9985 - protein, 116 aa, Agrobacterium tumefaciens
MGNQMKIVMAIIKPFKLDEVREALTGVGIQGLTVTEVKGYGRQKGHTEIYRGTEYAVSFLPKLKIEIAVPSDVVDKAVEAIASAAKTGQIGDGKIFVYSIEQAVRIRTGETNTEAL

SEQ ID NO: 9986 - protein, 471 aa, Bacillus cereus
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVVFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQQTIPQEIN

SEQ ID NO: 9987 - protein, 956 aa, Herminiimonas arsenicoxydans
MNVLNSIDYGTPKSTSENMVTLEIDGVEITVPQGTSVMRAAAEVGINVPKLCATDSLEAFGSCRLCLVEIEGRRGYPASCTTPAEAGMKIKTQTPKLADIRRGVMELYISDHPLDCLTCPTNGNCELQDMAGVVGLRDVRYGYDGENHLKLEKDESNPYFTYDASKCIVCNRCVRACEETQGTFALTIDGRGFASRVAASQNESFIESECVSCGACVDACPTATLTEKTVIMMGQGEHSKITTCAYCGVGCSFKAEMKGNEVVRMVPNPDGKANQGHACVKGRFAWGYATHKDRMLKPMIRSKISDPWREVSWEEAINYTASEFKRIQAKYGKDSIGGLVSSRCTNEEGYLVQKLVRAAFGNNNVDTCARVCHSPTGYGLKVTLGESAGTQTFESVMKSDVIVVIGANPVNAHPVFASQMKRRIRQGAKLIVVDPRTTEMVKSPHVQADYHLKLMPGTNVAIVNALAYVILSEKLHKPEFIAERCEADSFKEWEHFILQEENSPEAVEKISGVPAEDIRAAARMYANAKNGSIYYGLGVTEHAQGSTTVIGIANLAMATGNVGREGVGVNPLRGQNNVQGSCDMGSFPHELPGYRHVSDSTTRAEFEAAWNCVLDPEPGLRIPNMFDAAMDGTFMGLYCQGEDIVQSDPDTQHVTAALSAMECIVVQDIFLNETAKYAHVFLPGSSFLEKDGTFTNAERRISRVRKVMPPKAGKGDWEVTCMLSNALGYPMSYKHPREIMDEIASLTPTFTGVSFKRIDELGGSIQWPCNDAAPEGTPTMHIGEFVRGKGKFIDTKYFGAGEKVTRKFPLILTTGRILSQYNVGAQTRRTHNNMWHSEDRLEIHPQDALDRGIKHNDWVGIESRAGQTVLRAEITENVQPGVVYTTFHFPESGANVITTSSSDWATNCPEYKVTAVQVMPVTQPSEWQSTYNRFNTEQESFASDKLIPKEVSTAGK

SEQ ID NO: 9988 - protein, 593 aa, Zea mays
  misc_feature (195)..(195): Xaa can be any naturally occurring amino acid
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISIXCNLPSIPHPTFSRHPVPFFLSPRLSNQMNLEAAVEAAAAFLNKAVKPVLVGGPKMRVSKACEALAELADACGYPVAVMPSAKGLVPEHHSRFIGTYRCAVSTPFCAEIVESADAYLFAGPVFNDYSSVGYSLLLKKEKAIIVQPERVVVGHGPAFGCVLMKDFLHALATRLKKNTAAYENYRRIYVPLGEPLPSEPGEPLRVNVLFKHIQAMLSGDTAVIAETGDSWFNCQKLKLPEGCGYEFQMQYGSIGWSVGATLGYAQAAKDKRVIACIGDGSFQVTAQEVSTMLRWGHNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 9989 - protein, 136 aa, Zea mays
ADDRRDHQLAVRNPERALRAVALPLRLISIPCPKKRQHHPWTGGRRRGGDQAIPTAGAQQCTAPSSSRSSTAELLLAFVFVAVSLAFLPLVLPPLSPPPFLLLLVPVGLLAVLLALAFVPLDAHSHLVVVGSGSSR

SEQ ID NO: 9990 - protein, 448 aa, Acidobacteria bacterium
MDKPRRNFWQIVNMSVGFLGIQFGWNLQMANMSAIYEYLGARADQIPILWLAAPLTGLIVQPLIGHASDHTWGKLGRRRPYFLTGAILSSLALILMPRSGALWMAAGLLWILDASINISMEPFRAFVADILPEEQRTRGFAMQSLMIGLGAVMANVLPYLLLKFGNLKADTTGYAIPLAVRISFYVGAAAFFGAVMWTILTTKEYPPDDLEAFRKKKEKKGGLGLGEIVNAVREMPMTMRQLAPVQFLTWLGLFCMWLFFGVAVARNVLGATDAKSKLYTDGIAWGGICFAFYSGVTFVYSFFLPAIAKAVGRRRAHSLSLLCGAAGLISVAFIHDKNFLLLSMVGVGIAWASTLAMPYSILAASLPPERTGVYMGIFNFFIVTPEIIASLVFGWVMVHWLNNNRLYAVIAGGVFMIAAAIMMQFVTDPAEKKVRATEPEAVVASRRG

SEQ ID NO: 9991 - protein, 320 aa, Yarrowia lipolytica
MAATDPKKYLFNHTMLRIKDPKVSVPFYEKHFGMKVLGHYKFEQFKFDIYYLAYDHPESPYYGKPVWDRQGVLELTHNYGTENDANYKINNGNVEPHRGFGHICFSVDNIEKVSADLENGGVKFQKKLTDGRQKDIAFALDPDGYWIELITNHEAKLVANETNPSSYRFNHTMLRVKDPKKSIEFYTEKLGMRLFRTSKHENAKFTLYFLSYDKDFEVNDASRAGDREGLLELTHNWGTEDEADFSYHNGNAEPQGFGHLAITVDDIEAACERFNKIGVKFKKQLDEGGMKYIAFILDPDGYWIEVIPPYNLPLENHAKI

SEQ ID NO: 9992 - protein, 204 aa, Zea mays
MDTDDAQEPATPTSPSPSPSSSSSSSSSSSSSPKKRARRDGGRHPTYRGVRMRSWGKWVSEIREPRKKSRIWLGTFATAEMAARAHDVAALAIKGARDAHLNFPGLARLLPRPATAAPRDVQAAAALAAAADFPLPNAESGGSASDGAPQDDAEPSPDDALFDLPDLLLADLRCCGPPPSWAVDDDVVGGGAFRLIEEPLLWEY

SEQ ID NO: 9993 - protein, 323 aa, Gibberella zeae
MASTTETNNYKFNHSMIRVKDPKASTKFYEFLGMSLVKKLEFPDNKFDLYFFGYDSPNALSHNKSTFDRQGLIELTHNYGTENDPEYKVNNGNQDPHRGFGHTCIAVDNIQAACQRIEDAGYKFQKKLTDGRMRNIAFVLDPDGYWVEVVARNDYKETENVKETDVSTYTMNHTMLRVKDAEKSLKYYQEVLGMSRLRTLENPEAGFNLYFLGYPGDQPFPEGQDDKAITHREGLLELTWNYGTEKEENFKYHDGNSEPQGFGHICVSVDNLEAACKRFEDMDVSWKKRLTDGRMKNVAFLLDPDGYWIEIVQNEKFSGKENF

SEQ ID NO: 9994 - protein, 316 aa, Triticum aestivum
MLPWIFSRKGASGFSWASTADQVTAGISAAGLTAIVTGASSGIGAETARVLAARGAHVVMAVRNLAAAEAVRQAVLAETPGASVEVMELDLSSLASVRNFAADFAATGLPLNILVNNAGVMATPFSLSKDGIEMQFATNHVGHFLLTNLLLETMKKTSRESNVEGRIVNVSSEGHRFAYKEGIRFAKLNDEEEYSTIAAYGQSKLANILHANELARRFKEEGVNITANSLHPGSIITNLLRHHSIIDVMSRTLGRLVLKNVQQGAATQCYVALHPGAKGVSGKYWSDSNLYEPSAKAKDAELGKKLWDYTLDLVAA

SEQ ID NO: 9995 - protein, 112 aa, Xylella fastidiosa
MKLITAIIRPFKLDEVREALSKVGVSGITVTEVKGFGQQKGHTELYRGTEYVIDFLPKIKIEMVVTDEHLDAVIEVIRIAAVTGKIGDGKIFVTKIEQVVRIRTGEIDIDAL

SEQ ID NO: 9996 - protein, 174 aa, Nicotiana tabacum
AFLKSVAAGTYDAVIVDSSDPIGPAQELFEKPFFESIARALRPGGVVSTQAESIWLHMHIIEEIVANCRQIFKGSVNYAWTTVPTYPSGMIGFMLCSTEGPAVDFKNPINPIDADASHNKTLGPMKFYNSELHKASFCLPSFAKRVIESKGNDLENSSRTMEAANHNNNGQEGD

SEQ ID NO: 9997 - protein, 614 aa, Clostridium cellulolyticum
AGTYNYGEALQKSIMFYEFQRSGDLPADKRDNWRDDSGMKDGSDVGVDLTGGWYDAGDHVKFNLPMSYTSAMLAWSLYEDKDAYDKSGQTKYIMDGIKWANDYFIKCNPTPGVYYYQVGDGGKDHSWWGPAEVMQMERPSFKVDASKPGSAVCASTAASLASAAVVFKSSDPTYAEKCISHAKNLFDMADKAKSDAGYTAASGYYSSSSFYDDLSWAAVWLYLATNDSTYLDKAESYVPNWGKEQQTDIIAYKWGQCWDDVHYGAELLLAKLTNKQLYKDSIEMNLDFWTTGVNGTRVSYTPKGLAWLFQWGSLRHATTQAFLAGVYAEWEGCTPSKVSVYKDFLKSQIDYALGSTGRSFVVGYGVNPPQHPHHRTAHGSWTDQMTSPTYHRHTIYGALVGGPDNADGYTDEINNYVNNEIACDYNAGFTGALAKMYKHSGGDPIPNFKAIEKITNDEVIIKAGLNSTGPNYTEIKAVVYNQTGWPARVTDKISFKYFMDLSEIVAAGIDPLSLVTSSNYSEGKNTKVSGVLPWDVSNNVYYVNVDLTGENIYPGGQSACRREVQFRIAAPQGTTYWNPKNDFSYDGLPTTSTVNTVTNIPVYDNGVKVFGNEP

SEQ ID NO: 9998 - protein, 199 aa, Asparagus officinalis
LDEYSKFHGYSPAVVTGKPIDLGGSLGRDAATGRGVVFATEALLAEYGKSISGLTFVIQGFGNVGSWAAQLIHERGGKVIAIGDVSGAIKNSNGIDIPALVKHKSGGGVLKDFRGSDAFDPKELLVHECDVLLPCALGGVLHRENAADVKAKYIIEAANHPTDPEADEILSKKGVVILPDIYANAGGVIVSYFEWVQNI

SEQ ID NO: 9999 - protein, 165 aa, Arabidopsis thaliana
  misc_feature (52)..(52): Xaa can be any naturally occurring amino acid
TRRRTHGASAFAFHHTTFLHCNSSTKTPNSILLHGLRALRLGGSCFDLPKLXTTGRKSSSGVVRAELRPCIGIGLSTSLSLLLGRYVFLKFQRENVAKQGLPEQNGKTHFEAGDDRAKEYDSLLKSNDPIGYNMCDVLARGSIAHIGAYYILATFSTGYDPSLFG

SEQ ID NO: 10000 - protein, 676 aa, Methanococcus maripaludis
  misc_feature (133)..(133): Xaa can be any naturally occurring amino acid
MTEFKVVHTICPYCGTGCGIDLVVKDGKVVDSHPFKRHPVNEGKVCIKGNYCYEFVHSEDRLTKPLIKKNGEFIEATWDEALDLIAGKLKQYSPDEVAFFSCARGTNEESYALQKFARTVLKTNNVDHCARIXHAPTVVGLGECFGSGAMTNSITDLAQADVLLIYGSNTFEAHPLIARSIVKAKENGTKIIAIDPRTTHTAKMADLHLKLIPGSNIDLINTITNIIIQEGMADEEFIKNRTEGYDELKDVVSKYTLEKTAELSGIPAETILEAARMYGSAENASIMYCLGVTEYTFGVDNVKSCCNLAMVTGNLGRPGTGVNPLRGQNNVQGACDMGALPNVFPGYQKVGEAYERLENLWETADLNREIGLTSPEVLHKAGEQVKFLHIVGEDPMVADADINHVEKALKSLDFFVVQDIFLTETAKLADVVLPAACWAEKDGTFTNSERRVQRIRKAVDAPGDALPDWLIVRKLAEKMGAGEKLNFESASEIFDEMAKVIPQYAGMSFERLGIDGLQWPCKTPEDPGTPILHKEKFLRPNGLGKFTPVEHKDADELIDEEYPLILTTGRIIFHYNSGTMTRRCDSITNEIDENFIEINTEDAKELGIKPGEKVRVSSRRGTVNADARVTENVIKGVVYMSFHFLEEATNKLTNSAYDPVSKTAELKICAVKVEKI

SEQ ID NO: 10001 - protein, 294 aa, Bacillus licheniformis
MMTKKGLLTVLMPFLLALSAIQFGNPRPALAASPFVETAGTSFTLNGKEFYFAGTNNYYFHYKSKKMVDDVFEDMKAMNLKVIRIWGFLDGQPQENTVMQPRPGIYDESGFSKLDYAIYKAGQTGIKLVIPFVNNWDDFGGMNQYVRWFQADGHDAFYTHPDIKEAYKNYVSYMLNRVNTYNGVKYKDDPAIMAWELANEPRVQSDRTGNTLVEWADEMSEFIKSIDQNHLVAVGDEGFYHIEGHPDWHYNGGEGVDWKRLTALKHIDYGTYHLYPDHWGKTAEWGNQWITDHI

SEQ ID NO: 10002 - protein, 1072 aa, Bacillus halodurans
MRKNKASKVSVLFMIVLLVLSLFTPIMPMHEANADTEADTLRIHYQRSDQQFENLGLWLWGDVRYPSENWPSGGTPFEPEKMTDYGAYVDIELKENAENIGFLVLNTATGDKDGNDKHVQLLSPEMKEIWIKEGSDDVFLYEPVDLPDHTVRIHYERSDQSYHHWGLWTWKDVASPSEHWPSGANPFSDEQTSRYGAYLDVELADDANEIGFLVVNRENGDKDGDDKTFADLANHPQLFIRQGDDTVYTNPYYQTIEGLVSGELISLTEMELRFTSTIWLSEDDLAEQIHLTDTNGASVAFDHVTIHDEKTVILHGSFDAELAPYHVTFADKTVVARAGWRLIDALYGYDGELGAVLHEDGSSTLTFWSPLADHVSVVLYDKDDQYRIIKDDIDMTKGDQGVWQVTLHSENTGLDNLAGYYYHYKIERDGDTKLGLDPYAKSMAAWNNEGSYSIGKAAIVDPSSIGPELDFAEIEGFEKREDAIIYEVHVRDFTSDPGIEEELTAQFGTFASFVDKLDYIEDLGVTHIQLLPVMSYYWGDELANHERELAYSSSGNNYNWGYDPHSYFSLSGMYSENPEDPELRIKEFKHLIDEIHRRGMGVILDVVYNHTAAVEIFEDLMPNYYHFMDADGTPRTSFGGGRLGTTHKMSRRILVDSITYWVEEYKVDGFRFDMMGDHDAETIQIAYDRAKELNPNIVMIGEGWRTYVGDEHGGDIMPADQDWMQHTESVGVFSDEFRNELKSGFGSEGQPRFITGGARNIEQIFDNLTAQPHNFTATNPGDVVPYIEAHDNLTLHDVIAQSIRKDPEYHQEEIHKRIRLGNTMVLTAQGTAFLHAGQEFGRTKQFRADTGGQAPYKSTYMTDENGKPFVYPYFIHDSYDSSDAINKFDWGKATNKEKYPIHHLTRTYTAGLIELRRSTNAFTHGTLVDVQANVRLLDIPEISETDLVIGYRATSTDNTGTYYVFVNADTKERTLSLTDDLTEGVVIVDSDEAGIVAVSDPSGFDLTPNEITIDPLTAVIIRVGGDFQENPHDGHPGKGGGKAKGRPDHAGQPGPPPHAGEKGKPDHASKKK

SEQ ID NO: 10003 - protein, 222 aa, Zea mays
  misc_feature (74)..(74): Xaa can be any naturally occurring amino acid
  misc_feature (101)..(101): Xaa can be any naturally occurring amino acid
  misc_feature (108)..(108): Xaa can be any naturally occurring amino acid
  misc_feature (121)..(121): Xaa can be any naturally occurring amino acid
MAYSMLSSAAVVTSPAQATMVAPFTGLKSSSAFPVTRKANNDITSIVSNGGRVSCMKAWPPVEKRKFETLSYLXPDLTEVELGKEGDYLLPAQGDSLGVKXKLEHGFXYRGARKAPPGYYXGRYWDKGEAFPLFGGAPPLLKGVKEAQKGETKGNPKPPFSGILGSQNKPGKAGGSFSFPQKQPQVSRGVKTPSKKKKPFPLFSSKKRGVFFFSLGDFRKKK

SEQ ID NO: 10004 - protein, 359 aa, Solanum stenandrum
  misc_feature (197)..(197): Xaa can be any naturally occurring amino acid
SVAIEVIVGDSIEVVRFFHSYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFHLLNLPDEFRGSFDFIDGHEKPVKGRKINWMKAGILESDRVVTVSPYYAQELVSXVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 10005 - protein, 307 aa, Aspergillus oryzae
MSVIDWGVVAPWTRCSFVLTGASEGGLGGATALALASARPSHLVLLARTENKVRTVISTIKEISPETQPAFVHIELEDLDSVRRAAADVLSLTSKIDVLINNAGVMAIPWSKSKSGLEKTLAINHIGHFLLTKLLMPSILAAGPGSRIVNVTSAAYRMAPFFFDDWNFSDGQTYHPLAAYGQSKTANILFTVGLAQRYKEHGILSFAAHPGYIPGTSLLLHGPDLDPSAMDEVARKNTGFPFGPDPPKSLEQGISTTLVAALSPELTDASGAYMEDCQVCEAREYARDPKLADRLWSLSEELASEAF

SEQ ID NO: 10006 - protein, 142 aa, Glycine max
  misc_feature (24)..(24): Xaa can be any naturally occurring amino acid
  misc_feature (113)..(113): Xaa can be any naturally occurring amino acid
  misc_feature (126)..(126): Xaa can be any naturally occurring amino acid
FSFGIDAIEDVLYHIETYDVTTIXACTPICLMSRLIKSLGVKWVIPREGSSEIFGGYLYLHKAPYKEEFLREPCLWIKALDHYDRLRANRSTFGWGLEARVPFWDKACINAAXEFSPEWNMMKRDXGRIEKWVLRRAFDDEE

SEQ ID NO: 10007 - protein, 360 aa, Solanum stramoniifolium
WDTSVAIEVQVGDSIEIVRFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSRGIYLNAKVAFCIHNIAYQGRFAFSDFPLLNLPDEFRGSFDFIDGHEAPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLIPSRFEPCGLIQL

SEQ ID NO: 10008 - protein, 109 aa, Chlorobium tepidum
MSGKYFEATDQNFQAEILNSDKVALVDFWAAWCGPCMMLGPVIEELAGDYEGKAIIAKLNVDENPNTAGQYGIRSIPTMLIIKGGKVVDQMVGALPKNMIAKKLDEHIG

SEQ ID NO: 10009 - protein, 362 aa, Solanum tenuispinum
WDTSVAIEVKVGDSIEIVRFFHCYKRGVDRVFVDHPMFLEKVWGKTGSKIYGPKAGQDYLDNELRFSLLCQAALKAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRRIPLIGFIGRLEEQKGSDILVAAIHQFIGLDVQIVVLGTGKKKFEQEIEQLEVLYPNKAKGVAKFNVPLAHMITAGADFMLVPSRFEPCGLIQLHA

SEQ ID NO: 10010 - protein, 192 aa, Arachis hypogaea
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQ

SEQ ID NO: 10011 - protein, 311 aa, Chlorobium tepidum
MDKDIRDVVIIGTGPAGYTSAIYTGRANLKPLVIEGPQPGGQLMITTDIENFPGFPEGIPGPELMGRMREQAARFGVEFQFGSITEVDVSRSPFSLMLDNGQEILARTLIIATGANAKWLGIESEEKYRGRGVSACATCDGFFFRNCRVFVVGGGDTAMEEALYLTKFASEVVLVHRREEFRASKIMSLRASKNEKITTMLNQVVDEILGDDMKVTGIRLKNVKTGELTEHACDGVFIAIGHEPNAKLFKGQLDMDDYGYILTKDHSTETSVKGVFACGDVQDFTYRQAVTAVGTGCMAAIEAERFLESIR

SEQ ID NO: 10012 - protein, 362 aa, Solanum torvum
WDTSVAIEVRVGDNIEIVRFFHCYKRGVDRVFVDHPMFLEKVWGKTGSKIYGPKAGQDYLDNELRFSLLCQAALEAPRVLNFNCSKYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 10013 - protein, 839 aa, Oryza sativa
MAAAVAMRGSSSDGGGYDKVSGMDSGKYVRYTPEQVEALERVYADCPKPTSSRRQQLLRECPILANIEPKQIKVWFQNRRCRDKQRKESSRLQAVNRKLTAMNKLLMEENERLQKQVSQLVHENAHMRQQLQNTPLANDTSCESNVTTPQNPLRDASNPSGLLSIAEETLTEFLSKATGTAIDWVQMPGMKPGPDSVGIVAISHGCRGVAARACGLVNLEPTKVVEILKDRPSWFRDCRNLEVFTMIPAGNGGTVELVYTQLYAPTTLVPARDFWTLRYTTTMEDGSLVVCERSLSGSGGGPSAASAQQYVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSIMGGDGVEDVVIACNSTKKIRSNSNAGIAFGAPGGIICAKASMLLQSVPPAVLVRFLREHRSEWADYNIDAYLASTLKTSACSLTGLRPMRFSGSQIIIPLAHTVENEEILEVVRLEGQPLTHDEALLSRDIHLLQLCTGIDEKSVGSSFQLVFAPIDDFPDETPLISSGFRVIPLDMKTDGASSGRTLDLASSLEVGSATAQASGDASADDCNLRSVLTIAFQFPYELHLQDSVAAMARQYVRSIVSAVQRVSMAISPSQTGLNAGQRIISGFPEAATLARWVCQSYHYHLGVELLSQSDGDAEQLLKMLWHYQDAILCCSFKEKPVFTFANKAGLDMLETSLVALQDLTLDRIFDEPGKEALFSNIPKLMEQGHVYLPSGVCMSGMGRHVSFDQAVAWKVLAEDSNVHCLAFCFVNWSFV

SEQ ID NO: 10014 - protein, 362 aa, Solanum viarum
WDTSVAVEVKVGDSIEIVRFFHCYKRGVDRVFIDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRFEPCGLIQLHA

SEQ ID NO: 10015 - protein, 86 aa, Brassica napus
  misc_feature (60)..(60): Xaa can be any naturally occurring amino acid
  misc_feature (69)..(69): Xaa can be any naturally occurring amino acid
MGNRCARTPCCRKLWSCICCSSNKDEAQARSQHGPKGKVHPVTKIEKWEEKITEANNNGXFLVVYFSAXWCVPCKKIEPVFKKLAS

SEQ ID NO: 10016 - protein, 418 aa, Streptococcus pyogenes
MIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDADTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFKTSGIRIGCAAITSRGMGVKESQTIARLIIKALVNHNQETILEEVRQEVRQLTDAFPLYKK

SEQ ID NO: 10017 - protein, 306 aa, Streptococcus pneumoniae
MSIYNNITELIGQTPIVKLNNIVPEGAADVYIKLEAFNPGSSVKDRIALSMIEKAEQDGILKPGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEL

SEQ ID NO: 10018 - protein, 495 aa, Acidobacteria bacterium
MNILLLSMPDSFEHMPPVAIRMPNGALTSLAGNIDPQHKVAVADLILCQSKVRETVTRFIKELDPAVVGLSVMTFQRRTASRIIDLIRRLKPDTKIVVGGYDPSLATQAYESMPLDFIVRGEGELPFRRMLRALESDNNFASIPGLSYRAHDGWVHNAIGPVHRLEDGEIRLPNRDARVLKGYTLLGRQVDVIETSRGCTYDCSFCSIIEMRGRNFHTYSFDRVLDDIRDARDHGARTVFLVDDNIMLNVKRFEALCEAIIAAGLNNIDYFVQAMTSSIANHGETIAPLMQRAGFRYVFLGIENVVESDLVFLKASAKNTAKENGKNIGNATMRAVDILHKHKMLVVGGLIIGNPDDTRETIEINLEFARQYVDWPYIQHPTPYPRTPMTAEFRERGLIANERLEEYDGTTAVVRTEHVSSDDIEYARWKAERWMKTRHLPAVFKHDPWFVATHAREMTAFTFRGSTLKTWLGLEDERKAFERYKEIRQQEREYL

SEQ ID NO: 10019 - protein, 259 aa, Streptococcus pneumoniae
MAVISMKQLLEAGVHFGHQTRRWNPKMAKYIFTERNGIHVIDLQQTVKYADQAYDFMRDAAANDAVVLFVGTKKQAADAVAEEAVRSGQYFINHRWLGGTLTNWGTIQKRIARLKEIKRMEEDGTFEVLPKKEVALLNKQRARLEKFLGGIEDMPRIPDVMYVVDPHKEQIAVKEAKKLGIPVVAMVDTNTDPDDIDVIIPANDDAIRAVKLITAKLADAIIEGRQGEDAVAVEAEFAALETQADSIEEIVEVVEGDNA

SEQ ID NO: 10020 - protein, 341 aa, Pseudomonas syringae
MTTQQPVAVLGGGSFGTAIANLLAENGHQVRQWMRDPEQAEAIRVNRENPRYLKGIRIRPEVEPVTDLTAVLDASELIFVALPSSALRSVLSPHVARLNGKMLVSLTKGIEAQSFKLMSQILEEIVPQARIGVLSGPNLAREIAEHALTATVVASEDEALCQEVQAALHGRTFRVYASNDRFGVELGGALKNVYAIIAGMAVALDMGENTKSMLITRALAEMTRFAVSQGANPMTFLGLAGVGDLIVTCSSPKSRNYQVGFALGQGLTLDEAVTRLGEVAEGVNTLKVLKVKAQEVQVYMPLVAGLHAILFEGRTLSQVIEALMRAEPKTDVDFISITGFN

SEQ ID NO: 10021 - protein, 535 aa, Unknown
  Synechococcus sp. RS9916
MVSASSSSASAPAAGERVLLVRLPCNPIFPIGPIYLADHLHKCFPGLPQRILDLAALPVLDVERVLRTVVDQFRPTLLVFSWRDIQIYAPVDGRGGNPLQNSFEVFYARNPLKRLRGALGGLRLMTSHYGELWRNQRLVSQGLQMARRHHPDARAVLGGGAVSVFYEQLGRSLPKGTIVSLGEGEPLLEKLLSGGSLAQERCFVVGESPRPGLIHEQPESRPKTACDYDYIASIWPQLNWYLEGGDFYVGVQTKRGCPHNCCYCVYTVVEGKQVRLNPVAEVVKEMRQLYDRGVRGFWFTDAQFIPARRYIEDAKELLRAVKAEGLTGIRWAAYIRADNLDPELAQLMVETGMSYFEIGITSGSQELVRKMRMGYNLRTVLESCRMLAAAGFRDHVSVNYSFNVIDERPETIRQTVAYHREMERIFGADRVEPAIFFIGLQPHTHLEQYGFDQGLIKPGYNPMSMMPWTARKLLWNPEPMGSTFGRICLEAFDRDPSNFGRTVIDLLERDYGKAPLEQALRAPVQGRAALANAVS

SEQ ID NO: 10022 - protein, 440 aa, Sulfolobus tokodaii
MDCIFIFRRDLRLEDNTGLNYALSECDRVIPVFIADPRQLINNPYKSEFAVSFMINSLLELDDELRKKGSRLNVFFGEAEKVVSRFFNKVDAIYVNEDYTPFSISRDEKIRKVCEENGIEFKAYEDYLLTPKSLFHHRNFTSFYNEVSKVKVREPETMEGSFDVTDSSMNVDFLLTFKKIESPLFRGGRREGLYLLHRNVDFRRRDYPAENNNYRLSPHLKFGTISMREAYYTQKGKEEFVRELYWRDFFTLLAYYNPHVFGHCYRREYDNISWENNESYFEAWKEGRTGYPIIDAGMRMLNSTGYINGRVRMLVAFFLVKVLFVDWRWGERYFATKLVDYDPAINNGNWQWIASTGVDYMFRVFNPWKQQEKFDPEAKFIKEWVEELKDVPPSIIHSIYKTKVPGYPSPIVNWLERVNYVKSEYKNVKAVLLEHHHHHH

SEQ ID NO: 10023 - protein, 98 aa, Spirulina sp.
ATYKVTLISEAEGINETIDCDDDTYILDAAEEAGLDLPYSCRAGACSTCAGKITSGSIDQSDQSFLDDDQIEAGYVLTCVAYPTSDCTIQTHQEEGLY

SEQ ID NO: 10024 - protein, 497 aa, Unknown
  Mycobacterium sp. MCS
MATISTPEYLLDQAKRRFTPTLNTIPGMGIVEKRLRDKLQNQEWKQFVLAEPPAGSGLKPVMGDSGLPVLGHMIETFRGGPDYLLQVYKTYGPLHYAYSPALPAVVALGPDATQAVFSNKNKDFSQRGWHPVIGPFFNRGLMMLDFDEHMYHRRIMQEAFTRTRLAGYVEHIDRVASQVIANDWVENDARFLFYPAVKELTLDIASVVFMGHEPGTDKELVTKVNDAFTMTTRAGGAIIRTGLPPFKWWRGLQARKVLDNYFEQRVKEKRGSEGTDMLTVLCHTADEDGNTFSDQDIVNHMIFLMMAAHDTSTSTLTTMAYHLSRNPEWQERCREESERLGDGPLDIEALEKLETLDLVINESLRLVTPLPFNVRQTVRDTELLGHYIPANTDVVLWPSVNHHLPELWTDPEKFDPARFTEPRNEHKQHRYAFAPFGGGAHKCIGMVFGQLEIKTVMHRLLRRYRLEPPRPGYVSKLDYAGMPVPMDGMPIVLRPLR

SEQ ID NO: 10025 - protein, 325 aa, Medicago truncatula
MAVERSGIAKDVTELIGKTPLVYLNRLADGCVARVAAKLELMEPCSSVKDRIGYSMIADAEEKGLITPGQSVLIEPTSGNTGIGLAFMAAAKGYKLIITMPASMSLERRIILLAFGAELVLTDPAKGMKGAVQKAEELLAKTPNAYILQQFENPANPKVHYETTGPEIWKGTDGKIDAFVSGIGTGGTITGAGKYLKEQNSNIKLIGVEPVESPVLSGGKPGPHKIQGIGAGFVPGVLEVNLIDEVVQISSDEAIETAKLLALKEGLFVGISSGAAAAAAIKIAKRPENAGKLIVVVFPSFGERYLSSVLFESVRREAETMTFEP

SEQ ID NO: 10026 - protein, 161 aa, Kluyveromyces lactis
MSKFYELAPKDKKGEPFPFTQLEGKVVLIVNVASKCGFTPQYKELEALYKKYEDKGFIVLGFPCNQFGHQEPGTDEEISQFCQLNYGVSFPILKKVDVNGSEADPVYDFLKNEKSGLLGFKGIKWNFEKFLVDKKGTVVERYSSLTKPSSLEEPIEKLLNE

SEQ ID NO: 10027 - protein, 1338 aa, Kluyveromyces lactis
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTELGSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 10028 - protein, 561 aa, Bacillus cereus
MIHLKTQYTVSTYLLDRLSELGIEHIFGVPGDYNLAFLDDVIAHENVEWIGNCNELNAAYAADGYARIKGIAALITTFGVGELSAINGIAGSYAENVPVIKITGTPPTTVMENGALVHHTLGDGKFDHFSNMYREITVAQSKLTPEHAAEEIDHVLRACWSAKRPVHIQLPIDVYNKPINKPTEPILHKPVVSNKDALDKMLLHATSKINSAKKPVILADFEVDRFHAKEYLYQFVEKTGFPIATLSMGKGIFPEKHSQFIGIYTGDVSSPYLRKRIDESDCIISIGVKLTDTITGGFTQDFTKEQVIEIHPYTVKIIDKKYGPVVMKDVLQQLSNVIEHRNEETLDIKPFISESLSITEKFNPKPQMVTQKRFWQQIYHFLQENDVLLAEQGTPFFGSAAIPLPNNTTYVVQPLWGSIGYTLPALLGTQLANVSRRNILITGDGSFQLTVQELSTILRQNLKPIIFLINNNGYTVERAIHGQNEPYNDIQMWDYTKLANVFGSKEKSLTCKVENEIELAEVLTDITLNNKQLTFIEVVMSQGDQPELLAKLGERFGKQNS

SEQ ID NO: 10029 - protein, 328 aa, Mycoplasma pneumoniae
MSPKTTKKIAILTSGGDAPGMNATLVYLTRYATSSEIEVFFVKNGYYGLYHDELVPAHQLDLSNSLFSAGTVIGSKRFVEFKELKVREQAAQNLKKRQIDYLVVIGGDGSYMGAKLLSELGVNCYCLPGTIDNDINSSEFTIGFLTALESIKVNVQAVYHTTKSHERVAIVEVMGRHCGDLAIFGALATNADFVVTPSNKMDLKQLESAVKKILQHQNHCVVIVSENIYGFDGYPSLTAIKQHFDANNMKCNLVSLGHTQRGFAPTSLELVQISLMAQHTINLIGQNKVNQVIGNKANVPVNYDFDQAFNMPPVDRSALIAVINKNII

SEQ ID NO: 10030 - protein, 325 aa, Medicago truncatula
MAAFLRRVARSTPIGFGAHSKSSRSNFHLPFTAIAAISGGFSYLYYSSSPNLVHSDQIGDEDIKTKNIALIPDKWVEFKLQDTARVSHDTHLYRFSFDPTKKLGLDVASCILTRAPFGQDAEEKPKYVIRPYTPISDTESKGYFDLLIKVYPEGKMSQHFASLKPGDMVEVKGPIEKFKYTPNMKKNIGMIAGGSGITPMLQVIEAILKNSDDKTQISLIYANVSPDDILLQQKLDILAKSHPNLKVFYTVDNPTKTWKGGAGYISKDMVVKGLPAPSDDTLVLVCGPPGMMQHISGEKAKDWTQGEVSGILKEAGYTEQMVYKF

SEQ ID NO: 10031 - protein, 112 aa, Rhodobacter sphaeroides
MKKIEAIIKPFKLDEVKEALQAAGVQGLSVTEVKGFGRQKGHTELYRGAEYVVDFLPKVKIEVVLADDMVEAAVEAIVSAARTDKIGDGKIFISPVEQAIRIRTGETGEDAV

SEQ ID NO: 10032 - protein, 308 aa, Roseovarius nubinhibens
MREIVIGGAQMGPIQKADTREEVVDRMIALLQQAKGAGCDLVVFPELCLTTFFPRWYMEDQAEVDQWFEREMPNAATAPLFAAAREAQIAISFGYAELTPEGRHFNTSILTDRDGNIVGKYRKTHLPGHSEFDHDRAFQHLEKRYFEPGDTGFQVWRNMDAIMGMCICNDRRWPETYRVMGLQGVELVMLGYNTPSVNSQDSVEGLEKRLYHSELSMTSAAYQNATWVVGVAKAGDEDGHPLMGGSMIVDPNGYVMARAETEGDELIVHACDMDACSFGKSTIFDFARHRRIEHYGLICSQTGVVLPD

SEQ ID NO: 10033 - protein, 963 aa, Dechloromonas aromatica
MPLNLPLSALEQHDEFIGRHIGPCSTEMATMLTAIGADSLEQLIDQTVPAAIRLPADLPLPAPRREHEALADLKAMASKNVVNKSCIGMGYYDTLTPKVILRNVMENPGWYTAYTPYQAEIAQGRLEALMNFQQMVIDLTGLEIANASLLDEATAAAEAMTMARRVSKSKSNRFLVDANCFPQSIDVVKTRAAYFGFELVIGNIDAHKDGDFFGALLQYPGDNGEVRDLTDVIAGLKAKGTTVAVASDLMALVLLKSPGAMGADIALGSSQRFGIPMGFGGPHAAFFATREAFVRSMPGRIIGISKDARGNTAYRMALQTREQHIRREKANSNICTSQVLLANMAGMYVVYHGAEGLRTIAGRIHRLTAILAEGLKRASVNLLTKQFYDTVHFDLGARAESVYNDALAAGYNLRRVSAGVLGISFDETTTRDDVATLFKLIAQTTLDVATIDAQVAAADSALPDSLIRSDAVLQHPVFNTHHTEHEMLRYLKSLQNKDLALDHSMISLGSCTMKLNATSEMIPVTWPEFGGIHPFAPRDQAVGYLEMITSLTEWLKTVTGFDAICMQPNSGAQGEYAGLVAIDRFHASRGEEHRNVCLIPKSAHGTNPATAQMANMKVVVVDCDENGNVDVADLKAKAEEHKDDLACLMITYPSTHGVFEEAIRDICAIVHANGGQVYMDGANLNAQVGLTSPGFIGADVSHMNLHKTFAIPHGGGGPGMGPIGLKAHLAPFMADHVVQPTGDANRVNAGQGAVSAAPFGSASILTISWMYLAMLGGAGVKKATQVAILNANYVAKQLNAHYPVLYVGKNGRVAHECILDIRPIKAATGIAEIDIAKRLMDYGFHAPTVSFPVAGTIMVEPTESESKAELDRFIGAMIAIREEIRQIENGVWTADNNPLKNAPHSQADVMDAEWKHPYSRQQAVFPLPWVAANKFWPSVNRIDDVYGDRNLNCACPPMEAYAD

SEQ ID NO: 10034 - protein, 352 aa, Solanum wendlandii
WDTSVAVEVKVGDSIEIVRFFHCYKRGVDRVFVDHPMFLEKVWGKTGSKIYGPKAGQDYLDNELRFSLFCQAALEAPRVLNLNCCKFFSGPYGEDVLFIANDWHTALIPCYLKSMYQSRGIYLNAKVAFCIHNIAYQGRFAFSDFPLLNLPDEFRGSFDFIDGHETPVKGRKINWMKAGILESDRVVTVSPYYAQELVSAVDKGVELDNVLRKTSITGIVNGMDTQEWNPATDKYTDVKYDITTVMDAKPLLKETLQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSRF

SEQ ID NO: 10035 - protein, 772 aa, Unknown
  uncultured bacterium 463
MTRSISQRIAEELAVREAQVNAAIRLLDEGSTVPFIARYRKEVTGELDDSQMRLLEERLHYLRELEDRRGTILASIEEQDKLTPALKKSLLEADTKNRLEDLYLPYKPKRRTKAQIAREAGLEPLANLLWNDPQQIPEALAEQYLNEEAGISDSKAALDGARQILMERFAEDADLLAKLRQFLTDNAQLASRLVEGKEQEGAKFRDYFEHTEALAKTPSHRALAMFRGRNEGILNINLVMHAQEKPIDAHPCEAMIAEHWNIEDKARAADRWLREAVRWTWRVKLLTHLQTDLLGQLRERAEAGAIEVFAHNLQDLLLAAPAGQKATIGLDPGLRTGVKVAVIDANGKVLDHGAIFPNPPQKRIQEAGATLLHMIRQHKVELIAIGNGTAGRETDKFVGDLFNANPDLNCRKVMVNEAGASIYSASEFASREFPDLDVTIRGAISIARRLQDPLAELVKIEPKSIGVGQYQHDVSQVQLARQLDAVVEDCVNAVGVDVNTASVPLLARVSGLNQSIATNIVNLRDEQGSFTDRKALLKVSRFGEKTFEQAAGFLRVSGGSNPLDASAVHPESYGVVQKIANHRGKEVRSIIGDSGFLRALNAADYISDTVGLPTVQDIISELDKPGRDPRPEFKMAEFQDGVEKISDLRPDMVLEGTVTNVTNFGAFIDIGVHQDGLVHISALAEKFVKDPRDVVKAGDVVRVKVMEVDAPRKRIGLSMRLSDKAGEQAEKRGGSQRRGSNDANQRPPKPRQEQPAKNNAFAAAFANAKQRS

SEQ ID NO: 10036 - protein, 987 aa, Unknown
  Mycobacterium sp. JLS
MADSENTQAQDSPDSSEEASPRERLPERLRVHSLARVLGTTSRRVLDALAELDGRARSAHSTVDKTEAERVREVLAGSDGDAPVEAPAPAEIAESVADAPEVVIETVESVEVTIDVAPVDDTPDVPEPEDEPESRTILETAPVERADYLPLFVAPQPVRFEPADEDDDEDEDDDVAASADSEDDDEDDQSERPAARRRRRGRRGRGRGRGEQSDDNGEPDAAEGTETKTDGQADSDQDTGDDSDEDGDEDTSGGDGSSRRRRRRRRRKSGASDDSDNGSPDDPPNTVVHERPPRERGGKSGDSDDNEIQGISGSTRLEAKRQRRRDGRDAGRRRPPILSEAEFLARREAVERVMVVRDKVRTEPPHEGARYTQIAVLEDGVVVEHFVTSPASASLVGNIYLGIVQNVLPSMEAAFVDIGRGRNGVLYAGEVNWEAAGLGGQNRKIEQALKPGDYVVVQVSKDPVGHKGARLTTQVSLAGRYLVYVPGASSTGISRKLPDTERQRLKEILREVVPADAGVIIRTASEGVKEDDIRSDVNRLQERWTQIEAKAAEITAKKAGAAVALYEEPDVLVKVIRDLFNEDFSGLIVSGDEAWNTINSYVESVAPDLMPRLTKYEPAGNPNGEGPDVFAVHRIDEQLAKAMDRKVWLPSGGTLVIDRTEAMTVVDVNTGKFTGSGGNLEQTVTRNNLEAAEEIVRQLRLRDIGGIIVIDFIDMVLESNRDLVLRRLTEALARDRTRHQVSEVTSLGLVQLTRKRLGTGLIEAFSTPCPHCAGRGIVLHGDPIDNASGNGRKSEPGTGRRSKRGKKGGKPEEAPAAVPVIKVPPHPAGEHPMFKAMAAANGRDDESEDESDESADEQSGAREDDTAEKVHEAVGEELDDEDFEDAEDAEDSDDSDEDEDEDSDDSDEDEIDLDNDDDEEDDDIEVLDDEDSDEDEDSDEDEDSDEDSDEDSDEDSDDEDEPEVIAVPVRRPRRRAAARPAGPPSSE

SEQ ID NO: 10037 - protein, 434 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGKEAEAIKAKILAHPQYPSLLGAYIDCQKIGAPPEVVARLDALTHEYENQQHRTTVSIGMDPELDQFMEAYCEMLTKYHEELTKPFKEAMSFLKKIEAQLNSLSKGTIRISPSAENDEKTEGGASSEEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 10038 - protein, 105 aa, Clostridium tetani
MIKEINDSVFNSEVLNSDKVTVVDFWAPWCGPCRMLGPVIEELSQEMSEQVKFVKVNVDENPMSATEYKVASIPTVAVFKDGKIQETLVGFRPKQAMQSSIEKHI

SEQ ID NO: 10039 - protein, 435 aa, Agrobacterium tumefaciens [sequence omitted]

SEQ ID NO: 10040 - protein, 486 aa, Buchnera aphidicola
MLNKNLIDLFRSFSNMSLQKVGVIGMAVMGRNLALNIESKGYTVSIFNRSKNKTKEVILKNKNKNLIPFFTIKDFILSLQKPRIILLMVQSGTATDLTIKSIIPYLDPEDILIDGGNSFYKDTIKRSSLLFKKKIYFFGIGISGGEEGALKGPAIMPGGNKLIYKKISSLLKKIAAKTENNESCVSYIGTDGSGHYVKMVHNGIEYGDMQLISESYFILKHSLNLNNKQLSKIFSNWNKGELKSYLIEITKNIFLKKDSSGKYLIDVILDKANNKGTGKWTSQSALNLGEPLSLITQSVFFRYLSSFKNQRLQASKILYGPKPSQDVLNHEDFIENIRRSLYLGKIISYAQGFSQLKKASQVYHWNLNYSKIAKIFRAGSIIRADFLKEIIHAYQKSNGLENLLLAPYFIKISKEYQNSLRKIVSYSVMHGIPIPAFSAAISYYDSYRSPILPANLLQAQRDYFGAHTYSRIDKKGTFHTNWIDIK

SEQ ID NO: 10041 - protein, 360 aa, Escherichia coli
MTKKGAFTSAFFIYAFSACIIRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 10042 - protein, 320 aa, Brassica napus
  misc_feature (171)..(171): Xaa can be any naturally occurring amino acid
DSRVDPRVRSRDVHLLQICTGIDENAVGACSELIFAPINEMFPDDAPLVPSGFRVIPVDAKTGDAQDLLTANHRTLDLTSSLEVGPTPENASGNSSSSSSSRCILTIAFQFPFENNLQDNVAGMACQYVRSVISSVQRVAMAISPSGISPSLGSKLSPGSPEAVTLAQWIXQSYTHHLGSELLTVDSLGSNDSVLKLLWDHQDAILCCSLKPQPVFMFANQAGLDMLETTLVALQDITLEKIFDESGRKALCSDFAKLMQQGYACLPSGICLSTMGRHVTYEQAVAWKVFAPAAASSENNDGNDNTLHCLAFSFVNWSFV

SEQ ID NO: 10043 - protein, 465 aa, Oryza sativa
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYRGFYSDEVVPLDPAAVEHWHKAGGAALGTSRGGFDLARIVDAIERHGFNQVYAVGGDGTMRGAARIHREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWVRSITNQPDFIRAGPTS

SEQ ID NO: 10044 - protein, 678 aa, Unknown
  Synechococcus sp. WH 5701
MLVECGDTAVLVTATRSKGREGIDFLPLTCDYEERLYAAGRIPGSFFRREGRPPERAILTTRLIDRPLRPLFPSWLRDDLQVVATCLSLDERVPPDVLAVTGASIATLLAKIPFSGPMAAVRVGLLGDDFVLNPSYREIERSELDLVVAGTPTGVVMVEAGANQLPEQDVIEAIDFGYEAVGELIKAQQKLLADLGIEQVFPEPQVQDPALPAFLEQECGAGIGEVLKQFSLTKAERDAQLDVIKADVAQKIAGLSDDDPIRVAAAGKALGNTYKGITKKLMRAQILSEGKRVDGRNLDEVRPISAAVGVLPKRVHGSGLFQRGLTQVLSTATLGTPSDAQEMDDLNPMGEKTYLHHYNFPPYSVGETRPMRSPGRREVGHGALAERAIVPVLPPKESFPYVLRVVSECLSSNGSTSMGSVCGSTLALMDAGVPLKAPVSGAAMGLIKEGDEVRILTDIQGIEDFLGDMDFKVAGTEKGITALQMDMKISGLAVSTIAEAVNQARPARLHILEKMLEAIGKPRNVLSPHAPRLLSFRIDPELIGTVIGPGGRTIKGITERTNTKIDIEDGGIVTIASHDGAAAEEAQRIIEGLTRRVSEGEMFNGSVTRIIPIGAFVEILPGKEGMIHISQLSEARVEKVEDVIKVGDAVTVRVREIDNRGRINLTLRGVAQETVPVA

SEQ ID NO: 10045 - protein, 466 aa, Phaseolus vulgaris
MALFMAILGVLVLLLCFCSALLKWNEVRFRRKGLPPGAMGWPVFGETTEFLKQGPNFMKNKRARYGSFFKSHILGCPTIVSMDPELNRFILMNEAKGLVPGYPQSMLDILGTRNIAAVHGSTHKYMRGALLSIISPTLIRDQLLPKIDEFMRTHLMDWDNKVINIQEKTKEMAFLSSLKQIAGMESSSIAQPFMTEFFKLVLGTLSLPINLPRTNYRGGLQARKSIISILSQLLEERKASQDVHVDMLGCLMKKDENRYKLSDEEIIDLVITIMYSGYETVSTTSMMAVKYLHDHPKVLEEIRKEHFAIRERKKPEDPIDCNDLKSMRFTRAVIFETSRLATIVNGVLRKTTHDMELNGYLIPKGWRIYVYTREINYDPFLYHDPLTFNPWRWLGNSLESQSHFLIFGGGTRQCPGKELGIAEISTFLHYFVTRYRWEEVGGDKLMKFPRVVAPNGLHIRVSSFSN

SEQ ID NO: 10046 - protein, 160 aa, Raphanus sativus
MESEGKIVFTEEQEALVVKSWSVMKKNSADLGLKLFIKIFEIAPTAKKLFSFLRDSPIPAEQNPKLKPHAMSVFVMCCESAAQLRKTGKVTVKETTLKRLGANHSKYGVVDEHFEVTKYALLETIKEAVPEMWSPEMKSAWGQAYDHLVAAIKAEMKPSH

SEQ ID NO: 10047 - protein, 144 aa, Glycine max
MGAFTEKQEALVSSSFEAFKANIPQYSVVFYTSILEKAPAAKDLFSFLSNGVDPSNPKLTGHAEKLFGLVRDSAGQLKANGTVVADAALGSIHAQKAITDPQFVVKEALLKTIKEAVGDKWSDELSSAWEVAYDELAAAIKKAF

SEQ ID NO: 10048 - protein, 240 aa, Bartonella vinsonii
MKKTIKTPAGGYGGSGSHELYQRVKKKAGTIKASSRRWLERHLNDPYVHQSKVDGYRSRAAYKLIEINERYKFLKKGQKIIDLGAAPGGWCQVAVRVVGSNDQKPSVVGIDYLHVNPLPGVVMLKMDFLHADAPQKLIDALGEKPDVVLSDMAAPTTGHRQTDHLRTVYLCEVAADFALSVLKPGGHFLAKAFQGGAENTLLTTLKQNFKTVHHVKPPASRSESVELYLLALGFKGKAEV

SEQ ID NO: 10049 - protein, 197 aa, Crocosphaera watsonii
MLGEMWSLRGRYKILHMTWFAFFLSFVVWFNLAPLATQVKADFGLEVSQIRTLAICNVALTVPARIIIGMLLDRYGPRITYTLLLMYAAIPCLIFATAQSFTQLVIGRLMLGIVGAGFVIGIRMVAEWFPPKEIGLAEGIYGGWGNFGSAAAAFTLPTIGGWFAFGALSPAGDPLQLEALHRWNGHYRSAVWDFILQ

SEQ ID NO: 10050 - protein, 561 aa, Magnaporthe grisea
MAHIFSLFPNAKPGYVDGRQTEAGATKFPNTPFFSGPLKPNRIEADIFELETSGEIPGTIDGVFFRVQPDSQFPPVFEDDVHFSGDGRVSAFRFKDGHVDWKQRYVRTDRFRAERAARRALFGRYRNPFTDNEMVKGIIRTVSNTNVIFWRGVLLAMKEDGPPFAMDPVTLETIGRYDFEGQVDSPTFTAHPKFDPVTGEMVAFAYAASEDGQHASRDVVVWTFDAQTGEKKREHRYKAPFCGMIHDAALTENYLILPLTPLKASLERLEKGGNHWTWDPEEDQFYGIVSRKGDKDVVWLRADNAFHGHVAGAYENEEGHIVCDLTIADGNVFYWWPPENSSLGPNPRQKLNADTHRWTFDPNGGSGTRVAPAELYGTNGEFSRIDERFVTKKYRHFWQLQIDSSRPYDMAKCGPPAGGLFNVLGHYDWDAPRNQDGTRFKDEYWAGPTCTFQEPVFMPKSADAAEGDGYVMALVNHLDVLRNDILIFDALDLAKGPIGACHLPLHIGIGLHGNFVDEADMACWRSARQAKGDIASARPASEPLPWQRELIAKSVAQESSR

SEQ ID NO: 10051 - protein, 388 aa, Crocosphaera watsonii
MAVGVTLDLLLLPLPCPPSAVGSPLAHFPPQVIPFNWRLCIAGTGIIAALYGILYYNNVQDYPPGKTYRKPKSARGIEVTTKRDFWFLMVMNAPLSGILMVLAWRLTKVGFYGVNTMYIVWACLIGLYLFQAYNCWVVNKDLMTGKKQYPAKDRYRFSQVAILELTYIVNFGSELAVVSMLPTFFEGTFTLTPAQAGMIASSYAFMNLMSRPGGGLISDKLGSRKNTMAVLTLCMGIGYLMMGTVSSSWWLPGAIILTMACSFFVQAGEGSTFAIVPLVKRRITGQVAGNVGAYGNVGAVAYLTIFSLLPEWLGGGKDPSAAIIAQANTAFFQIMGIMAVIVAFLCWFILKEPEGSFAEHHEGEEEDLGLSPVAVMESNTSLDSVSRG

SEQ ID NO: 10052 - protein, 307 aa, Desulfotalea psychrophila
MEAIKPEKLFCSEMGKRAIIAHYHRTDWPYQVVKTGTELSLGSRSVQFIETRMLHWPDSMFSYLKEDGILFSNDAFGQHIATEERFDDELEAGKAINAAEHFYATTLTLLSPLVQKLLKTMEKMELDLRLIAPDHGIIWRQQQDEILEGYRRWSQQEQHPEAIIVYDTKWKSTEMMAKAIAQGIEEENVPARLMSLKECHRGDIMQRLLTASTIVLGSATINNAIMPSLASFLMYMKGLKPRKKIGAAFGSYGWGGEAVKQLNTMMDEMKIKRIDDGLRIKYVPHEEQLKECVEYGRHIGRATKADK

SEQ ID NO: 10053 - protein, 400 aa, Desulfotalea psychrophila
MNKNKLAKGIYWVGAVDWDVRDFHGYSTYRGSTYNSFLVIDEKVTLFDTVKHSHMDQLLYNIGKIIDPKEIDYIVVNHVELDHSGSLPKMMEIVQPEKLICSPMGEKALIAHFHREDWPYHIVKSGDEISLGARTVQFLETRMLHWPDSMFSYLQEDGILFTSDAFGQHLASTERFDDELELDEIMQESAKYYANILNLFSPLIRKLLRTIKEMDLDLKIIAPDHGLIWRSHQDKILAAYEKWSNQEHSNRALIIYDSMWHSTEEMAKSISIGLEEEGVPAELINMQVHHRSDVVTKVLDARALILGSPTLNNGILPRMAGLLSYMKGLKPARKLGAAFGSYGWSGEAVAQLNTIMDEMKIERINDGLRLKYVPTEESLDQCREYGRELGRSILASEEGK

SEQ ID NO: 10054 - protein, 98 aa, Spirulina sp.
ATYKVTLIDEAEGINETIDCDDDTYILDAAEEAGLDLPYSCRAGACSTCAGTITSGTIDQSDQSFLDDDQIEAGYVLTCVAYPTSDCTIKTHQEEGLY

SEQ ID NO: 10055 - protein, 373 aa, Roseovarius nubinhibens
MTPNPFSPDTKRPKTTEGVFSAAEVGLANRNSGLLLETLTRDITPTGAHYLLNHFDVPLIDEAEHRLSFSGAFDAPYSLTMDEIRALPTETLPVTLECAGNGRAGVSPRAYSMPWMYEAVGTSEWTGTPLAPLIARAKPQNDVQDFAFTGADFGFDKGQPHAFGRSLTPDELAALDVMLIWGMNGQPLLPQHGAPLRLIVPGWYGMASVKWLTDISALTTRYDGFQQVQTYRFRKDENDPGRPVTTIRVKSLMAPPGVPDWISRERWLEPGRVTLRGRAWSGGGTPIARVEVETPEGWQEATLDAPVGRYAWTGWHLDWQATPGRHVLACRATDAEGRTQPIEPPFDMAGFANNAVQKTVVHVAQPDAIQKDS

SEQ ID NO: 10056 - protein, 117 aa, Oryza sativa
  misc_feature (52)..(52): Xaa can be any naturally occurring amino acid
PEGCGYEFQMQYGSIGWSVGALLGYAQGAKDKRVIACIGDGSFQVTAQDVSXNGEGKCWTSKVKCEEELTEAIGMALGEKDCLCFIEVIAHKDDTSKELLEWGSRVSAANSRPPNPQ

SEQ ID NO: 10057 - protein, 143 aa, Oryza sativa
MGGFGFRRMGLEKEDAYFWKQMGKGMLCTYALFGAAWLWNEASPLGWWTLKPRPKEEREMAHLYERRMFPYPGDEEAVEEFIKSGGALGTTIGPKGFADSNMDSDNMQKQLQSKKFDQEAQKLWFRMRNEVVQELQEKGFDVE

SEQ ID NO: 10058 - protein, 352 aa, Glycine max
MGEVDPAFIQEPQHRPNLSTIQAEGIPIIDLSPITNHTVSDPSAIESLVKEIGRACQEWGFFQVTNHGVPLTLRQNIEKASKLFFAQTLEEKRKVSRNESSPMGYYDTEHTKNVRDWKEVFDFLAKDPTFIPLTSDEHDDRVNQWTNQSPQYPPLFRVVTQEYIQEMEKLSFKLLELIALSLGLEAKRFEEFFIKDQTSFIRLNHYPPCPYPDLALGVGRHKDPGALTILAQDEVGGLEVRRKRDQEWIRVKPTPNAYIINIGDTVQVWSNDAYESVDHRVVVNSEKERLSIPFFFFPAHDTKVKPLEELINEQNPSKYRPYNWGKFLVHRGNSNFKKQNEENIQIHHYKIA

SEQ ID NO: 10059 - protein, 159 aa, Triticum aestivum
  misc_feature (151)..(151): Xaa can be any naturally occurring amino acid
GANMNAQVGLTSPGFIGADVCHLNLHKTFCIPHGGGGPGMGPIGVKKHLAPFLPSHPVIPTGGFPLPEKTDPLGTISAAPWGSALILPISYTYIAMMGSQGLTDASKIAILNANYMAKRLEKHYPVLFRGVNGTVAHEFIIDLRAFKTTAXGIEPEDVA

SEQ ID NO: 10060 - protein, 244 aa, Neisseria gonorrhoeae
MAKLEKHTGKPKGWLDRKHRERTVPETAAESTGTAETRIAETASAAGCRSVTVNRNTCETQITVSINLDGSGKSRLDTGVPFLEHMIDQIARHGMIDIDISCKGDLHIDDHHTAEDIGITLGQAIRQALGDKKGIRRYGHSYVPLDEALSRVVIDLSGRPGLVYNIEFTRTLIGRFDVDLFEEFFHGIVNHSMMTLHIDNLSGKNAHHQAETVFKAFGRALRMAVEHDPRMAGQTPSTKGTLTA

SEQ ID NO: 10061 - protein, 829 aa, Oryza sativa
MASLPHCLSARPLVVAAAPGRPGPGPGPWLRGGARRRNAAFSAGNAGRRVGLRRSVASAVEVGVGEDEEGVEEEEEEVEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKGMGYEKYRDIVRQFIKGTDGFAGGFAECLCGSPHLYQVCIRIKAVTCICHYRYSFINQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSMKDETKGEIYVAFNASHLPAVVGLPERPGYRWEPLVDTGKPAPYDFLTDDLPDRAHAVHLFSHFLNSNLYPMLSYSSIILELQPDD

SEQ ID NO: 10062 - protein, 352 aa, Glycine max
MGEVDPAFIQEPQHRPNLSTIQAEGIPIIDLSPITNHTVSDPSAIESLVKEIGRACQEWGFFQVTNHGVPLTLRQNIEKASKLFFAQTLEEKRKVSRNESSPMGYYDTEHTKNVRDWKEVFDFLAKDLTFIPLTSDEHDDRVNQWTNQSPQYPPLFRVVTQEYIQEMEKLSFKLLELIALSLGLEAKRFEEFFIKDQTSFIRLNHYPPCPYPDLALGVGRHKDPGALTILAQDEVGGLEVRRKRDQEWIRVKPTPNAYIINIGDTVQVWSNDAYESVDHRVVVNSEKERLSIPFFFFPAHDTKVKPLEELINEQNPSKYRPYNWGKFLVHRGNSNFKKQNEENIQIHHYKIA

SEQ ID NO: 10063 - protein, 341 aa, Sorghum bicolor
MQHLGVLLVLAALTASPLAAAWRPWPPRANGTTAGLGASKKFEGSSEFVKLEYHMGPVLASAITVHPIWYGAWPAAQKRTIRAFLRSLAPPPDSSARIPPPSVSAWWRTVRLYTDQTSANVSAAVTLGAEKCDARMSRGARLSRMDIQSVVRDAVTARTRPLPVDSSGGVYLVLTSPDVSVEDFCGQVCGFHYFTFPSVVGYTLPYAWVGNSARRCPEVCAYPFAIPSYVPGRKAEAPPNGDVGVDGMVSVIAHELAELASNPLANAWYAGSDPSFPTEIADLCEGIYGTGGGGAYTGQLLTDARSGAAYNVNGVGGRRFLVQWVWNPVLSYCSGPNALDQ

SEQ ID NO: 10064 - protein, 355 aa, Oryza sativa
MHAQLSTVVRHRWTGRYEAHLWDNSCKKEGQTRKGRQGGYDMEEKAARAYDLAALKYWGPSTHINFPLEDYQEELEEMKNMTRQEYVAHLRRKSSGFSRGASMYRGVTRHHQHGRWQARIGRVSGNKDLYLGTFSTQEEAAEAYDVAAIKFRGLNAVTNFDITRYDVDKIMASNTLLPADLARRNAATTTSKDDHSAAGAGAIVSVHSAADIAVADTLWKATTAPRQQQQHHDDVVLSGADQAAFSVLHDLVAVDAAAAHQQQQQQQHMSMSAASSLVTSLSNSREGSPDRGGGLSMLFAKPSPAVAASAQQQASTKLMAAPLPLGSWVSSPPASARPPAVSIAHMPLFAAWTDA

SEQ ID NO: 10065 - protein, 422 aa, Pennisetum glaucum
MALRLVLAAAFAVLAPALAAAGAPALGINYGQVADNLPPPQAAAVLLRALNATKVKLYDADARVLSAFAGSGADFTVGVPDRLVPRFATDPSAAPAWVRANILPHVPATSITAVTVGNEVLTGTDTTMLRSLLPAMEALHAALAACNLTSRVSVTTAHSLGVLSSSFPPSDAAFRRDVLPYMSPILGFLAKTGAPFLINAYPYFAYKADPDGVDLSYALFEPNAGVSDAATGLRYGNMLHAQVDAVRAAICRANYGKALEIRVSETGWPSQGDDDEAGATPENAARYNGNLMRMVMEGKGTPAAPGEALQVYVFALFNEDQKPGPASERHYGLFKPDGTPAYDVGVKAPTISGWKGSGSGSGNGTSGSAGLVVAQGPGGADGVGPGTGFYTVSASANKMKRRWQCAESLLVAAFLAMVSGLC

SEQ ID NO: 10066 - protein, 559 aa, Anaplasma marginale
MSSGTGLQGSASGSISRMYSNRFVSHGFDDIESGDADLSDALSELLDKGPKEGEIIEGTVICMNGGYITVDAGLKSEGVVSLREFELGDGGQDVEVGSKVKLCLEKIEGKSGSVVLSREKAIRDELWQKLEKAAEEKTDVEGVIFGSIRCGYTVDVGGVVAFLPASHVGLRQVKDITPLLGKKQQFRILKMDKKQGNIVVSRKAVLEESLADAKDSFLSQLEEGSIIEGKVKSITKYGVFIGIHESPSVGVVDGLLHITDISWSRVSHPSAVFSCGQTVRAKIIRIDRENRKISLGVKQLEESPWANVEERYPVDSIHKGIVTSIEDYGIFVELETGVEGLIHVSEVSWVRSHLPVNQTFMRGEEVEAKVLSLDAAKNRMSLSIKRCKENPWEAFIEKHPVGSVVETRVKSISSLGVFVSFEDDTSGSGIEGLIRSTELSWSGSPEAALKKYSVGDLVKAKILMVATNKNKIDLGVKQIERDPFLDLLKRVEVGDRVAVTVSKVLEDMGVLVDVFEGSESFNVLVKQEHLPENKKFFPGDRVEAEVLTVGSYSLVLSLK

SEQ ID NO: 10067 - protein, 510 aa, Aspergillus oryzae
MTRTDLIVDAVVIGGGFGGCNALYRLREMGLTTKLFEAGSGFGGVWHWNGYPGARVDSEMPAYQFNIPAVYRDWHWSERFPGVEELRRYFEHVDRVLGLSKDTYFNTIVSECRFDSASRLWIVHTSTGIRATCKYLIAATGSSYKKYFPEYPGLSQYKGQLVHSAAYPDNLDVTGKKVGIVGNGASGLQIVQELAKKDCELTVFIRTPCFALPMRQRNISPEESEMMKGYYDAIFDRCYKSVTGFPHNTKPQAASTASPEERKAIFDQLWQRGGYSFLVSNYYDFLLNEEANSIFYDYWVQQVRARMTNQKKMDLVAPLKQTYLVGTKRPSLEQDYYEMIDRENVVLHDLKKAPIQEFDETGVITAEGHRDLDIVIFATGYDAVTGSLLDLGIEDRNQVPLSEKWKDGTATHLGLMIPDAPNLFLVYGPQAPTSLANGPPFIEMEVDWICRAIAKMHDEGLASVVPTAKAAEQWKEEGPRDVDHPIWKHILCVCVCILKGTRTVIGIDIT

SEQ ID NO: 10068 - protein, 98 aa, Unknown
  Nostoc sp. PCC 7120
ASYQVRLINKKQDIDTTIEIDEETTILDGAEENGIELPFSCHSGSCSSCVGKVVEGEVDQSDQIFLDDEQMGKGFALLCVTYPRSNCTIKTHQEPYLA

SEQ ID NO: 10069 - protein, 609 aa, Pennisetum glaucum
MAALATSQLATTHAGFGFGDASSSSMFRTGVLRGSSRASSPAAGTLTVRTSARAVPRQQHHRRAHQRGARFPSLVVCATGAGMNVVFVGAEMAPWSKTGGLGDVLGGLPPAMAANGHRVMVVSPRYDQYKDAWDTSVVSEIKVGDRYERVRFFHCYKRGVDRVFIDHPSFLERVWGKTGEKIYGPDTGVDYKDNQLRFSLLCQAALEAPRILSLNSNPYFSGPYGEDVVFVCNDWHTGPLSSYLKSNYQSNGIYRNAKTTFCIHNISYQGRFAFSDYTELNLPERFKSSFDFIDGYDKPVEGRKINWMKAGILEADKVLTVSPYYAEELISGVARGCELDNIMRLTGITGIVNGMDVSEWDPSKDKYIATKYDVSTAIEAKALNKEALQAAAGLPVDRKIPLVAFVGRLEEQKGPDVMAAAIPQLMEEDVQIVLLGTGKKKFERMLMSAEEKYPDKVRAVVKFNAALAHHIMAGADLLAVTSRFEPCGLIQLQGMRYGTPCVCASTGGLVDTVIEGKTGFHMGRLSVDCKVVEPADVQKVASTLKRAIKVVGTPAYEEMVKNCMIQDLSWKGPAKNWENVLLSLGVAGSEPGIEGEEIAPLAKENVAAP

SEQ ID NO: 10070 - protein, 456 aa, Anabaena variabilis
MSNPTVENLVIIGSGPAGYTAAIYAARANLKPVVFEGFQAGGLPGGQLMTTTEVENFPGFPQGITGPDLMDRMKAQAERWGAELYTEDVISVDLSQRPFTVRSEEREFKAHSIIIATGATAKRLGLPSEHQFWSRGISACAICDGATPIFHGAELAVIGAGDSAAEESIYLTKYGSKVNLLVRSEKMRASKAMQDRVLSNPKIQVHWNTEVVDVFGNGHMDGVKVRNNKTGEETTVHARGLFYAIGHKPNTSLFQGQLELDEIGYVVTKHGSPETSVEGVFAAGDVQDHEYRQAITAAGSGCAAALLAERWLSANALIQEFHQEPTINNELETQPVAQKTEAEQEAGFALSATRHAGGYALRKLFHESDRLLIVKYVSPGCGPCHTLKPILNKVVDEFDGKIHFVEIDIDQDRDIAENAGVTGTPTVQFFKDKELVKEVKGVKQKSEYRQLIEANL

SEQ ID NO: 10071 - protein, 816 aa, Mesorhizobium loti
MTERLVIIGNGMAPGRMLEHLLEQAPSRYSVTIFNAEPRVNYDRIMLSPVLSGEKAYEEIIIHGDGWYIANNITLYKGHKIVAIDRAAKTVTSDHGVTEPYDKLVIATGSVPFIIPVPGHNLPGVLTYRDLDDVQAMMLAAQSRAKAVVIGGGLLGLEAAAGLNAQGMDVTVLHVMPTLMERQLDPAAGYLLQRAVEQRGIKVITKANTQAITGNGKVEQVELADGTVIPATLVVMAVGIRPNSALAKEAGIAVNRGIVVDAGMRSNDPDIYALGECAEVNGMVYGLVAPLYEMARVAAHQLAGNEAAAFVHMDTPTKLKVTGIDLFSLGDFAEGEDRQEIVLRDAAAGVYKRLVLKDDRIIGTVLYGETADGAWFNDLKKKQTDISQMRDTLIFGQSYQGGAPLDPMAAVAALPDDAEICGCNGVCKGKITGAITAKGLTSLDDVRAHTKASASCGSCTGLVEKLMVLTLGDSYNPAAVQPMCTCTTLGHDEVRRLIKAKHLKTIPAVMQELEWKTSCGCAKCRPALNYYLVCDWPDDYADDYQSRFINERVHANIQKDGTYSVVPRMWGGVTNAAELRAIADVVDKFEIPMVKVTGGQRIDMLGIRKEDLPAVWADLGQAGFVSGHAYAKGLRTVKTCVGSDWCRFGTQDSTGLGIRIEKFMWGSWTPAKVKMAVSGCPRNCAEATCKDVGVICVDSGYEIHFAGAAGLDIKGTEVLGLVKTEDEALEHIVALTQMYREQGRYLERIYKWAKRIGIPEIKRQIMDDDAKRKTYYERFVFSQKFAQVDPWSERVSGKDKHEFRPMASVGFAEAAE

SEQ ID NO: 10072 - protein, 259 aa, Datura stramonium
AGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 10073 - protein, 972 aa, Mesorhizobium loti
MRTTCPYCGVGCGVLAKVAADGQVSVRGDPDHLANFGRLCSKGSALAETIGLDGRLLHPEIHGRRTGWNEALDIVASTFSQTIAEHGSDAVAFYVSGQLLTEDYYLANKLMKGFVGSANIDTNSRLCMASSVAGHRRAFGSDTVPGTYEDLERADLIVLVGSNVAWCHPVLYQRIAAAREKRPEMKIVLVDPRRTMTSDIADMHLAIAPDGDVALFTGLLAWLGQHNALDRAYITAHTTGFGQALFAASALDLAGVAAATGLSEDELGGFYSLFAATAKTVTVYSQGVNQSSSGTDKVNAIINCHLATGRIGKPGAGPFSVTGQPNAMGGREVGGMANMLAAHMEIENPEHRDRVQRFWNAPGIAQKPGLKAVEMFQGVADGRIKALWVMATNPVDSMPDADAVEAAIKACPFVVVSDVLASTDTVRHAHVRLPAAAWGEKDGTVTNSERRISRQRSFLSAPGEARPDWWIIAEVARRMGFGEAFAHETPAEIFGEHAALSGFENDGGRDFDIGAYAGIDSVSYASLEPFQWPAPSQGTPLWPAGHIPRKGGDQPSLLPSPIVNVSERVAGPKLPISPLEGGEEWSAQRTESQLLGFPNDERPERQRRAGTGRTEGGDQARHLQQANGTTERDPTRFFANGHFYTADRKARFIAIRPTTETRTTPDFPLILNTGRIRDHWHTMTRTGKSPRLSQHIAEPFVEIHPLDAQHHGIGDADIVRISSPRGDVLVRALITPRQRQGSVFAPMHWTDQFAAKGRLDALTAPLIDPVSGQPALKHVAARIEKFAAKAFAFAVMRRRPEAIAADYWAVARCRGGWRVELAFANDDADWTAFAGSLFEAPSTEMLAYHDRDAGQHRIAAFDGEHLTGALFVARGPVAVSRGWAAEQLEEVQASQRERFRIVAGRAGAERPDAGATVCSCFSVGANQIVAAVAAGCTTVEAIGGALKAGTNCGSCRSEIRALIQASRVQAAE

SEQ ID NO: 10074 - protein, 478 aa, Oceanicola granulosus
MAAEAILVWVRRELRLGDHPALAEAAATGRPVVPVFLCDETVEARGAAAQWRLGLGVAAFAEALAGAGSRLVLRRGGAAAALVALAREAEAGEVWWSRAHEPVAAALERDVAGALAAEGIGTRAFEGHVLFPPESVATKTGGYYKVYTPFWKSVRDRDVGTPLPPPKRLTAPGRWPESERLEAWGLGAEMRRGADVVAEHVVVGEAAAARRLERFVEERLADYPQARNRFDVEGTSGLSENLAVGEISARSCWQAGLMARDAGNPGAETFLKEVAWRDFAYHLLHHTPRLATDNWRPEWAAFPWNTDEDAPEVVAWQRGRTGVALVDAAMREMYVTGRMHNRGRMIVGSYLTKHLLSHWRIGQRWFDAHLTDWDPANNALGWQWVAGSGPDASPFFRVFNPDGQAEKFDPDGAYRRKWVAEGQDDPPATALAYFAAIPRKWSMSADDPYPQPVVGLAEGRARALAAYKGRQDADAAGG

SEQ ID NO: 10075 - protein, 399 aa, Pyrococcus horikoshii
MSVMSGDEVQFQGDYDDYITYLKRRIRQLELQVRMLEADKERLERELSRLRSEMSRLRQPPAFAGTVIEVLDEDRAIVQNYNGPRFVVRIAPWIDRKKLRPGTRVALDQRTMAVVEILPTSKDPTVLGFEVIERPNVTYNDIGGLKKQLQELREAIELPLKHPELFEEVGIDPPKGVLLYGPPGCGKTLMAKALAHEVNATFIRVVGSELVRKYIGEGARLVHELFELAKEKAPTIIFIDEIDAIGAKRMDETTGGEREVNRTLMQLLAEMDGFDPRGNVKVIAATNRPDILDPALLRPGRFDRLIEVPLPDFEGRLEILKVHTRRMKLKGVDLRAIAEMTEGASGADLKAIATEAGMFAIRERRTYVTQEDFLKAVDKVLGNERKLLQQITSHEVIYG

SEQ ID NO: 10076 - protein, 590 aa, Magnaporthe grisea
MATINTQATAGTQPAKYHTSLLTSLDCRGHVHLILGTNPLAASRCTQSLAAGATPIVIAPATDGTDLHYALQKRIDAGEVQWLRRAFEDADLSTLGRPEVGGFVDAVFVTAAGSRDPQSPAAHVSALCRRQRVPVNVVDSPALCTFSLLSTHSDGPLQVGVTTNGRGCKLASRIRREIAAALPRDLGAACARLGEVRRRVQEEDGRGGGKGGQGVTTDDDSYDQSASFNKLVTDADIEAAKTRRMRWLSQVCEYWPLKRLAAVTDADVDAVLASYHTTTATSTTQPTATPSQTHPNPSSSPTLPTPRGRIILAGSGPGHPDLVTLATHKALQTADVILADKLVPSGVLDLIPRRTPVSIARKFPGNADAAQQELISSALAAYQAGKTVLRLKQGDPFVYGRGGEEIAAFRAAGVPDDRVAVLPGLTSALCAPLFAGVPATQRDVADQVLVCTGTGKKGKPPTPPGYLPSRTVVFLMALHRIVGLVGELTERTAEEESAGEEKRALWPRDTPCAVVERASCPDQRVIRTTLRHVAEAIEQEGSRPPGLLVVGRACEVLYTMEKGRAWVVEDGFKGMDYLDDVVAQGIPLLA

SEQ ID NO: 10077 - protein, 105 aa, Triticum aestivum
MWTERRARRSSSMAGGGGGRARGAEGKRAAPQGQRAPAATAGYFTAELAVLFLCLTALLVFLPLVLPPLPPPPSLLLLVPVGLMAVLVALAFVPSDSRSIASSCH

SEQ ID NO: 10078 - protein, 152 aa, Solanum lycopersicum
MSSFSEEQEALVVKSWGSMKKDAGEWGLKFFLKIFEIAPSAKKMFSFLKDSNVPLDQNPKLKIHAKSVLVMTCEAAVQLRKAGKVVVRDSTLKKIGATHFKYGVVDEHFEVTKYALLETIKEASQEMWSVEMKNAWGEAYDQLVSAIKTEMK

SEQ ID NO: 10079 - protein, 924 aa, Unknown
  Silicibacter sp. TM1040
MSDKITFTLDGAQVTADAGMTIWEVANGRGLKIPHLCHKPQPGYRPDGNCRACMVEIEGERTLAASCIREPSEGMVVTTNNARAENARKMVMELLVADQPAQEVAHDKSSHMWDMAELNGVSESRFPKLEEGHIPLLDDSHVAMSVNLDACISCGLCVRACREVQVNDVIGMAGRGHNAYPTFDIADPMGESSCVACGECVQACPTGALMPATVVDENQVGDRKDFDSETESVCPFCGVGCKVSLKVKDGKVKYVEGINGPANEGRLCVKGRFGFDYIHHPHRLTKPLIRREDAPDKGLNVDPGNLMTHFREASWDEAMDLAAKGLIKLRDADPKSVAGFGSAKCTNEEAYLFQKFIRQGFKHNNVDHCTRLCHASSVAALIENVGSGAVTATFNEIENADVAIIIGANPIENHPVAATYFKQFTKRGGKLIVMDPRGVGMRRYADEMLQFRPGADVSMLNAIMNVIVEEELYDSQYIHRWTENWEAEKEHLRQFTPEKMSEICGIEPEQLRRVARTFAGAEAGMIFWGMGVSQHIHGTDNSRCLISLALMTGNVGKPGAGLHPLRGQNNVQGASDAGLIPMFLPDYQTVTSDDVRRSFTDVWGGGDFSNEKGLTVTEIVDQVYAGNIKGMYIQGENPAMSDPDADHAREAFAKLDLMIVQDIFLTETANFADIILPASTLYEKNGTVSNTNRQVQRVRPAVTPPGEAREDWKITVELAQRIGLPWAYSDVSEVFAEMKLNMKSLDNITWERLEVETITYPSLHETDPGQAIVFGDGFPRPEGRARFTPASVIPPDEAPDADFPMIMTTGRQLEHWHTGSMTRRSLVLDAVEPEANCSLHPRTLRTLGVEPGEMVRLSTRRGSIEIMARADRAVAEDMVFVPFAYVEAAANILTNPAIDPYGKIPEFKFSAVRVEKAEGQIAAE

SEQ ID NO: 10080 - protein, 431 aa, Beta vulgaris
MAQILAPNMQCQMKLSKSLTNSMIPNSWTSILLKGSQKGSIKCSTKFKVCAALKTEHGTVNRMEQLLNLDVTPFTDKIIAEYIWIGGSGIDLRSKSRTLSRPVEDPSELPKWNYDGSSTGQAPGEDSEVILYPQAIFKDPFRGGNNILVICDAYTPAGEPIPTNKRHKAAEIFSNPKVASEVPWFGIEQEYTLLQPNVQWPLGWPVGAYPGPQGPYYCGVGADKSFGRDISDAHYKACLYAGINISGTNGEVMPGQWEFQVGPSVGIEAGDHIWCARYLLERITEQAGVVLTLDPKPIEGDWNGAGCHTNYSTKTMREDGGFEVIKKAILNLSLRHKEHISAYGEGNERRLTGKHETADIDTFSWGVANRGCSIRVGRDTEKEGKGYMEDRRPASNMDPYVVTGLLAESTLLWEPTLEAEALAAQRLSLNV

SEQ ID NO: 10081 - protein, 181 aa, Arabidopsis thaliana
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTDA

SEQ ID NO: 10082 - protein, 345 aa, Unknown
  marine gamma proteobacterium HTCC2143
MSEPSTAPFSEWREAVVFDAEVLRGNGEVRDRELQRLLQAVERWGFFELQGHGIETQHMKALFAAQRAFFALPDAQKLSLRRTETNARGYNPRELTKNQIDAKEILDFGHKPDPTADDDAPVNRVVDGWNQMPEDAGICTPIWDWFGLCEPLAIEVYGWLLEAMGASDDLASLTRGHTSFLRLNAYSDAHRLTQSQTKGPDSPVPLGIHRHTDAGLLTLLVENGHHALQVLHDRQWHMIEPAPNAFIVNTGDMLQVLSNDRFVAPEHRVLGSVGSQYRLSAAYFFNPPYAQVIEALPCKPVDFSGHSNDDKPRYRGFTWEEFRRRRGAGDYQDLGEEVQISHYRI

SEQ ID NO: 10083 - protein, 161 aa, Trema virgata
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDQLVAAIKFEVKPSST

SEQ ID NO: 10084 - protein, 161 aa, Trema virgata
MSSSEVDKVFTEELEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDQLVAAIKFEVKPSST

SEQ ID NO: 10085 - protein, 420 aa, Roseovarius nubinhibens
MSQRPTSRRAFLRGSAAAAAGAGALATSARAQSADPLITEVQPWASGLGDGVDATPYSLPIRFEADVIRRNVEWLTADTISSINFTPIHALDGTITPQGCAFERHHSGAIELRKQDYRLMINGLVDRPLVFTYEDLERFPRENHVYFCECAANSGMEWAGAQLNGAQFTHGMIHNMEYTGVPLRALLEEAGFDASAKWVYVEGADASSNGRSIPMEKALDDVFVAFKANGEALRKEHGYPVRLVVPGWEGNMWIKWLRRIEVLNAPVESREETSKYTDTLADGTSRKWTWEMDAKSVITSPSPQSPITHGTGPLVITGLAWSGRGAITRVDVSKDGGITWETARLAKPGERMAMSRFYLDTDWDGSEMLLQARAMDETGYVQPTKDQLREVRGENSIYHNNGIQTWWVKPNGEAENVEIS

SEQ ID NO: 10086 - protein, 346 aa, Xylella fastidiosa
MIDSKQKIAVLGAGSWGTALAALVARHDYPTILWGRDVRVIQSIDIQHQNFRYLPSIMLPQTLRATTDLAAAVSGADWVLVAVPSYAFTETLCRLAPLLSIGVGVAWATKGFEPGSGRFLHEVAREILGGDAPLAVVTGPSFAKEVTLGLPTAVTVHGEDACFTQMVANAMHGPMFRAYTGNDVIGAELGGAMKNVLAVAIGVADGMQLGMNARAGLITRGLNEMLRLSAVIGARPETLMGLAGLGDLVLTCTGDLSRNRRLGFALGRGQSLSDAIREIGQVVESVQTSDEVMRHAEQNGVELPISEAVRAVLREEITPYAGMKVLLAREQKPEYLDILFKANCSL

SEQ ID NO: 10087 - protein, 239 aa, Roseovarius nubinhibens
MMAKGPDGKNTSGRGQRDLTVKVKTARGRRNSSTRWLQRQLNDPYVKRAQAEGYRGRAAFKIMELDDKFRFLVNGARVVDLGCAPGGWAQVAVPRINALGEKPGKAVGRFIGVDLQEVEPLAGAEFHVLDFMEDGADDKVKEWLGGRADVVMSDMAASSSGHKQTDHLRIIALCEAAAYLAFDVLEEGGTFVSKVLAGGAEGDLQKLLKQRFTKVANVKPPASRPDSSEKFVIATGFRG

SEQ ID NO: 10088 - protein, 182 aa, Glycine max
VSVPCTSLFKTVTVRCGHCTNLLSVNMRGLLLPSANQLHLGHSFFTPQNLLEEIRNAPSTNMMMNQLPNPNDLVMSTMRGGPEETPKPPSANRPPEKRQRVPSAYNRFIKDEIQRIKAGNPDISHREAFSAAAKNWAHFPHIHFGLMPDNQPVKKANVRQEAEDVLMKDGFFAPANVGVSPY

SEQ ID NO: 10089 - protein, 788 aa, Methanococcus maripaludis
MVDLMVAEAYQGDVGKGIVRIDPLTMEKLSLKAGDAIEIAGKEKTYATVWRGYLEDQGKGIIRMDGILRQNTKAGIGDKVKITVVEVKEAKKITLAPMQAVRFSTGFESYVGSRLVEQVVDKGSKVVIGVLGTAFPFIVTGTTPKGPVKINEYTQIELKTEPVTELKETKVPNVTYEDIGGLKEEVKKIREMVELPMRYPELFDKLGIEPPKGVLLAGPPGTGKTLLAKAVANEAGANFYTINGPEIMSKYVGETEENLRKIFEEAEENSPSIIFIDEIDAVAPKRDEASGEVERRMVAQLLTLMDGLESRGQLVILAATNRPDSIDMALRRPGRLDREITIGIPDRHGRNEILQIHTRNMPLQPDYEKSDVISILNELVGEYDRSKIESLVKLVEKASSEEEIEKILKDGEVEDKVKVKLNQLMVKELADKTHGFAGADLAALSKEAAMKTLRRFLPDIDLEKEEIPREVLDKIKVTKEDFVGGLKEVEPSALREVLVEVPNIKWSDVGGLEDIKQDLKEAVEWPIKNKEMFERMGIRPPKGVLLFGPPGTGKTLLAKAVANESEANFISVKGPEIFSKWVGESEKAIREIFRKARQAAPTVIFFDEIDSVAPKRGMDFGSSGVTEKVVNQLLTELDGLEEPKDVVIIAATNRPDILDQALLRPGRLDRIVLVPIPNETARLEIFKVHTKGMPIGKDVNLEKLAKETKGYTGADIEAVCREAAMIALRENINSEHVESRHFDGAFKRIAPSVKDDDMDEYKDLAKEYGQNAGVSEIEKGPENTGYHG

SEQ ID NO: 10090 - protein, 197 aa, Unknown
  Oceanobacter sp. RED65
MAQRTASVERNTSETEISVKVNIDGTGKTQFDTAMPFLEHMMDQIGRHGLIDLDIVCKGDNHIDDHHSAEDTGITLGQAFAKAIGDKKGIRRYGHAYVPLDEALSRVVIDFSGRPGLEYNIPFTRASIGGFDTELFYEFFQGFVNHAQVTLHIDNLKGHNAHHQIETVFKAFGRALRMALEMDPRMEGVIPSTKGSL

SEQ ID NO: 10091 - protein, 59 aa, Brassica napus
KKVKKGLFAEHSPLLDDISGVPNWKKVNSGLLKMYKVEVLEKVPIMQHFLFGCLIKWEE

SEQ ID NO: 10092 - protein, 501 aa, Acidobacteria bacterium
MSKKVVFFFPSFASTEATAPLGILAVATPLLRAGYEVCLIDSTITPDFKKRVLAEVKDAICLGVSLVTGPMIRETIEIARAIKEWNPEFPIVLGGWHPSLLPTQTLEAEYVDIVVRGQGEESFLDVVRHLESRSAMDLVAGIGFKRDGKTVFTAERPLRPIADLPPKAYHLADFDAYERVCGRRWAMYTSSLACPFNCAYCTNAGVYGRKWNALPAEQFVEETVDLTRRYNLEMLWVVDDNFLVDLDRAREIGAGLVRAGGNFKWSIQATTNLVARLSTEDLKLLHRAGLQQICQGAESGSEKVLAAMNKDFQNFESIYESAKRCLEAGIRPSFNIIFAFPGEGPKERRETVHFILDMCTKYPGAEFWTNIFTPYPGAPVMQKAKEFGIDVPTSFEGWADFFPRYTELPWLKGREHRRLQVMRDYLRMAFDRIPIAAQRRTSFTRFAQRAISLPARWRLKNDFYAAPIELYLNNKLKKRMTMKPAVDAKRLQTTATAEAAC

SEQ ID NO: 10093 - protein, 297 aa, Agrobacterium tumefaciens
MPVVQPRRRVFPSVSICIPIAGTAFSVIVKKQPRTMSIPQILNSIAAKGPVFEAGHVWLAGAGPGDVRYLTLEVALALSQADIIVRDALVSDDVVALGPQAEVVFAGKRGGKPSATQDDITASLIDFALQGKKVLRLKGGDPFIFGRGGEEAEALVHAGIPFRILPGMTSSFTALASARIPATMRGISRAVTLATGHAAGTEEDLDWLALAKTQEPIVVYMGLKNIGTIAGLLMQGGRSGKTPVAVIMSATTAKERIFIGTLQSIADDAKRESFEAPALIIIGEIVSMRDRLGVSGS

SEQ ID NO: 10094 - protein, 501 aa, Acidobacteria bacterium
MLTRGKVVLFYPAYEGAPLSAPTCLLSLAATLREHDYSVVMIDAAIVPNSKDRVLRELDDALCLGISVLTGPMILGAIEVAKAAKELHAKLPIVFGGWHPTLLPEQTLIEPYVDFVVRRQGESSFLELVNAIASGQSGEFISGVSWKIRDHCEHNVDRPTQPLDALPLPAYDMVDFDAYERTAGERKLAYATSVGCPYACNYCTDMVFYKRRFNALNAERVVAEMTGLVAKFKIAEIALLDSNFPVDVKRAVAIARGIYESGVPFRWTFQASTDFLFRMSDDEVKVLRASGVSHMGFGTESTSESVLKLMNKRHQRMNEVYETARKADAAGIRVTFNLIFGYPGETENDRAETFRAMSEIAREFQSVSFSPNIFTPYPGIPIWPELREMGVQEPQSLREWALLPLGVNVLPWLQGRDLARLQRMLAYFLLNSHVRKNSRSISRASRVVRRAVSGSVRWRIRKSRFSFPWELWLARTTEHWAERRSLVTGQVLPKPSAAVCN

SEQ ID NO: 10095 - protein, 488 aa, Nostoc punctiforme
MQIQTPDWVKHAVFYQIFPDRFARSKQPRKRLLQEARWEDWDSMPTLQGYKGGDLWGIMEDLDYIQNLGINAIYFTPIFQSASNHRYHTHDYYQVDPMLGGNEAFKELLDAAHQRNIKVVLDGVFNHSSRGFFFFHDVLENGPHSPWVNWFKIEGWPLSPYNGEFPANYVGWAGNRALPEFNHDNPEVREYIMEIAEYWLKFGIDGWRLDVPFEIKTPGFWQEFRDRTKAINPEAYIVGEVWGDSRQWLDGTQFDGVMNYLFAGPTIAFAAGDRVVLEQVQSRDYQPYPPLFAAEYATKIQEVLQLYPWEIQLTQLNLLASHDTARLMTIAGGDIASVELSTLLLLTFPGAPSIYYGDEVGLPGGIDPDSRRGFPLEANWNQEIFNTHRQLITIRQTYPALRTGDYQVLYAQGQLYLFARTLGTEELIIAINAGTSSATANVDVASLHTQPNKLLYGTAEAEWNGEEGTQQLSLTLPARSGCILGTGD

SEQ ID NO: 10096 - protein, 605 aa, Triticum monococcum
MAALVTSQLATSGAVLGITDRFRRAGFQGVRPRSPADAALGMRTVGASAAPKQQSRKAHRGTRRCLSVVVRATGSGGMNLVFVGAEMAPWSKTGGLGDVLGGLPPAMAANGHRVMVISPRYDQYKDAWDTSVVSEIKVADEYERVRYFHCFKRGVDRVFVDHPCFLEKVRGKTKEKIYGPDAGTDYEDNQLRFSLLCQAALEVPRILDLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLTVNYDVTTALEGKVLNKEALQAEVGLPVDRKVPLVAFIGRLEEQKGPDVMIAAIPEIVKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEHVLLELGVEGSEPGIVGEEIAPLAMENVAAP

SEQ ID NO: 10097 - protein, 431 aa, Rhodobacter sphaeroides
MNAPHRDDGFFTESLSSRDPELFASITGELGRQRDEIELIASENIVSRAVMEAQGSVMTNKYAEGYAGKRYYGGCDYVDVAETLAIERAKQLFGCAYVNVQPNSGSQANQGVFQALIKPGDTILGMELASGGHLTHGAAPNQSGKWFNAIQYGVRQQDQLIDYDQVAALAREHKPKLIIAGGSAIPRQIDFARFRAIADEVGALLMVDMAHFAGLVAGGAHPSPFPHADVATTTTHKTLRGPRGGMILTNSEEIAKKVNSAIFPGIQGGPLMHVIAAKAVAFGEALRPEFKAYAAQVVKNAQALADELMKGGLDIVTGGTDTHLMLVDLRPKGVKGNATEKALGRAHITCNKNGIPFDPEKPTVTSGVRLGTPAGTTRGFGEAEFREIGRLIVEVVDGLAANGEEGNAAVEEAVKAKVAALCARFPLYPTL

SEQ ID NO: 10098 - protein, 369 aa, Leptospirillum ferrooxidans
PVRDMDRLIGQTIQVRIIKMNKKRGNIIVSRRVLLEEWRDRRKKVTMDALKEGEVLEGIVKNITDYGAFIDLGGIDGLLHITDMSWGRVSNPQDLMNVGDKLNVVVLKHDRDTGRVSLGLKQLSADPWTLVATRYPEFSKVAAKVVSITDYGAFLEIEPGVEGLMHVTEMSWNHEVKHPSKIMNVGDVVEARVLKIDEKNRKISLGLKQLGPNPWDSVEERYPVGTVVSGKVKSLTDFGAFVGLDEGIDGLIHISDMSWTKHVRHPSELFKKGQKVDVAVLKIEKERQRLSLGFKQLSQDPWDAEIPEKFAVGVSVDGVITKVMDFGFFVELAEGVEGLVHVSEVDIESGQRLDQSYQVGSTISVRVIK

SEQ ID NO: 10099 - protein, 329 aa, Chromobacterium violaceum
MNSHLFDDRKTHMSAPRHSPLLILGSGPAGYTAAVYAARANLKPVVITGLAQGGQLMTTTDVDNWPADAEGVQGPELMQRFQQHAERFGTEILFDHIHTTHLSEKPIRLVGDAGEYTCDALIIATGASAQYLGLPSEEAFAGKGVSACATCDGFFYRNQDVAVVGGGNTAVEEALYLANIARHVTLIHRRDTFRAEKILVDKLMSRVAEGKISLKLNATLDEVLGDDSGVTGVRVKLNDGGSENLALTGVFIAIGHKPNTDIFKGQLEMDSTGYLITKGGRDGNATLTSIDGVFAAGDVQDHIYRQAVTSAASGCQAALDAERYLDSLK

SEQ ID NO: 10100 - protein, 461 aa, Acidobacteria bacterium
MAELLLTHGYFLFEDPKEMQIMKPYPPLGLLYICSYLKQKGFDVDVFDSTFSLREDLFNYLRTQTPGVLGIYANLMTRANVVQIVKVAREAGWTTIVGGPEPGAYALEYLSAGAEFVVMGEGELTMEELLSCLLANQKERALNIAGIAFLDEKGTLRRTASREQIRDLDAQPWPARNSIDVARYVETWRKAHGQGSVSFITARGCPFKCRWCSHQVFGQTHRRRNPKLVVDEVEWLLNAYSPDMVWVADDVFTINHAWIREYSAEMKRRSLRIPFECITRADRFNEEMAVLLSELGCFRIWIGSESGSQRILDAMERGVRVEQVHKATELCRTHGIQSGMFLMWGYEGEEVADIEATIDHVKQSKPDIFLTTLAYPIKGTPYYNAVADKLVEVRPWTESSDRELVVAGRRPREYYQHADQLLRDEVALTRLSPETAGGVKLRQRIAASRSAMSLLTGGPTK

SEQ ID NO: 10101 - protein, 520 aa, Aeropyrum pernix
MWRQSRWNEPLITEMSRRGRRGALPPRPDEKVVKEVGPLKLPQSLARGSPPSLPEVSEVEVVRHYTRLSQMAYGVDNGPVPLGSCTMKYNPRVAARLAFDPRLETLHPLQDDETVQGVLEAIYMVQEWLRHITGMDACTVHPAAGSQGELAGVLMIKRFHEMRGDLDKRRVIIVPDSAHGTNPASAAMGGFQVVEVPTGDDGNVDMEALKAAVGGDTAGLMITNPSTLGLFEENILEISRLVHEAGGLLYYDGANLNGIIGRARPGDMEFDIAHVNLHKTFSVPHGGGGPGSGPVCVKRVEVVDGVTLEDLLPGPRVVYSREEGLYRVRPPGRWSVGRLRAWIANTLAVLWAYAYILAMGPQGLRLAGEVSVVNTNYFIRLMEGHWGYSLPYAPSRPRKHEVVLSAKPLKRETGATAEDVAKGLLDAGLYAPTIYFPLIVEEALMIEFTESETKENIEAYAARLKEIAEEARRDPSTPRKWPRNTTSARVDNVRANHPRTVTPTWRVEVLRRQGKLGPLR

SEQ ID NO: 10102 - protein, 465 aa, Aeropyrum pernix
MEHPWIPNSHKAILDEMLEAIGVSSVDDLYRDIPPTILLSPEEWDSLPIGEGRPLSEAEVLARINDILSRNKYFTDPPPFVGGGVWPRYVPSVVKALITRGEFLTAYTPYQAEISQGLMQALFEYQSLVAELLEMEVVNASLYDWSSAVGEAMLMARRVTRRNRVLVPETMNPLHLETATTYAYGGGIRVEKVRVDRETGFIDLEDLESRLSQGDTAALYMEYPSSYTGVIDENVEAAGEAVHKAGGLFILGVEPVSMAILKPPGRLGADIAVGDGQPLGLGLNYGGPYLGVFAVRWDGRLVRQMPGRLIGMTVDAEGRRAFAMILQTREQHIRRAKATSNITTNEALMAIAAAVYLSLLGPQGLREVAEASWYMSHYAAKRLSELRGVEAPLLEGEFIMDFTVRLPMDAGVARRRLLEKGVLAGIPLGGFSFFSDNDMLLTVTEAHTRRHVDLLVNLLDSVLGG

SEQ ID NO: 10103 - protein, 170 aa, Oryza sativa
MAASSSLDLVKTMAASGFLLRCPAAPSAVPLWGRSGRGGGGGLAFSASSSNGAAVPSSLSDSEKKGPVVMEIPLDKIRRPLMRTRANDPAKVQELMDSIRVIGLQVPIDVLEVDGVYYGFSGCHRYEAHQRLGLPTIRCKAPYAMKLEWTYYFSQKVIICVPLCSYAILL

SEQ ID NO: 10104 - protein, 435 aa, Magnaporthe grisea
MTVLPLEPEFSQAYNELAGTLEDSTLFEKYPELRTALSVVSIPERVIQFRVVWEDDSGALRVNRGYRVQFSSALGPYKGGLRLHPSGGADFDPKGKSDAEIRRFCVAFMTELSKHIGADTDVPAGDIGVGGREIGYMFGAYRKLRNRFEGVLTGKGLDWGGSLIRPEATGYGLVYYVGHMLEYAGVGGWAGKRVAISGSGNVAQYAALKIMELGGTVVSLSDSRSALVAVEGGRTITEADVKRVMELKDRRRPLSDLLPESEEGGSTSPGGLKHLPGARPWTHVGKVDVALPCATENEVSKEEAEALVAAGCRFVAEGSNMGCEQGAIDVFEANRRSKGKGDAVWYAPGKAANCGGVAVSGLEMGQNSSRLKWSREKVDKELANIMETAFRTGLDTAKEYVNRASDDELPSLVAGSNIAGFVKVARAMQAQGDWW

SEQ ID NO: 10105 - protein, 136 aa, Oryza sativa
MFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADAAAAAAAAGIPRPAAGVPATDPLAYYYVPQQ

SEQ ID NO: 10106 - protein, 739 aa, Escherichia coli
MYRNGNTVEGSTLMSTSDDIHNTTATGKCPFHQGGHDQSAGGGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVGPDPEAAPIEEQGLGWASTYGSGVGADAITSGLEVVWTQTPTQWSNYFFENLFKYEWVQTRSPAGAIQFEAVDAPEIIPDPFDPSKKRKPTMLVTDLTLRFDPEFEKISRRFLNDPQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGVVGVEKAASAAGLSIHVPFAPGRVDARQDQTDIEMFELLEPIADGFRNYRARLDVSTTESLLIDKAQQLTLTAPEMTALVGGMRVLGANFDGSKNGVFTDRVGVLSNDFFVNLLDMRYEWKATDESKELFEGRDRETGEVKYTASRADLVFGSNSVLRAVAEVYASSDAHEKFVKDFVAAWVKVMNLDRFDLL

SEQ ID NO: 10107 - protein, 441 aa, Clostridium cellulolyticum
AGTHDYSTALKDSIIFFDANKCGPQAGENNVFDWRGACHTTDGSDVGVDLTGGYHDAGDHVKFGLPQGYSAAILGWSLYEFKESFDATGNTTKMLQQLKYFTDYFLKSHPNSTTFYYQVGEGNADHTYWGAPEEQTGQRPSLYKADPSSPASDILSETSAALTLMYLNYKNIDSAYATKCLNAAKELYAMGKANQGVGNGQSFYQATSFGDDLAWAATWLYTATNDSTYITDAEQFITLGNTMNENKMQDKWTMCWDDMYVPAALRLAQITGKQIYKDAIEFNFNYWKTQVTTTPGGLKWLSNWGVLRYAAAESMVMLVYCKQNPDQSLLDLAKKQVDYILGDNPANMSYIIGYGSNWCIHPHHRAANGYTYANGDNAKPAKHLLTGALVGGPDQNDKFLDDANQYQYTEVALDYNAGLVGVLAGAIKFFGGTIVNPPVKK

SEQ ID NO: 10108 - protein, 280 aa, Pyrococcus horikoshii
MRDMEFIEWYPRGYGVAFKVKRKILEEQSEYQKIEVYETEGFGKLLAIDGTVQLVTEGEKSYHEPLVHPAMLAHPNPRRVLIIGGGDGGAIREVLKHEEVEEVIMVEIDKKVIEISAKYIGIDGGILEKMLSDKHEKGKLIIGDGVKFIEENSGFDVIIVDSTDPVGPAEMLFSEEFYKNAYRALNDPGIYVTQAGSVYLFTDEFLTAYRKMRKVFDKVYYYSFPVIGYASPWAFLVGVKGSIDFMKVDAEKGKKLGLEYYDPDKHETLFQMPRYIVQML

SEQ ID NO: 10109 - protein, 387 aa, Medicago truncatula
MISQVKYTSSLPFTNFGSSNFIPRPKLCTLPIVQHVGKNTNNLSLSSLKPLYISSTENFSFSTTKLTRRETECHAYEADRSQPLEINIDIAGEQAAQKLKIGLYFATWWALNVVFNIYNKKVLNAFPYPWLTSTLSLAAGSLIMLISWATRVAEAPKVNLEFWKALFPVAVAHTIGHVAATVSMSKVAVSFTHIIKSGEPAFSVLVSKFLLGEAFPLQVYLSLLPIIGGCALAAVTELNFNMIGFMGAMISNVAFVFRNIFSKKGMKGMSVSGMNYYACLSILSLLLLTPFAIAVEGPTMWAAGWQTAVSPNWWVAAQSVFYHLYNQVSYMSLDQISPLTFSIGNTMKRISVIVSSIIIFHTPIQPNNALGAAIAILGTFLYSQAKQ

SEQ ID NO: 10110 - protein, 147 aa, Unknown
  Fragaria x ananassa
AFLKWYREAELIHGRWAMTAVVGIFVGQAWSGVPWFQAGADPSAVAPFSFGTLLGTQLLLMGWVESKRWVDFYNPESQSVEWATPWSKTAENFSNFTGEQGYPGGKFFDPLGFAGTIKDGVYIPDTEKLERLQLAEIKHSRLAMLAM

SEQ ID NO: 10111 - protein, 513 aa, Unknown
  delta proteobacterium MLMS-1
MRKKGGKVYLIGAGPGDPELITCKGKRLLGQAGVVVYDYLANPRLLELAPADALFIYAGKKGGSQHTHSQSEINQMLVDHARAGKTVVRLKGGDPFVFGRGGEELEELAAHGIAFEAVPGVTSASAAATYAGVPITHRAFTSTVAFVTGHEDPNKQESRIAWDKLATGVGTIVFYMGIKNLPNITANLIRHGRDPQTPVAVVRWASTPEQRSVVGTLDNIVHVVRENGITPPALVVVGEVVSLREVLNWYEKRPLFNKRILVTRSREQASELVAQLEDMGAACLEGATIAIAEPADWQPLDRAVARLGSYHWLLFTSPNAVRFFFRRLAALGLDSRALQGPRLAAVGTATAEALAGQGIKVDLLPEQFTAEGLSSALLAQGVAGQRILLPRALKARDILPDNLRAAGAGVDIVPVYQNITPPLSDEIRQALKQRQIDLITFTSSSTVRNFIDLLGLAKEQLAELLSGVKIAAIGPITAATAHEAGLVVDIQPTEHTIAALVEAIVDDSGQGEG

SEQ ID NO: 10112 - protein, 516 aa, Methanocaldococcus jannaschii
MMCGINGIIRFGKEVIKEEINKMNKAIKHRGPDDEGIFIYNFKNYSIGLGHVRLAILDLSEKGHQPMGYNVDEDKIIYRDDELDRADIIIVYNGEIYNYLELKEKFNLETETGTDTEVILKLYNKLGFDCVKEFNGMWAFCIFDKKKGLIFCSRDRLGVKPFYYYWDGNEFIFSSELKGILAVKEINKKENINKDAVELYFALGFIPSPYSIYKNTFKLEARQNLIFDLDKREIRKYYYWELPDYKPIYDKKKLIEEGKKLLYDAVKIRMRSDVPVGAFLSGGLDSSTVVGVMREFTDLSKLHTFSIGFEGKYDETPYIKIVVDYFKTQHHHYYFKERDFEELIDKYSWIYDEPFGDYSGFPTYKVSEMARKFVTVVLSGDGGDEVFGGYMTHLNGYRMDFIRKLPKFLRVVGSKLPVKKDLNGIANLYLLKEAFRLSLINPEEFYAESIKEDAIRPEIYKKWTIEKLRYCLNKGDNKLGEALRIFDLLFNTLCDNFLVKVDRASMLTLWKLEVHF

SEQ ID NO: 10113 - protein, 161 aa, Trema virgata
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDLLVAAIKFEVKPSST

SEQ ID NO: 10114 - protein, 411 aa, Bacillus cereus
MSIFRSQNESETEKNIDKHALIFGLISVFLCGIGFSIIMPVVPFLVQPYISSPEEQALVVTLLTSVYAVCLFFTAPALGALSDKYGRRPLLLICLFGSAIGYLVFGIGGALWVLFAGRIIEGITGGSISTIFAYFADIIPSEQRTKYFGWVSAVVGAGTIIGPTLGGLLAKFGHSVPLYFGALITLLNVLYGMKYMPESLDKNNRLKEITFVRLNPFAQLANILSMKNLKWLLVSAFLLWIPNGSLQGIFTQFTMDTFSWKPALIGLMFSIMGFQDIISQAFIMPKLLIKLSDKQIAILGMVSEVIGYSFIAASALFSLYSFLIVGMLLFGFGDSIFGPSFNGMLSKSVDSSEQGRVQGGSQSIQALARMIGPIIGGQIYVSLGHAAPAFMGIILIVVAIAVLYREKHITV

SEQ ID NO: 10115 - protein, 201 aa, Magnetospirillum magnetotacticum
MVAADQALPGRASEMRVPERHYVLDTLLKPPFPVGMETAIFAMGCFWGAERLFWKTGGVYSTSVGYGGGFTPNPTYEEVCTARTGHAEAVLVAFDPAEVPYSALLRLFWEGHNPTQGMRQGNDIGTQYRSAIYWTSPAQKDEAEASRLAYGQALQRAGFGAITTEIAQAGPFYWAEGHHQQYLAKEPGGYCGLGGTGVRCG

SEQ ID NO: 10116 - protein, 476 aa, Agrobacterium tumefaciens
MEQAEIGLIGLGVMGSNLALNIAEKGNKIAVFNRTPEVTRKFYADAGELQGQIIPCETIEEFVAAIRPPRPIIIMIKAGDPVDQQMEILKPHLANGDIMIDAGNANFRDTIRRFDNLKDSGLTFIGMGVSGGEEGARHGPSIMVGGTEDSWKRVEKVLTSISAKYNDDPCVAWLGNDGAGHFVKTIHNGIEYADMQMIAEIYGILRDGLKMSAVEIADVFAEWNKGRLNSYLIEITEKVLRAADPITGKPMVDLILDKAGQKGTGKWSVIEAQNMGVAATAIEAAVAARILSSQKDEREAAEKIFGLPTLAAAPADKKAFIADLESALLAAKVGAYAQGFAIMSAASKEFNWNLPMPTIARIWRAGCIIRSEFLDEITSAFTKDPHVANLIVTPAFSAIVKDTDAPLRRVVSYAVLSGLPVSALASALGYFDAYRRGRGSANLIQAQRDFFGAHGFERTDGVDKPHGPWGSGADIF

SEQ ID NO: 10117 - protein, 1111 aa, Kluyveromyces lactis
MSDVKKEICKVLGLDDEIVADFIININKNCTTKNEFKKKLLEMDQDLSAAVVSDIYDVVNKTAGSTAATRVKTLLAEQLDVHDDVVTNFIMDICSKSETLLKFRAKLKEMEAGVSDSLALRIFNIVHSSNVAVKTEIEDTKSALSLPNTTVSWEGIEEKASNKSRFRKNETVDPEPVLDKVYPGKVQNVTKFGCFVRIFGVRNTNVDGLVHVSELSSSHVDKPEDVVHRNQDVFVKVIKIQNNGKISLAMKGIDQSTGMEAATRGRTKEKVIPKRKLTSPERWEIRQLISSGAASIEDYPELKDDYNISQPTNSEADGTNEQKEEEELEVEINVDDEPKFLKGQVKPDRKYELPSITKVPKGSLNRSAMVGSYTMKEHREEKLKRKKEVKKQLNKSKQLADPSSSKVLSNSEFDARQLVATAWERSRMKERVSYGKRTSLPIKEQRERLPVYRMRQQLIDAVIKNQFLVIVGETGSGKTTQLTQYLDEEGLSNKGMIGCTQPRRVAAVSVAKRVAEEMGCNVGEEVGYTIRFEDETSSRTRIKYLTDGMMQREALLDPLMSRYSVILLDEAHERTVATDVLFALLKKAALQRPDLKVIITSATLDSDKFSKYFMNCPVIEIPGKTFPVEVLYSSKPQMDYIESALDTTMDIHINEPQGDVLVFLTGQEEIDTCCEILYERVKALDGTIPELIILPVYSALPSEIQSRIFEPTPKGSRKVIFATNIAETSITIDGVYYVIDPGFSKINTYNPRVGMEQLLVSPISQAQANQRKGRAGRTGPGKCFRLYTESAFKNEMLPNTVPEIQRQNLEHTILMLKAMGINDLLNFEFMDPPPKSFMVSALEELFNLQALDEEGFLTTLGKRMSQFPMEPGLSKTLLASVTNKCSDEMLTIVAMLSIQNVFYRPKDKQQEADNRKARFHHPYGDHLTLLNVFNRWRESNYSKSFCTTNFLHERHLKRALDVRQQLFNIFKKMNLPIVSCHGDVDCIRKTLVSGFFRNAAKRESQAGYKTLTDGTQVAISPGSSLFGKEYDYVLYHSIVLTSREYMMQVTAIESKWLLESAPHFYKVADPNGSSRKKAKIVPLNDRFAQSKDSWRLSSIRANRDKKLGGKR

SEQ ID NO: 10118 - protein, 285 aa, Desulfitobacterium hafniense
MPTFLSENEHGLWMTEDERENLKIDYRIKEIIVEAKSTLQHVMILDSYSFGRMLVLDGAVQTTSLDGHIYNETISHVPLSIHPNPKKVLIIGGGDCGVAKEVCKYSSVEQIDVVEIDPMVVEVCLKHLPEVSGGLADPRVNFIFDDGVNYVQNSPTKYDIVIVDSSDPIGPAEVLIEKSFYRSIFNALEEDGLMVCQSQSPIFHGEVMEQIFERVHDIFPKTKMFTAVVPTYPGGLWSFTLGSKGYVIPNEARMKELDALYVNEQIMASCFSLPEFMNKQLSKYR

SEQ ID NO: 10119 - protein, 186 aa, Zea mays
  misc_feature (173)..(173): Xaa can be any naturally occurring amino acid
MVSADTIRTAIGVIGNGTALVLFLWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFGTGMYAAPLSVMKLVIQTKSVEYMPLFLSLASLANSICWTXYALIRFDLYITIP

SEQ ID NO: 10120 - protein, 371 aa, Candida glabrata
MSDNSVLKVFKLVKAPIYSHCFSADRSVLAISCEANCLIYRVGGPTPQLVATLANHDKLVTAVDISPHGRIVTCSQDRNAYVWEPLSDGSYKPTLVLLRINRAATSVSWAPSGYKFAVGSSARIIAVCYYEHENNWWVSKHIKKPIKSTINCLSWHTNGVLLAAGGTDGYMRVFSGFIKGLDSKESVAGSPWGDKFPFGSLVKEWYQGSYIHDVKWRSSQEQIAFVTHDAKLNIVDSQNGYEFTDSPDGLPFKALVWINDNEILCGGYSCHPVLFSKSSQGWKFSKNIDKIGAKTPTPQVGGEDEDENPTFGMSALKKFKELDLKGKVSVEVQESAHENTITELAPFAESNGQVTEVSSCGLDGKIVIYRI

SEQ ID NO: 10121 - protein, 383 aa, Coprinopsis cinerea
MAPEVFTLAQTPITSHAFNADRSILAVYIRSLTIRGAQHDKVITSIDWAPNSNRIVTASQDRNAYVWQETADPETGKLVWKPTLVLLRINRAATYVRWSPKEDKFAVASGARAIAICSFDAENNWWVAKQLKKPIRATVLSLDWHPNNVLLAAGSADLKARVFSAYIKEVDERPAPTVWGSKLPFNTICGEYSSPSGGWVHAVGFSPSGDVLAFASHDSTISVVYPGGPTVYNIRLPSLPLVSLTWTSEHSIVAAGHDCRPLVFAGSEQGWQESGTLDDATSTKSPGGASGFGSGPGRLKSAAFETFRAADTRGQSNIGGSGTTDTKLHTIHQNTITTVRAYEWDQNGEVTKVSTSGVDGTLVIWDANAISALTGRLGGATVR

SEQ ID NO: 10122 - protein, 374 aa, Hevea brasiliensis
MAISSSTSGTSSSLPSRTTVMLLLIFFTASIGITDAQVGVCYGMQGNNLPSVSEVIALYKQSNIKRMRIYDPNQAVLEALRGSNIELILGVPNSDLQSLTNPSNANSWVQKNVRGFWSSVRFRYIAVGNEISPVNGGTAWLAQFVLPAMRNIHDAIRSAGLQDQIKVSTAIDLTLVGNSYPPSAGAFRDDVRSYLDPIIGFLSSIRSPLLTNIYPYFTYAYNPRDISLPYALFTSPSVVVWDGQRGYKNLFDATLDALYSALERASGGSLEVVVSESGWPSAGAFAATFDNGRTYLSNLIQHVKGGTPKRPNRAIETYLFATFDENKKQPEVEKHFGLFFPDKRPKYNLNFGAEKNWDISTEHNATILFLKSDM

SEQ ID NO: 10123 - protein, 473 aa, Clostridium tetani
MNKQDIGLIGLSVMGSNLALNMADKGYKVAIFNRTTTVIDEVLEKYKHSNLFGKYSLKQLMDSLERPRKIIMMIKSGEPVDMLIEQILPYLDEEDILIDGGNSYFKDTQRRSKYLKEKGIKFLGVGISGGEEGARFGPAIMPGGDFGSYEKVKCIFEDIAAKVNGEPCCNYVGENGAGHYVKMVHNGIEYADMQLISEAYMLLKHLGKFNNKELHGIFAKWNEGELESYLIKITSNIFTVKDRETNNYLLDMILDKASQKGTGKWTNMEAIDLGVDVSIITSALNGRFMSNLKEERLRASKILNGKVESSINIEKEEFAELVRRSLYLSKIACYAQGFQLLKVASKTYNWDLQYGNIARIFRGGCIIQARFLKDIISAYEENNNACNLMITKVFSKVINEYDKSLRKTISIAINQGIPVTAMSSALGYMDTYRSYNLGANLIQAQRDYFGAHTFQRIDKEGNFHYDWVNNYEK

SEQ ID NO: 10124 - protein, 625 aa, Ipomoea nil
MARGEGFAENLREKLALAIRSIEWSYAIFWTISSAQPGVLEWGDGYYNGDIKTRKTVQAAETSTDQLGLQRTEHLRELYGSLLAGETNLHAKIPSAALSPEDLTDTEWYFLVCMSFVFNIGQGLPGKALAKNQTVWLCNAPQADGRVFTRTLLAKSACIQTVVCFPHLGGVIELGVTELVKEDRGLVQHLKTSYLDIPCPIVPGVPNYISTDDGNDRDIVNSKPNQDTLEASPKEENIDSPDNSSNGLEADEFKVKGATAEASQPPNCQIVEDDISNCIHNSTNSSDCISQNYENPEEKVSDFLNDEEMVEHSPPENQECNQESLVPLDNRGQGHDVHYQSILSSVLKSSHQFILGPYFRNGNRESSFGGWKKEISTNIQTLRIETSQRLLKKVLSGVARMVCIPDTRKEGDGKNDPRRLEADESDRSRVVSERRRREKINERFMILSSLIPSSGKADKVSILDETIEYLKDLKTRVWEAESQKEGFELNARMGRNCKDCDDAERTSDNCGTNIIDNNKKPSSKKRKASETEGASKSIAKNGSARDVAVSVTDEDVTIEIGCQWSEGVLIKIIQALNNLHLDCETIQSSNGDDGTLSVSVKCKMKASKLTSPSPALIRQALKRVI

SEQ ID NO: 10125 - protein, 416 aa, Unknown
  Acidovorax sp. JS42
MTDRLTPRRAAPRQPALLPLADRCTALLSRLSHADAAGGIVLLIAAAAALAWANSPWAASYHALWHVPLSVAVGGWQLTQSLHFWVNDALMTVFFLVVGLEIRRELHDGVLAQPRDALLPVLAALGGVAVPALLYLALVPPALRSGWAVPTATDIAFAVGVLALLGRGLPPVLRVFLLTLAIIDDLVAVLIIALFYSGGLQWPMFGIAALGLAGVLLLQQLGVRRAWAYVPAGAVLWWGIWQTGAHPTLAGVVLGLVTPVHALAGREPAPPVQRVQASLHPWVTFGVMPLFALANAGVALGSAGGAQPAAPGTGLLMAAVAVALVAGKPLGVLLACWLAVRLRLCALPAGMGWGGLLLTGLLAGIGFTMAIFIATLAFDSAALLDAAKRGVLLASGLAALLGLAWGWWLQRRATTA

SEQ ID NO: 10126 - protein, 170 aa, Xanthobacter autotrophicus
MTTERAVLAGGCFWGMQDLIRKLPGVISTRVGYTGGDVPNATYRNHGTHAEAIEITFDPSQTTYRRLLEFFFQIHDPTTLNRQGNDRGASYRSAIYFTNDQQKAVALDTIADVEASGLWPGKVVTEVEPVGDFWEAEPEHQDYLERIPHGYTCHFARPDWVLPRRAGAAA

SEQ ID NO: 10127 - protein, 436 aa, Novosphingobium aromaticivorans
MTTATAAPEIRKAGFFTEHLETADAEVFAAIRGELKRQQTKIELIASENITSLAVLEATGSVFTNKYAEGYPGKRYYGGCEYADVVENLAIERAKKLFGCNFANVQPNSGSQMNQAVFLALLQPGDSFMGLDLNSGGHLTHGSPVNMSGKWFKPIPYGVRADDHLIDMDEVARLARENKPKLIIAGGTAYSRVWDFKRFREIADEVGAWLLVDMSHFSGLVAGGAHPSPFPHAHVVTSTTHKSLRGPRSGIILTNDEDLAKKFNMAVFPGMQGGPLVHVIAAKAVAFGEALRPEFKAYAAQIVANARALAEAVKDAGLSVVSGGTDNHLMLVDLSAKDVTGKAAEKGLDRAWLTCNKNGVPFDKRSPFVTSGIRLGTPAGTTRGFREEEFRKIGALIGEVVDGLARNGEEGDGQVEQRVRDRVAELCAQFPIYPEL

SEQ ID NO: 10128 - protein, 270 aa, Thermoplasma acidophilum
MKVAVVQMESSTDREKNIEASYRLLEKAKNSDLVVFPEYQIYAPAFDGKDDMKTISEPLDGKFVKSITEIARSESQKIILNIPERNQYNLKPFNTAIYIDELGLILKYRKLHLFDAFGFRESSVFEKGDARPAIFNGSGDPLGVLICYDLRFPEPARMLALDGAKLIIYQAGWFAGERKYDQWKTLLKARAMENGVFVIGAAQTGHRFTGHSMVISPYGDVLAEMGTDEGVITFDIDFSLVEKYREEVPVLKHRRTDVYDVLDVDAFKLI

SEQ ID NO: 10129 - protein, 513 aa, Physcomitrella patens
MAIGKVLGCAGFQHSAVPTLREPVRLRAQCRRRGKTVSMSVQKTSKTVQQAEKMSQEFRQSSSTPLPLLHQVADALVQEMYAGLASEGGSDQLKMLPTYVENLPSGSEKGLFYAVDLGGTNFRVLRVELGGKTGQILSQEFKEVVIPPELMVGTGKDLFDFIAGTLASFVDTEDESIKAHFVQSGKTRESGFAFSFPVRQTSVKSGIVIHWTKGFKVDDAVGKDIVKQFQDAISRSNHQIMISALVNDTVGTLAGGRFNFDEETMIGCIIGTGTNACYVERADAVHKWDEPLPKSGEMVINMEWGNFRSPYLPRTFADETVDKDSVNPGDQWFEKMISGMYLGEIVRLVLARMAKEAELFGGNVPVKLLERLTLGTPHVSKIHLDNSPDLDVVAKVLKDVFEIETTTLEERKIVHEVCDIMGERGGRLAAAGLYGILKKIGRTGKSRNGSKKKTVIAMDGGLFEHHVRYRSYMEEALQELMGSDAAYEVALRLQNDGSGIGAALLAASHSHFK

SEQ ID NO: 10130 - protein, 232 aa, Zea mays
MAGKELTLLGLWASPFVLRARIALSLKGLTYAYSEENLDDKSELLLSSNPVLKKVPVLIHHGKPVCESQIIVQYVDEAFPAAAPNFLPSDPYDRAIARFWASYVDDKFYSAWIPVFRGRTAEEMAEAARQAVAALETLEQAFRECSKGKAFFGGDSVGLVDVVLGGLVGWLYATEAICGVKALDAGRTPLLAAWAERFCALEGVKGLIPDVDRLLEYTKARRAVFGLPPLRP

SEQ ID NO: 10131 - protein, 242 aa, Neisseria gonorrhoeae
MSQITMRQMIEAGVHFGHQTRFWNPKMAQYIFGARNKIHIVNLEKTLPMFQEAQEAVRRLVANKGTVLFVGTKRQARDIIREEATRAGMPFVDHRWLGGMLTNYKTVKQSIKRLEEKTAALENAAESGFSKKEILEMQRDVEKLERSLGGIKNMKGLPDAIFVIDTGYQKGTLVEAEKLGIPVIAVVDTNNSPDGVKYVIPGNDDSAKAIRLYCRGIADAVLEGKNQALQETVAAAQETAAE

SEQ ID NO: 10132 - protein, 399 aa, Chlamydomonas reinhardtii
MSSLLKTRVVPSLAARDVAFCHPLVFTTSSQRVARASGQSSAFPLRSAVSGVSSRRPFTCLAVAASAGDVSDGSSHTEMMQTLVLGSMFAGWYAANIAFNIYNKQLLKAFAFPLTITEAQFLVGSCVTLVAWGSGLQRAPKITWSTIKNVLPLAVVHTLGNLLTNMSLGAVAVSFTHTIKAMEPIFSVALSALFLGDQPSPLVLATLLPIIGGVAMASMTEATFNWFGFLSAMGSNLTFQSRNVLSKKLMLKKKDKDGNAEAPLDNMALFSVITLLSAALLLPATLLFEGWKLSPVGLAEMGVRSPNGVLAHAAMAGLCFHLYQQVSYMILSRVSPVTHSIGNCVKRVVVIAASVLFFRNPVSLQNALGTALALAGVFLYGTVKRQQAIAAGKKIAASE

SEQ ID NO: 10133 - protein, 290 aa, Oryza sativa
ERDGGGRKDGDGGAAAGSLAGARVHRQVRARPSSGSSVVPFALPPFAGDGRRQEGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMEWSYKGKPFFGGDAVGFLDVALGGLLSWLHGTEELCGAKILDAAKTPLLSAWARRFGEMDAAKVALPDVCKLVEFAKMKRVQLEAAMAATTVSRN

SEQ ID NO: 10134 - protein, 609 aa, Zea mays
MAALATSQLVATRAGLGVPDASTFRRGAAQGLRGGRTASAADTLSMRTSARAAPRLQHQQQQQARRGARFPSLVVCASAGMNVVFVGAEMAPWSKTGGLGDVLGGLPPAMAANGHRVMVVSPRYDQYKDAWDTSVVSEIKMGDRYETVRFFHCYKRGVDRVFVDHPLFLERVWGKTEEKIYGPDAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 10135 - protein, 164 aa, Grabowskia boerhaviifolia
GVDRVFVDHPMFLEKVWGKTASKIYGPKVGQDYVDNELRFSLLCQAALEAPRVLNLNCSKYFSGPYGEDVLFIANDWHTALIPCYLKSMYQSKGIYLNAKVAFCIHNIAYQGRFSFSDFSLLNLPDEYRSSFDFIDGYEKPIKGRKINWMKAGILESHRVVTVS

SEQ ID NO: 10136 - protein, 152 aa, Chlamydomonas reinhardtii
MALLANSRSLRGANPSAVRATAARVARLAVVPRRGVATAAQKQQFESFDDMLARSELPLLVDFYATWCGPCQMMSPILTAVQTKMKGKLQVVKIDTDKYPGIASQHRIQALPTIALFMKGKMVFRFEGVLNEGQIIDKVNYYLSGAAMGQQK

SEQ ID NO: 10137 - protein, 353 aa, Grabowskia boerhaviifolia
DAWDTSVAVEIKVGDSIETVRFFHCYKRGVDRVFVDHPMFLEKVWGKTASKIYGPKVGQDYVDNELRFSLLCQAALEAPRVLNLNCSKYFSGPYGEDVLFIANDWHTALIPCYLKSMYQSKGIYLNAKVAFCIHNIAYQGRFSFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPVDKEIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 10138 - protein, 454 aa, Saccharomyces bayanus
MSEPEFQQAYDEVVSSLEDSTLFEQHPKYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQFAALKVIELGGTVVSLSDSKGCIISETGITSEQIADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 10139 - protein, 358 aa, Grabowskia boerhaviifolia
YDQYKDAWDTSVAVEIKVGDSIETVRFFHCYKRGVDRVFVDHPMFLEKVWGKTASKIYGPKVGQDYVDNELRFSLLCQAALEAPRVLNLNCSKYFSGPYGEDVLFIANDWHTALIPCYLKSMYQSKGIYLNAKVAFCIHNIAYQGRFSFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPVDKEIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 10140 - protein, 484 aa, Haemophilus ducreyi
MSIKGDIGVIGLAVMGQNLILNMNDNGFKVVAYNRTASKVDEFLAGEAKDTNIIGAYSLEDLAAKLEKPRKIMLMVRAGEVVDQFIDALLPHLEAGDIIIDGGNSNYPDTNRRTITLAEKGIRFIGTGVSGGEEGARHGPSIMPGGNEEAWPFVKPILQAISAKTDKDEPCCDWVGKEGAGHFVKMVHNGIEYGDMQLICEAYQFLKDGLGLNYEEMHAIFADWKNTELDSYLIDITADILAYKDADGEPLVEKILDTAGQKGTGKWTGINALDFGIPLTLITEAVFARCVSAFKDQRVAVSQLFNKTITPISDDKKEWIEAVRKALLASKIISYAQGFMLIREASENFEWNINYGATALLWREGCIIRSAFLGNIRDAYEANPGLVFLGSDPYFQNILQSAMADWRKVVAKSIEIGIPMPCMAAAITFLDGYSSEHLPANLLQAQRDYFGAHTYERTDKPRCSFFHTNWTGRGGNTASTTYDV

SEQ ID NO: 10141 - protein, 583 aa, Streptomyces avermitilis
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTYDPVRKQYYWHRFFSHQPDLNYESAAVQEEILAALRFWLDLGIDGFRLDAVPYLYNEEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDVTQVTKVSLFVSS

SEQ ID NO: 10142 - protein, 381 aa, Arabidopsis thaliana
MSDDEEPPLKKNKLPVEEPTLIPSLPEELILSILARVSRLSYRSLSLVCKRFHSLLTSGEIYRFRSLSGYTENCLYVCLRFSHTGRSHRWFMLREKNKSSGYVLAPIPISHSPSLHASSIVAVGSKIYKIGGVMDGSSVSILDCWSHRWLEAPSMQMERDRPSANLIDGKIYVTGGCHRGSYNPSKWMEVFDLKTETWEPVLCRSDRLTFESYHERTNNLLVDGKLYIFWADKGVVYNPKDDTWDSLEVPEMDMCLTLFYCCVIENVLYDFFYEELDIKWYDTKARTWRSLLNGMRELHKFVRHASVTLADYGGKMVMFWDKFVASGDGLGFHKTMMWCAMIALERSDSGEIWGKVEWFGPVLPNQIPLEYAFEYVGSVKV

SEQ ID NO: 10143 - protein, 490 aa, Unknown
  Nocardioides sp. JS614
MTSTISVLPDYDAPQVAVNDIGSEADFLAAIDETIKYFNDGDIVAGTIVKVDRDEVLLDIGYKTEGVIPSRELSIKHDVDPSEVVAVGDEVEALVLQKEDKEGRLILSKKRAQYERAWGTIEQVKEEDGVVEGTVIEVVKGGLILDIGLRGFLPASLVEMRRVRDLQPYVGQTLEAKIIELDKNRNNVVLSRRAWLEQTQSEVRHGFLTQLQKGQIRKGVVSSIVNFGAFVDLGGVDGLVHVSELSWKHIDHPSEVVAVGDEVTVEVLDVDMDRERVSLSLKATQEDPWQHFARTHQIGQIVPGKVTKLVPFGAFVRVEEGIEGLVHISELAERHVEIPEQVVQVNDDVMVKIIDIDLERRRISLSLKQANETATAADVEDFDPTLYGMAATYDEQGNYVYPEGFDPETGEWLEGYEEQRAVWEDQYAKAHARWEAHVKQQAEAAKAEVEAGEATSYSSGGTDTDSAETGGSLASDEALQALREKLTGGN

SEQ ID NO: 10144 - protein, 212 aa, Ralstonia eutropha
MNRRQTAFAASVRRAMFATALALAAASAALLPHPARAADKPAAMPAAAPAGNCPASLNFQFPRLQDEAPQNLCQYAGKVVLVVNTASYCGFTPQYEGLEALYSKYRDRGLVVLGFPSNDFSQEPGSSKEIADFCYNTYGVKFPMLGKSHVRGGDVNPMYALLAKETGTAPKWNFYKYLIDRSGNVVGSYNSMTKPDDKQFVAKIEQLLSSPR

SEQ ID NO: 10145 - protein, 358 aa, Lycium afrum
  misc_feature (81)..(81): Xaa can be any naturally occurring amino acid
YDQYKDAWDTSVAVEIKVGDSIETVRFFHCYKRGVDRVFVDHPMFLEKVWGKTASKIYGPKVGQDYVDNELRFSFLCQAAXEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIVGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 10146 - protein, 374 aa, Hevea brasiliensis
  misc_feature (206)..(206): Xaa can be any naturally occurring amino acid
MAISSSTSGTSSSLPSRTTVMLLLIFFTASLGITDAQVGVCYGMQGNNLPSVSEVIALYKKSNIKRMRIYDPNQAVLEALRGSNIELILGVPNSDLQSLTNPSNANSWVQKNVRGFWSSVRFRYIAVGNEISPVNGGTAWLAQFVLPAMRNIHDAIRSAGLQDQIKVSTAIDLTLVGNSYPPSAGAFRDDVRSYLDPIIGFLSSSXSPLLANIYPYFTYAYNPRDISLPYALFTSPSVVVWDGQRGYKNLFDATLDALYSALERASGGSLEVVVSESGWPSAGAFAATFDNGRTYLSNLIQHVKGGTPKRPNRAIETYLFAMFDENKKQPEVEKHFGLFFPDKRPKYNLNFGAEKNWDISTEHNATILFLKSDM

SEQ ID NO: 10147 - protein, 134 aa, Gossypium barbadense
ADTIDNVKAKIQDKEGIPPDQQRLIFAGKQLEDGRTLADYNIQKESTLHLVLRLRGGMQIFVKTLTGKTITLEVESSDTTDNVKAKIQDKEGIPPDQQRLIFAGKELEDGRTLADYNIQKESTLHLVLRLRGGF

SEQ ID NO: 10148 - protein, 367 aa, Prochlorococcus marinus
MSENSSAPVTELEESNADSQITSPENEQNADLADQAATHEESFNTEEIPSADDPSSRVKKYDFDGAGFSLEEFDSLLGKYDYNFKPGDIVNGTVFALETKGAMIDIGAKTAAFMPMQEVSINRVEGLSDVLQPSEIRQFFIMSEENEDGQLSLSIRRIEYQRAWERVRQLQKEDATIYSEVFATNRGGALVRVEGLRGFIPGSHISTRKAKEELVAEYLPLKFLEVDEERNRLVLSHRRALVERKMNRLEVGEVVVGAVRGIKPYGAFIDIGGVSGLLHISEISHEHIETPHSVLNVNDQMKVMIIDLDAERGRISLSTKALEPEPGDMLTDPQKVFDKAEEMAAKYKEMLLEQAEEGENPITSMEV

SEQ ID NO: 10149 - protein, 344 aa, Sinorhizobium meliloti
MTKYKLEYIWLDGYTPVPNLRGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHSFVNNGYRGYLEDRRPNSQGDPYQIASVILKTISSVPTAVAKVA

SEQ ID NO: 10150 - protein, 374 aa, Hevea brasiliensis
MAISSSTSGTSSSLPSRTTVMLLLFFFTASVGITDAQVGVCYGMQGNNLPPVSEVIALYKKSNITRMRIYDPNQAVLEALRGSNIELILGVPNSDLQSLTNPSNAKSWVQKNVRGFWSSVRFRYIAVGNEISPVNRGTAWLAQFVLPAMRNIHDAIRSAGLQDQIKVSTAIDLTLVGNSYPPSAGAFRDDVRSYLNPIIRFLSSIRSPLLANIYPYFTYAGNPRDISLPYALFTSPSVVVWDGQRGYKNLFDATLDALYSALERASGGSLEVVVSESGWPSAGAFAATFDNGRTYLSNLIQHVKRGTPKRPKRAIETYLFAMFDENKKQPEVEKHFGLFFPNKWQKYNLNFSAEKNWDISTEHNATILFLKSDM

SEQ ID NO: 10151 - protein, 406 aa, Crocosphaera watsonii
MYSSALGATSGQTTAYGSRMFVYEVVGLSQNTDNDSLDYPIRRSGSVFITVPYGRMNQEMRRISRMGGRIVSIQPVDAETPLKSTSNGSSTAKVAQPQASNQTEKKRKSMTQAKTKIPTNIYRQKSPYVGKCIENYALVAEGGSGIVQHVTFDISGGDLHYLEGQSLAIIPPGTDAKGKPHKSRLYSIASTRHGDKVDDKTISLCVRQLEYEHPETKETVYGVCSTYLCNLEVGADVAMWGPVGKEMLLPDEEDANIIMLATGTGIAPFRSFLWRMFFENNPEYKFKGKSWLIFGVPYSANVLYKDQLEEIQTKYPDNFDLTYAISREQKNSEGGRMYIQHRVAEQAEKLWTMLQDPKTHLYMCGLKGMESGLEEGLRDFASKQGVEWPDFVKQLKKEHRWHVEVY

SEQ ID NO: 10152 - protein, 432 aa, Bacillus cereus
MESIIKRSLTKECTKQSGKVVLLQGWVKKIRHLGNVSFLLIRDRSGVMQCVLENELAGYKVDVESVVQVVGEIVETSKTELGVEVLAHEVKILNGAEPLPFEINKKKLQVGLDQLLNERVLSLRHERIAAIFKVKSTLVQSFSEFLIENDFTRIFTPKIVSQGAEGGANVFKLPYFQKEAYLAQSPQFYKQMMVAGGLERVFEIAPVYRAEHHNSSRHLNEYISLDVEFGFIHDFHEVMQLETDVLRYMFQQVAKKCEKELQLLQIEVPVITEIPKIKLLEAQEILKSKYRKESPVGDLDTEGEKLLGKYVKETYKSEFVFITHYPKEARPMYTMPNKENPAITDSFDLLYKGLEITSGAQRIHNYEMLLASFNEKGLHPDKFQSYLTTFRYGCPPHGGFGIGLERVIYKLLELTNVREASAFPRDCTRLIP

SEQ ID NO: 10153 - protein, 258 aa, Brassica napus
MAMAVSGAVLSGLGSSFLAGGKRSAAALGNNVGAGAARVGRKTLIVAAAAAQPKKSWIPAVKGGGNFLDPEWLDGSLPGDFGFDPLGLGKDPAFLKWYREAELIHGRWAMAAVLGIFVGQAWSGVPWFEAGADPRAIAPFSFGSLLGTQLLLMGWVESKRWVDFFNPDSQSVEWATPWSRTAENFANYTGDQGYPGGRFFDPLGLAGKSRDGVYEPDREKLERLKLAEIKHSRLAMLAMLIFYFEAGQGKTPLGALGL

SEQ ID NO: 10154 - protein, 415 aa, Clostridium tetani
MGVINMMKNVIIKEKIYLVGKIDDRDVPFHRLTLTKGTTYNSYLLLTEKPTIIDTVDISFGREYIQSLKNLIDLDKIQYIVINHTEPDHSGALGSLAYNAKNATIVCTDKAVDQLKAMYKLYNRNFLVVKNGDTLDIGGKTLEFIKTPYLHTEETMVTFTKEDKILFPCDIFSTHISNYEYFNDKAKEDILEDFKTYYSLIMHPHRRYVQNMINKIENLDIEIIAPSHGFILREDVKKFINIYDEMSKNTNIDKKVLILYSTMTNNTKKISELIKEHFERDSINTELINVNKTSDEEIFKKVKESDAVLVGTSTKYGDMIGRLEDILKSLKDMDLENKIAAAFGSYGWSGEGIEVVQDYLNETNMKVLSTSYIIKSTGMTDVKFPIRIKFSPEENDKEEIKKTTTFIVDLLLNSI

SEQ ID NO: 10155 - protein, 681 aa, Methanothermobacter thermautotrophicus
MKLEYIPTVCPYCGCGCGLNVVTIDGKVEGVEPWKRHPLNEGKLCPKGNFSYQFVGRDDRLTKPLIKENGEFREASWDEATSLIASKLEEYRGEDPDSLAFLASARCTNEENYLLQKFARAVIGTQNVDHCARLCHGPSVAGLAKTFGSGAMTNSISDIEESSCIFIIGSNTAEQHPLIWRRVLRAKANGAKLIVADPRVSPTAKMADIYLPFKPGTDVPLMNAMMNVIIEEGLEDREFIEKRTKDFEKLKETVKNYKPEEAEKITLTPADKIREAAIEYAKADSAAILFAMGITQHITGTDNVVSTANLAMLTGNVGKRGAGVNPLRGQNNVQGACDMGALPAFYPGYQKVIEEDATEKMSCAWGCSDLKCTPGLTVVEMMNAAAEGKLKAMYIMGENPMVSDPDIQHVKESLENLEFLVVQDIFLTETAELADVVLPASAWSEKNGTYTSTERRVQYIRKAADAPGEAKDDWQIICEIANKMGADGFKFSSAEDIFEEIREVTPQYAGMNPERLVKPEGLHWPCPDETHPGTPILHTEQFATPDGLGIFFPVEYREPAETPDSEYPFILTTGRIIFHYHTGTMTRRSETLDREVPTGFVEINDEDALELGIKNGDMVKVKTRRGEIEITARVTPEIMKGVLFIPFHFAECAANMLTSADELDPEAKMPELKVSAASISK

SEQ ID NO: 10156 - protein, 270 aa, Aeropyrum pernix
MVFARVNEADVTEAILDGFYSSLKKHLRSDVIVVGAGPAGLTAAWRLAEAGARVLIVEQNNYLGGGLWLGGYFMNPVTIRAPAQRILDELEVPYEAVKPGLYRTKGPLLAAKLAARALEAGAEVLNLTMLDDVIVENSRVAGVVVNWSPVQGLPRQITCVDPVGLRAEYVVDATGHDAVVTRKLAERGMVEASKLGPMWVERSEDLVVEKTGEVYPGLVVAGIAVAEVYGLPRMGPTFGAMLLSGEKAAALIGEKLGLKVKVAAAPASQA

SEQ ID NO: 10157 - protein, 159 aa, Populus euphratica
MNFGLRMVSEPDQAPIHSITLFVALLCACILIGHLLEKHRWINESITALAIGLCTGTLILLTTKGRSSHILLFDEQLFFIYLLPPIIFNAGFQVKKKQFFRNFMTIMLFGAVGTLISFIIISLGTAQLFKKLDIGFLDTVDYLGLGAIFSATDSVCRIR

SEQ ID NO: 10158 - protein, 607 aa, Ipomoea nil
MAKGCEDQEGFAENFREKLGFAVRNIEWCYAIFWSISSSQPGVLEWGDGYYNGDIKTRKTVQATEISPDLLGLQRTEHLRELYDSLLAAEANTLAKIHPTALSPEDLTDTEWYFLVCMSFVFNVGQGLPGKALSKNQSIWLCNAHQADSRIFTRSLLAKSASVQTVVCFPYLGGIIELGATDLVLEDLNLIHHIRTSYLDIPHAVGSKVPNYVSSNGKNDKDIGGREPDEDKLDLCPVPPVECEDNNNIGSPYNNSNGFGANQEEGDSFMVEEMIGEASQLQSWKLADDDISNCIHNSTNSSDCISQNYVNPERVSTLSDAEKLNGDSGKGVDVHYQSILSNVLKSSHQLVLGPHFRNNDRESSFVTWKKETSSKNPMPRTRTRPQRLLKKVLCGSHKQNDHHKPEADETDKSRVLSERRRREKLNERFTTLASLIPTSGKVDKISILDETIEYLRDLERRVRNVEPQKERLELEARSDNAERISDNCCAKSADKGKNVMRQKRKVSDMEENSRGKHKDCTKNGSGHDVTVSMISKDVTIEMKCQWSEGMLMKIVQVLNNLHLDCHGIQSSNSDGILSVTIKAKMEGTKAISMSLIRLALQKLIQAS

SEQ ID NO: 10159 - protein, 112 aa, Unknown
  Azoarcus sp. EbN1
MKFVTAIIKPFKLDEVREALSAIGVQGITVTEVKGFGRQKGHTELYRGAEYVVDFLPKVKIEAAIRPDLLDQAIEAIEKSAATGKIGDGKIFVFDLEQAIRIRTGETGPDAL

SEQ ID NO: 10160 - protein, 258 aa, Methanococcoides burtonii
MKLDEVTISRAIIEEFSKVFLDYTDVDVALVGGGPANLVAAKYLAEAGLKTVIYEKKLAVGGGMWAGGMMFPRIVVQEDALHILDEFGISYHEYENGYYVANSIESVGKLISGATSAGAEIFNLVNVEDVMIRENDEICGLVINWTAVEIGKLHVDPLAIRSKVVVDGTGHPAVVCSTVQRKVPGAKLGELGVVGEKPMWADVGEKMLLDTTKEVYPNLYVAGMAANAVAGAPRMGPVFGGMLLSGKQVAELIIERLG

SEQ ID NO: 10161 - protein, 334 aa, Oryza sativa
MASQGVASMFALALLLGAFASIPQKAEAIGVCYGMSANNLPPASSVVGMYRSNGITSMRLYAPDQAALQSVGGTGISVVVGAPNDVLSNLAASPAAAASWVRNNIQAYPSVSFRYVAVGNEVAGGATSSLVPAMENVRGALVSAGLGHIKVTTSVSQALLAVYSPPSAAEFTGESQAFMAPVLSFLARTGAPLLANIYPYFSYTYSQGSDDVSYALFTAAGTVVQDGAYGYQNLFDTTVDAFYAAMAKHGGSGVSLVVSETGWPSAGGMSASPANARIYNQNLVNHIGRGTPRHPGAIETYVFSMFNENQKDAGVEQNWGLFYPNMQHVYPISF

SEQ ID NO: 10162 - protein, 426 aa, Methanococcoides burtonii
MTETIDDEPRSNNYSFSGIGNGELVSKSDEDFSKYLLDRMKQLESRNNLLKEQYDQMESDKRYIESQKLKYERETHRLQSEIERLKSPPLVVASVVDIFDDDKALIRSSTGPQFLVNVSQDFEDDDLLVPGARVGLNQQTLAVVDIIPESDEPLITAMEVIDSQEVDYSQVGGLDQQIREISESVELPITKPEAFKRIGITPPKGVLLFGPPGTGKTLLAKAVAHRTNATFIRVVGSELVQKYIGDGAKLVRDIFEMARKKAPAIIFIDELDAIAATRLGDTNGADREVQRTLMQLLAEMDGFDNRGDVRIIAATNRPDVLDPAIVRPGRFDRIIEIPLPDQDGRETIFLIHMDMLNIGSDVDVKKLASLTEGASGADIGAIVMEAGMLAVRNDSDHIGMSDLLDAVTKVMVPKENNLDHSENMFW

SEQ ID NO: 10163 - protein, 78 aa, Onion yellows
MSKNNLNETESKIEIEAKVVELLSNDKFKVELPNKKTIIAYVSGKIRINNIRILPGDKVRIELSPYDPTRARITYRFK

SEQ ID NO: 10164 - protein, 455 aa, Myxococcus xanthus
MDIHENILTAIGNTPLVKLNKLVGPNDATVLVKCEFMNPGASIKDRMALYILEKAEREGKLKPGGTIVENTSGNTGMGVALAAAVKGYKCIFTMPDKMSLEKINRLKALGAQVVVTPTNVPAEDPRSYYETAKRLHRETPGAFMLNQYHNPDNIEAHYNTTGPEIYKQTEGKFDYFVAGLGTGGTMSGAGKFLKEKIPGLKNVGVDPEGSVYEGYFKTGKLTEPHVYKVEGIGEDMLCGAMDFTHLDDVRQVDDRQCFIAARRLAREEGIFAGGSSGAAIHVAVQLAKEVGKGKTIVVVLPDSGSSYISKFHSDEWMRDNGFLEEKGAGTIRDILGDKRKDVKTARRGDKVDQVVETMRGHGISQMPVVGDDGRTVGMVHEYDLLNALVAGKAKFSDTIDSIIAPLQGALSLDTSIARLREVFAQDNVAVVKDGEKVVGIVTKIDLIDYLHRTAA

SEQ ID NO: 10165 - protein, 258 aa, Silicibacter pomeroyi
MTASRIYPGSGHVDFVGAGPGDPDLLTVAALKAFAAADVVLHDRLISDAVLALAGETATLVDVGKAGFGPSWKQGDIDALLVDHASRGARVVRLKSGDPTVFGRLDEEIDAVSAAGISWRIVPGITAASAAVAGIGQSLTRRGRNSAVRFLTGHDMQGFADHDWTALARPGAVAAIYMGKKSARFVQGRLIMHGADRATPVTLVENASRPDQRVLATTLDRLPADLAAAEMDGPALTFLGLAPRDAATALSTINKELA

SEQ ID NO: 10166 - protein, 454 aa, Saccharomyces monacensis
MSEPEFQQAYDEVVSSLEDSTLFEQHPKYKKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQFAALKVIELGGTVVSLSDSKGCIISETGITSEQIADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 10167 - protein, 144 aa, Oryza sativa
  misc_feature (133)..(133): Xaa can be any naturally occurring amino acid
LVATGRGGSRSRRRRDLAAGGRAPCVASSPCSASQTSPSPSAPASSSLSRRLRHRGPDWSGIHCYQDCYLDGSVWFSSEMKALSDDCERFISFPPGHLYSSKTSGLRRWYNPPWFAESIPSTPYNPLLLRQSXFEKAIIMRLMT

SEQ ID NO: 10168 - protein, 275 aa, Bacillus subtilis
SELWYTEKQTKNFGITMKVNKTLHTEQTEFQHLEMVETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVDVQVDDGFMHIAKSENQYDVIMVDSTEPVGPAVNLFTKGFYAGIAKALKEDGIFVAQTDNPWFTPELITNVQRDVKEIFPITKLYTANIPTYPSGLWTFTIGSKKYDPLAVEDSRFFDIETKYYTKDIHKAAFVLPKFVSDLIK

SEQ ID NO: 10169 - protein, 1163 aa, Gibberella zeae
MSKQAGTEDAAAPQSVTNPTSQNELYPMVNWKYDMFLYTVGNIVDMFFREVVPRGAWRVPQTGPVLFVAAPHANQFVDAIILQRTLRNEAKRRASLLIAQKSVHGFIGWGSRQVGSVPVGRAQDAAKPATGTIYLPDPINDPTLIRGVGTKFGQGEGEVQGMLFLPSVKGQSGASVDILEIISPEEIRVKRPFKGKLALSQLTGRDDIDNNGNFTIKEVKGPAPGFQGTKFKMAPHIDQTKVYDAVFSRLCNGGCVGIFPEGGSHDRTELLPLKAGVAIMALGTLAQDPDCGLKIVPVGMNYFHAHKFRSRAVVEFGAPFEIPRHLVELYCNKQRREAIGQVLDTVYQALNSVTVSAPDYDTLMVIQAARRLYNPTGKKLPLPVVIELNRRLCMGYERYKNDERITSLTAAVKEYNSQLRYLNLKDHQVQYAKMNMVKVIFLFIYRSIKLLLLFICTLPGLILFAPVFVATRIISRRKAKTALAGSTVKIRGRDVMATWKILVAIGLAPTLYHIYSAIVTFKVWQDRLWGRVPEGVPLWVIYFAMWPFMVGITFASLRFGEVGVDIFKSLRPLLLCLTPTSNYNIHRFRIRRAELSAQVTDVINTLGPEMFDDFEKARLVPDLYKVEGGAATSPMSHRRRDSDQSSTGLEPETPPALSRRSTTQSSRALPRNDSFSNIGHVGIFSTRPPSRARSRSRSSSSGGGFGSGGFPLSGFTTLDSSGGFDEATRKIREAMKHRRHKTDQERTDGDEEDDDSEEEGYDEARKKNATWIDTSNEEWLCSVIGVRRGQPHNPSSSTTAATPSWLPRPPAKQRMALSFKNLVSSVLGSGAAKDDKPPSASELFVKTDPKVDGEECLHDCDNCSARYPRGFKIEEEDVLYGLVAAWSTHVLVGTGKTDWVRDVEEEEGSVMQAFSKAVEPSNGKLKLSASNMPTPHDTDDYSEPTTLLLLPAFKLLRNVHPLSVPQIITEVINQAPTNTSPLTPTPLPASLPSPDPAAGIPDVSLANCPHNAVILMCSHRTRDVRCAQSAPVLRKEFERQLRPLGLYRDLHDERPGGVGIYYISHVGGHKYSANVMIYRRPNAFGLDDTTEQQNGTSNGEKNGDSVNDSGEGSVGAAQGIWLARVMPEDCENLIRYTVLRGKVVKPERQLRGGFDRGRGVMSW

SEQ ID NO: 10170 - protein, 273 aa, Datura stramonium
MEESKVSMMNCNNEGRWSLKGTTALVTGGSKGIGYAIVEELAGLGARVYTCSRNEKELDECLEIWREKGLNVEGSVCDLLSRTERDKLMQTVAHVFDGKLNILVNNAGVVIHKEAKDFTEKDYNIIMGTNFEAAYHLSQIAYPLLKASQNGNVIFLSSIAGFSALPSVSLYSASKGAINQMTKSLACEWAKDNIRVNSVAPGVILTPLVETAIKKNPHQKEEIDNFIVKTPMGRAGKPQEVSALIAFLCFPAASYITGQIIWADGGFTANGGF

SEQ ID NO: 10171 - protein, 478 aa, Myxococcus xanthus
MNRTTRTMRLFPLLAAVSLAAVGCTSSKATGPSTKTADPNAGKTEALQPISNTAKARFEDALKAFDTQKKAKAIDYPSLERKFQSALEADGNLAEADYNLGVLAERQGKLTEARNHYKTALTKKPSLRQASENLAVMEQNAGNVAGAVALYQEVLQRYPDDAQSRARLAEIFRQQGDHTKAMDLTRAALMRDPQSTTALKVMIRSYLDRKQLAMAKLVALRGVKLDAADPELHHAVGLILLQEGDVDDARLSFKKALEVREDYVPSHVELAQLALAAENYPTAEQHLRRILQADGKNAAAHLDLGVAYKGMGQFDKAMQEYDEAEKLDPELAAVNLNRAIILHKVKDAPERASELYRKYIAMAGGEVALPAEAPVFALLREVEVVVNAKREAKFAEEQAKQMEELQKQQQAQMQAAEKAAGTANPPATTATPASGTGPAPQVTPASGNTPPAPAPVNGNSDQKNAGSAEPGEPEDDLL

SEQ ID NO: 10172 - protein, 260 aa, Datura stramonium
MAGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 10173 - protein, 260 aa, Hyoscyamus niger
MAGRWNLEGCTALVTGGSRGIGYGIVEELANLGASVYTCSRNQKELDECLTQWRSKGFNVEASVCDLSSRSEREEFMKTVSNHFHGKLNILVNNAGIVIYKEAKDYTMEDYSHIMSINFEAAYHLSVLAHPFLKASERGNVVFISSISGASALPYEAVYGATKGAMDQLTRCLAFEWAKDNIRVNGVGPGVIATSMVEMTIQDPEQKENLDKLIDRCALRRMGEPKELAAVVAFLCFPAASYVTGQIIYVDGGFMANGGF

SEQ ID NO: 10174 - protein, 151 aa, Dunaliella tertiolecta
WNVMGMMNNCHFRVLLHPFKDQRGEIGVRFQHPAPVEVGELGNIGWREEDNLRQQALEAAGITTKEGPLPPIKELAAVPKAAAAAPKPPPGSAKEFTMEEVAEHTSPESAWFVHEGKVYDATPFLEDHPGGPDSILIATGADATEDFNAIH

SEQ ID NO: 10175 - protein, 268 aa, Datura stramonium
MAGREIGGGDRRWSLRGMTALVTGGTRGIGYAIVEELANFGAEVYTCSRSQNDLDECLEKWRRKGFKVSGPVCDVSSISQRQTLMESVTSSFNGKLNILINNAGTTIPKEATNFTAEDYSIIMGTNFEASYNLCQLAHPLLKASGNASIVFNSSAAGVIAVPLSSIYAASKGAINQVTKSLACEWAKDSIRVNAVAPWIINTPIIEAACQVPSQKKNIESLIGRAPMKRAGEPSEVSSLVTYLCLPTASYITGQIICVDGGYTVNGFI

SEQ ID NO: 10176 - protein, 605 aa, Zea mays
LRVDGRQLDEVRPLYCESNTYPLLHGSALFSRGDTQVLCTVTLGAPGDAQRLDSIVGPPTKRFMLHYSFPPFSIDEVAKRGGLNRREVGHGTLAEKALLAVLPPESDFPYTVRVNAEVMASDGSTSMASVCGGSMALMDAGIPVREHVAGVSVGLVSQVDPATGDISNYRILTDILGLEDHLGDMDFKIAGTRKGITAIQLDIKPAGIPLDIICESLEPARKARNQILDRMDPEFPAPPARTPASSPRLATLSFSNESLRKLLFHRKKLEQETGARVSISDGTVTIVAKTQEIMDKAIEKVEFLVGREIEVGRTYKGIVSSIKEYGAFVEFNGGQQGLLHISELSHQPVTKVSDVVTLGQSLSLRCIGQDMRGNIKLSLKATLPQPRIKKDLKNKDPLPSEVTGWAAVENMSSVDVDAQLSSTEHENGTTEEAAAFSTPSVIIRSAADCDAQDDANGSKKRAKVAKSSPRPNKPASECHDVRKATAKKATGATTKKTKKVKIEESVSNGLETSGSDVPEQSADNTSDQNQSPTKFQSGAMKLGDVVTAKVYQIRAYGLVLELSDGVRGMHKFEANGLKEFEVGQELVVKCSSFNAKGIPLFSLLD

SEQ ID NO: 10177 - protein, 469 aa, Arabidopsis thaliana
MSEEVPQQFPSSKRQLHPSLSSMKPPLVAPGEYHRFDAAETRGGGAVADQVVSDAIVIKSTLKRKTDLVNQIVEVNELNTGVLQTPVSGKGGKAKKTSRSAKSNKSGTLASGSNAGSPGNNFAQAGTCRYDSSLGLLTKKFINLIKQAEDGILDLNKAADTLEVQKRRIYDITNVLEGIGLIEKTLKNRIQWKGLDVSKPGETIESIANLQDEVQNLAAEEARLDDQIRESQERLTSLSEDENNKRLLFVTENDIKNLPCFQNKTLIAVKAPHGTTLEVPDPDEAGGYQRRYRIILRSTMGPIDVYLVSQFEESFEDIPQADEPSNVPDEPSNVPDVPSNLPSTSGLPENHDVSMPMKEESTERNMETQEVDDTQRVYSDIESHDFVDGIMKIVPPDLDMGVDYWFRSEVGEVSITDMWPDESGPDWNQMITFDQDHAGPSDNKILEQPQTPSSPTPEESTATRSPTGS

SEQ ID NO: 10178 - protein, 463 aa, Pseudomonas fluorescens
MSSTQSSNGLEQGLKPRHVTMLSIAGVIGAGLFVGSGHAIAAAGPAVLLAYAAAGALVVLVMRMLGEMAVASPDTGSFSTYADRAIGHWAGFTIGWLYWWFWVLVIPLEANAAATILHAWFPGVDIWAFALIITMLLTVTNLFSVKNYGEFEFWFALLKVVAIIGFIILGVAAIFGFLPNSQVSGVSHIFDTQGFLPNGMGAVLGAILTTMFSFMGTEIVTIAAAESKNPGKQISKATNSVIWRIGLFYLVSIFIVVALVPWNDPVLASVGSYQTVLERMGIPNAKMIVDIVVLVAVTSCLNSALYTSSRMLFSLGKRGDAPVMSTRTNKSGTPYWAVMLSTGAAFLCTFANYVAPAAVFEFLLASSGAIALLVYLVIAISQLRMRKQRMARGEKIVFSMWLFPGLTYAVIAFIVAALTIMLFQDAHRVEILATGLLSLVVVATGLLVARRRKMENRGAAVLN

SEQ ID NO: 10179 - protein, 687 aa, Alteromonadales bacterium
MSNQFEVTHGLVEPLGSSLHLNGVNFSLYAPKATQAYVCLFDKSGHSEILKVAMNINEGGIWSIHIAPLNTGALYGFRVEGEYNPDNGLLFNEHKLLIDPYGKDLFGEFTWSERHYGQMPIGTKSTVNNAIDIPKSKVSSIDLYEHKKPNHRWSKTVIYECHVKGTTCRYPKIPKTLQGKFLGLSHPHFIDHLKSFGVTAIELLPVHAFISEQFLTGKGLQNYWGYNTLNFFTPHKDYLVNDDINEFKQMVKELHAADIEVILDVVYNHTAEAGNDGPILSLRGLDNLAYYRTVEAQPSVYINDTGCGNTINIDHPKTLQLVLDSLRYWVEVMGVDGFRFDLATILGRSKAGFSSAHTFLQTIAQDPVLNKVKLISEPWDIGPGGYQLGAFPPPWREWNDQYRDVIRRFWKGDEGIIANVAKRLHGSFDIFEHSHRGPLNSINFITSHDGFTLADLVSYEHKHNEANGENNRDGHSANYSFNCGAEGFSTDEKIAALRLQQQKNFLLTLILSKGVPMIAAGSEMAHSQGGNNNAYCQNNRTSWLAWKDSQLNHSLTRFIDDALKIRRAHSAFKHSVFLDDIDERFTVKWFTETGDTMTDSHWHENSRQFLMYSLLDKQNKHALLIVFNANKKSVSCQLPPSPINASWQMVLSSVNNASLTTHQDVPVEISAQSSWVFSANLEDVANG

SEQ ID NO: 10180 - protein, 433 aa, Alteromonadales bacterium
MPNYANRYISSLTRETYALILAGGRGSRLHELTDWRAKPAVYFGGKHRIIDFPLSNCINSGVRRVGIATQYKSHSLIRHVNRAWGHFKKELGESVEILPASQRHGDEWYCGTADAVFQNMDIIRHELPKYVMILSGDHVYRMDYGALLAEHVQKGADMTVCCIEVPVEEAADTFGVMTVDEESRVCRFDEKPAMPSSVPGKPGTCLASMGNYIFNTEFLFEQLKKDAENEGSGRDFGHDIIPAIIEEHNVFAFPFRDPQQEGQPYWRDVGTLDSFWEANMELVMPEPQLDLYDPAWPIWTYQEQLPPAKFIFDDDDRRGMALDSTVSGGCIISGSAVRKSLLFSNVHVRSFCEIEQSVILPGAIINRGCKIKRAIIDRSCEIPAGLEIGFDRKTDEENGFRVSKKGIVLVTRDMLSELAKKLERQTQENKKLA

SEQ ID NO: 10181 - protein, 197 aa, Mesorhizobium ciceri
FAEFPELEQLPLWGFDGSSTQQAEGHSSDCVLKPVAVYPDPPRTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLLQRLTEKYGIDIEYHCKPLGDTDWN

SEQ ID NO: 10182 - protein, 135 aa, Erwinia carotovora
MSEALKILNNIRTLRAQARECTLDTLEEMLEKLEVVVNERREEDSQVQAEVEERARKLQQYRDMLIADGIDPNELLQSLGSVKVAGKSKRAARPAKYQYIDENGEAKTWTGQGRTPAVIKKAIEEQGKSLDDFLL

SEQ ID NO: 10183 - protein, 187 aa, Zea mays
FCKTWNEVPDQTLRVQHLKKFYFHFQDYVDLIIWKVQFLDRHHLFVKFGSVDGGVSRSTDQNLAFFAVYNMETTDIVSLHQNSSEELYALFEQFYDHFHANPQASSHGKFISSHSNDIHALDQLRVIKNKASSSSQFVKKMMTSLPYTCQSQSPSPYFDLSLFRYDEKVCSVTFKISAMSSACAQLG

SEQ ID NO: 10184 - protein, 545 aa, Unknown
  Azoarcus sp. EbN1
MTEPFTPPHRLSAWSTLENHAARLRTMRIAELFEHDAARFATLSFGHRGLLLDLSKQSIDAPALAALVDLAGQARLPDGIEALFAGEHLNFTEDRAVLHMALRGACAAPLEDAATLAQSQQRMRAFTVALRSGTMTGATGKPIRLVVNLGIGGSDLGPRMAAQALVPTGLRATPEVRFVANIDRRELDEALADADPASTLFVVSSKSFATAETLANAQAARAWLQAGLGAGCDPALHFTAVSNATDAAAAFGIPAERVFPLPEWVGGRYSVWSTIGLPLMIAIGASEFDAFLAGARAMDEHFRTAPPGENLPVLMGLAGLWNTDFLGIESLALLPYAHGLRSFAAWLQQLEMESNGKRCLRDGSGSVIHTSPIVWGGVGTVGQHAFHQLFYQGTRRVALDFIVPVAAADDVSQRSLVENAFAQSAALMSGRDLDTALASLRAKGLAESEAAVLAPHLVCPGNQPSTTVLLPALDAFSLGQLMALYEHKVFVQGWIWGINSFDQYGVELGKEMARSLSAGSGENHDASTAGLMAAAEAMRRTPDRS

SEQ ID NO: 10185 - protein, 251 aa, Acetabularia acetabulum
MSFAVQSVLVGATAKTALVKGNKRVSVQAAVEWYGPDRAKWLGPYSDGAVPSYLTGEFPGDYGWDTAGLSADPETFKKYRETELIHARWAMLGALGCVTPEILAKYGGTSFGESVWFRAGAQIFKDGGLDYLGSPALIHAQSIGAIVISQVILMGLIEGYRVNGGPAGEGLDPLYPGESFDPLGLADDPDTFAELKIKEIKNGRLAMFSMFGFYVQAIVTGKGPVENWAEHIADPFTANAFSYATKFTPTA

SEQ ID NO: 10186 - protein, 356 aa, Unknown
  Acidovorax sp. JS42
MRGFPTMQGTFPIDRNTAMNLQKFPRHPLTFGPTPIQPLKRLSQHLGGKVELYAKREDCNSGLAFGGNKTRKLEYLIPEAIAGGYDTLVSIGGIQSNQTRQVAAVAAHLGLKCVLVQENWVNYSDAVYDRVGNIEMSRILGADVRLDAAGFDIGIRPSWEQAMADVKRAGGKPFPIPAGCSEHPYGGLGFVGFAEEVRQQEKELGFRFDYIVVCSVTGSTQAGMVVGFAADGRARRVIGIDASATPEKTHAQILRIAQSTADLVELGQDITAEDVVLDTRYGGPEYGLPNEGTLEAIRLCARQEGMLTDPVYEGKSMHGMIERVRNGEFPAGSKVLYAHLGGVPALNAYSFLFRNG

SEQ ID NO: 10187 - protein, 582 aa, Novosphingobium aromaticivorans
MTTERSGAEILVESLVAKGVEFVFGYPGGAVLPIYDALFGDERLRHILVRHEAGAAHAAEGYARATGKPGVVLVTSGPGATNAVTGIADAFMDSIPMVVITGQVPTALIGSDAFQEADTIGITRHCTKHNYLVKDPSQLAATIDEAFRIATEGRPGPVVIDIPKDVQIATAAWSSAAPQQRNRYAPQTEGGAKEIAEAIELIAKAKAPVFYTGGGVINAGPEAARLLRELQSLTGAPVTSTLMGLGAFPADHPAWLGMLGMHGTYEANMTMNRADLVVCIGARFDDRVTGRLDAFSPNSKKIHIDIDRASINKTVQVDLPVIGDCGKVLAQLIEAWLERGYQKQDLTEWNARIDGWRARQSLAFPRRGKEIMPQLAIERLYELTRHKEPIISTEVGQHQMWAAQHFHFMKPNKWLTSGGLGTMGYGLPAAIGAQAGFPDALVIDIAGDASIQMNIQELGTATQYRLPVKVFVLNNEWMGMVRQWQELTYESRYSNSYSDSLPDFVKLAEAYGWKGIRITDESELDAGIQAMIDHDGPVFVDCLVAKEANCFPMIPSGAAHTDMILYGDEVAGTMDDEAKALV

SEQ ID NO: 10188 - protein, 470 aa, Zea mays
  misc_feature (389)..(389): Xaa can be any naturally occurring amino acid
MPNGGGKRWLLLLPLSRWVLLLGSLQLPADGGSGHVVTRMRGFNGPLPFYLETGYVEVDEQQGVQLFYYFVRSERDPYEDPLLLWLSGGPGCSGISGLAYEIGPLKFDARGQGEFPTLLYRPETWTKVSNIIFEDSPVGTGFSYAKSEEGLETGDTKQVKQLVIFLRKWLQDHPRIVMNPLYIAGDSYSGLIIPTLALEIDRSIELGEKIFSGLKGYIAGNPLTGGQFDTDSQIPYFHAMGLVSDELYKNARENCGGKYSAPLNAVCAEAVQAINNCTRDINKQYILDPACPDDDLLSPKTVAETDGTSRLMLESADFLLGSKCAEALYILSYAWGNDDTVQESLGIRKGTIGAWKRYSHALPYNYDIQSVVDYHSRLATKGYRALIYXSGDHDAVVPHVGTQAWIRYLNLTIVDDWRPWYVGGQVAGFTRSYASGLTFATVKGAGHVAPLYKTLECQKMFITWISGNPL

SEQ ID NO: 10189 - protein, 382 aa, Unknown
  Mycobacterium sp. JLS
MRDHQVVVIGAGPSGVAAALSLRDRGLRPVLIDRADHVGSSWKARYDRLKLNTGRRTSHMPNRPYPDGTGVFPTRDQVVAHLDRHAHEDGIELLLETTVTRIDRHPAGWCLSTSTGDLTARQVVVATGYEHSPRIPEWPGMRSYPGEVSHSAQYRNPRPYTGRRVLVVGAGSSAMEIVHDVATGGAESAWLAVRTVPHIMIRSLPGGFPSDYLATPLFDAPTWLADAVSRVGQRIDVGDLAEYGLPTPSEGVFARGKRLGRAPVIVDREVVRAIRARVFEVVPTVARFDGATVELVDGRRLRPDAVICATGYTRGLDAMVGHLGVLDDKGLPRSCGVAAAAPGLRFVGFLSRPGLISYVAKQSQHVARHIADELDRTPTLIR

SEQ ID NO: 10190 - protein, 419 aa, Thermus thermophilus
MPLKAYRPPEDPGLWDTYLEWLERALKVAGVHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPRELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSAYEATGSLPRLDLAPEEVFGLEAEVLVLAAREGALDGDRARQVQAQAVVEVANFGLTPEAEAYLLGKGALVVPDLLSGGGGLLASYLEWVQDLNMFFWSPEEVRERFETRVARVVDAVCRRAERDGLDLRMGALALALERLDEATRLRGVYP

SEQ ID NO: 10191 - protein, 378 aa, Providencia sp.
ETVTGVINGKVKGGFTVELNGIRAFLPGSLVDVRPVRDTTHLEGKELEFKVIKLDQKRNNVVVSRRAVIESESSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPEGTKLTGRVTNLTDYGCFVEIEEGVEGLVHVSEMDWTNKNIHPSKVVNVGDVVEVMVLDIDEERRRISLGLKQCKSNPWQQFAETHNKGDRVEGKIKSITDFGIFIGLEGGIDGLVHLSDISWNVAGEEAVREYKKGDEIAAVVLQVDAERERISLGVKQLAEDPFNNYLAATKKGAIVTGKVTAVDAKGATVELTLGVEGYLRASEA

SEQ ID NO: 10192 - protein, 411 aa, Spinacia oleracea
MASLAQQLAGGLRCPPLSNSNLSKPFSPKHTLKPRFSPIVSAVAVSNAQTRERQKLKQLFEDAYERCRNAPMEGVSFTIDDFHTALDKYDFNSEMGSRVKGTVFCTDANGALVDITAKSSAYLPLAEACIYRIKNVEEAGIIPGVREEFVIIGENEADDSLILSLRQIQYELAWERCRQLQAEDVVVKGKIVGANKGGVVALVEGLRGFVPFSQISSKSSAEELLEKEIPLKFVEVDEEQSRLVMSNRKAMADSQAQLGIGSVVTGTVQSLKPYGAFIDIGGINGLLHVSQISHDRVSDIATVLQPGDTLKVMILSHDRERGRVSLSTKKLEPTPGDMIRNPKLVFEKAEEMAQTFRQRIAQAEAMARADMLRFQPESGLTLSSDGILGPLTSDLPAEGLDLSVVPPAVES

SEQ ID NO: 10193 - protein, 568 aa, Clarkia gracilis
MASPALISETEAWKDLKAHLEGIKRTHLRELMGDTERCQSMMVEFDNIFLDYSRQQASPDTINKLYNLADAAHLKQKIDRMYNGDHINITENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDTINAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 10194 - protein, 454 aa, Oryza sativa
MAAAALICRQRQPPLVELPLCPHAAARCFFVASLCSAPACRINGDYISGFCQKTHNHKFVKEKVGRQAQAQGPPAAVAAEEAPTARKECYGVFCTTYDLRADEKTKSWKSLVNVAVSGAAGMISNHLLFKLASGEVFGPDQPIALKLLGSERSIQALEGVAMELEDSLYPLLREVSIGIDPYVVFEDAEWALLIGAKPRGPGMERSALLDINGQIFAEQGKALNSVASRNVKVIVVGNPCNTNALICLKNAPNIPAKNFHALTRLDENRAKCQLALKAGVFYDKVSNMTIWGNHSTTQVPDFLNAKINGRPVKEVIKDTKWLEDEFTKTVQKRGGVLIQKWGRSSAASTAVSIVDAIRSLVNPTPEGDWFSTGVYTTGNPYGIAEDIVFSMPCRSKGDGDYELVKDVAMDDFLWERIKKSEAELLAEKRCVAHLTGEGNAFCDLPGDTMLPGEM

SEQ ID NO: 10195 - protein, 434 aa, Pyrococcus horikoshii
MIEKVYCQEVKPELDGKKVRLAGWVYTNMRVGKKIFLWIRDSTGIVQAVVAKNVVGEETFEKAKKLGRESSVIVEGIVKADERAPGGAEVHVEKLEVIQAVSEFPIPENPEQASPELLLDYRHLHIRTPKASAIMKVKETLIMAAREWLLKDGWHEVFPPILVTGAVEGGATLFKLKYFDKYAYLSQSAQLYLEAAIFGLEKVWSLTPSFRAEKSRTRRHLTEFWHLELEAAWMDLWDIMKVEEELVSYMVQRTLELRKKEIEMFRDDLTTLKNTEPPFPRISYDEAIDILQSKGVNVEWGDDLGADEERVLTEEFDRPFFVYGYPKHIKAFYMKEDPNDPRKVLASDMLAPEGYGEIIGGSQREDDYDKLLNRILEEGMDPKDYEWYLDLRRYGSVPHSGFGLGVERLVAWVLKLDHIRWAALFPRTPARLYP

SEQ ID NO: 10196 - protein, 820 aa, Zea mays
  misc_feature (334)..(334): Xaa can be any naturally occurring amino acid
SKTRLVTHSTRTHYLIGQSQTNWAPSPPLPLPMAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINXCSLGCSMQWKLENVGVALLSVVYMRMSVCEKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 10197 - protein, 331 aa, Caulobacter crescentus
MTFEKVGVIGAGAWGTALAQVAARAGLAVTLQAREPEIVAAINDTHENAVFLPGIALEPGIKAVADLADLADCDLILAVAPAQHLRAALTAFAPHRKAGAPVVLCSKGVEQGSLKLMTDVAAEALPGAPIAVLSGPSFAGEVARNLPAAVTLACEDEALGRAIAEAIAIPTFRPYTANDLIGAEAGGAVKNVLAIACGIVEGKGLGRNAHATVITRGFAELTRLAVALGARPETVAGLCGLGDLVLTCSSPQSRNMSVGLALGQGLTLEQALAGKVSVAEGVASAPAVRALARKVGVEAPICEAVAAILAGEVAVDAAIAGLLSRPLKPEA

SEQ ID NO: 10198 - protein, 104 aa, Bacillus halodurans
MAIVNVTDQTFAQETSEGLVLADFWAPWCGPCKMIAPVLEELDGEMGDKVKIAKLDVDENQETASKFNVMSIPTLIVFKDGQVVDQVTGFQPKDALAELLNKHL

SEQ ID NO: 10199 - protein, 328 aa, Unknown
  Synechococcus sp. WH 5701
MASIFADSSLSIGRTPLVKLNRVVGDSRATVLAKIEGRNPAYSVKCRIGAAMIWQAEKDGRLGPGKELIEPTSGNTGIALAFVAASRGIPLTLTMPESMSLERRKLLTAYGAKLVLTEGKLGMTGAVGRAHEIAASDPERYVLLQQFANPANPQIHHDTTGPEIWNDTDGQVDVLVAGVGTGGTITGVSRYFKTTRGQKLLSVAVEPVNSPVIAQARAGEPPQPGPHKIQGIGAGFVPENLDLDLVDRVEAVSDQEAVAMARRLMREEGILAGISCGAATVAALRLAAEEEFAGKTIVVVLPDSGERYLSSVLFEGVFDAAGLAPVER

SEQ ID NO: 10200 - protein, 91 aa, Glycine max
  misc_feature (65)..(65): Xaa can be any naturally occurring amino acid
KPHGTCARVAIGQVLLSVRCKDSNQHHAQEALRRAKFKFARRQKIIASRTCGFTKLSRSDYLKFXVENRCVRDGANAMLHGCHAPFGYREP

SEQ ID NO: 10201 - protein, 958 aa, Ashbya gossypii
MTMEVPLINGTNSVVVTAYSREQYAQCMQFYSAMLRLETLTKGENETVLTNKAVSVRVKYEEDKSRDQEARERREALAAAATTHDWRGEASTVVFSTVDVAKVRQTLGLCQAYPSELAPLEVYTLDPQGNVVGFTQTKNAISTFTNVPSVVGPRHARDSMTVSSAGSSTDLRSFGLDTTAHYPSLPKKSVAGDRKAIAVMTSGGDAPGMNANVRAIVRSVIFKGCRAFTVMEGYEGLVRGGPEYIKECKWEDVRGWSTEGGTNIGTARCMAFRERSGRLLGAQHLIEAGVDALIVCGGDGSLTGADLFRSEWPSLIQELLETGKITQAQYDRYRHLNICGTVGSIDNDMSTTDATIGAYSSLDRICQAIDYLEATAKSHSRAFVVEVMGRNCGWLALMAGIATSADYILIPEKPASSREWQDQMCDIVSTHRSRGKRTTIVIVAEGAIAADLTPITPKNVHQVLVDRLGLDTRITTLGHVQRGGSAVAFDRILATLQGVEAVNAVLESTPDTPSPLIVLNENKIMRKPLMESVALTKSVADAIQAKDFKKAMGLRDPEFVEHLNNFMAINSADHDEPKLRGEKRLNIAIVNIGAPAGGINSAVYSMANYCLSQGHKPFAIYNGWTGLARHESVRTLNWKDMLGWQSRGGSELGTNRTVPEDADIGMIAYYFQKYKFDGLVIVGGFEAFVSLHQLERARENYPAFRIPMVLIPATLSNNVPGTEYSLGSDTALNALMEYCDVVKQSAASTRARVFVVDVQGGNSGYLATHAALAVGAQVSYVPEEGISLEQLSQDIETLRESFEKAHGKGKHGKLILKSTNASKVFTTAVLADVITAEAKGDFDAKSAVPGHVQQGGLPSPIDRTRGTRLAVRAIGFIEAKQDVIREARENEEAFDCADKAVSHTAAVLGITGSQLKFTSIRQLYDLETEFSKRMPKVIHWEPTRAIADHLEGRKRVTV

SEQ ID NO: 10202 - protein, 197 aa, Pseudomonas fluorescens
MAERKASVERDTLETQIKASINLDGTGKARFNIGVPFLEHMLDQIARHGLIDLDIECKGDLHIDDHHTVEDVGITLGQAFAQAIGDKKGIRRYGHAYVPLDEALSRVVIDFSGRPGLQMHVPYTRATVGGFDVDLFQEFFQGFVNHALVSLHIDNLRGTNTHHQIETVFKAFGRALRMAVELDERMAGQMPSTKGVL

SEQ ID NO: 10203 - protein, 510 aa, Streptococcus pyogenes
MALSPDIKEQLAQYLTLLEADLVLQVSLGDNEQSQKVKDFVEEIAAMSERISIENITLDRQPSFKVAKKGHGSGVVFAGLPLGHELTSFILALLQVSGRAPKVDQDVIDRIKAIDRPLHFETYVSLTCHNCPDVVQALNIMSVLNDKISHTMVEGGMFQDEVKAKGIMSVPTVFLDGEEFTSGRATIEQLLEQIAGPLSEEAFADKGLYDVLVIGGGPAGNSAAIYAARKGLKTGLLAETFGGQVMETVGIENMIGTLYTEGPKLMAEVEAHTKSYDVDIIKAQLATSIEKKENIEVTLANGAVLQAKTAILALGAKWRNINVPGEDEFRNKGVTYCPHCDGPLFEGKDVAVIGGGNSGLEAALDLAGLAKHVYVLEFLPELKADKVLQDRAAKTNNMTIIKNVATKDIVGEDHVTGLNYTERDSGEDKHLDLEGVFVQIGLVPNTAWLKDSGVNLTDRGEIIVDKHGSTNIPGIFAAGDCTDSAYKQIIISMGSGATAAIGAFDYLIRQ

SEQ ID NO: 10204 - protein, 731 aa, Carboxydothermus hydrogenoformans
MTTGRQILEKEIMIAGRPLKLTAGKVATQASGSVLVSYGDTVVLVTATGSKEPREGIDFFPLTVDYEERFYAVGKIPGGFIKREGRPSEKAILSARLIDRPIRPLFPKGFKNDVHIVATVLSVNQDNPPEIAAMNGASAALTLSHLPFLGPIGAVVVGLVEDELVINPTIEQAEKSRLHLVVAGTRDAVMMVEAGAQEVPEEIMIEAITRGHEEVKKIVAFIEEFREEALKLGLAKEKMEVVVEEKAELKEAVTAEAYPLLKEAIEKIIAEKFNKQERDEYLENLKKELTTKFLETYPEEELTIKGILDSIQKEIVRQKILKEGIRIDGRKTDEVRPIWCEVGLLPRTHGSGLFTRGQTQVLSIVTLGAVGDVQILDDLGIEESKRFMHHYNFPPYSVGEVRPMRGPGRREIGHGALAERALEPVIPPEEVFPYTIRIVSEVLESNGSTSMGSVCGSTLALMDAGVPIKAPVAGVAMGLIKEGDEVAILTDIQGIEDALGDMDFKVAGTKDGITALQMDIKIAGVTRDILTKALAQAREGRMHILGKMLEVISEPRKELSPYAPRIIFTTVDPEKIRDIIGPGGKIIKKIIDETGVKIDIEDDGRIFIAAVDKEAGEKALNIIENLTKEIEVGKVYLGKVTRIADFGAFVEVVPGVLGLPGKEGLVHISQLAHSRVKRVEDVVKEGDQILVKAIGYDNQGRLKLSRKDAIPAEEVREKKNPPIHKPRREGK

SEQ ID NO: 10205 - protein, 239 aa, Thermus thermophilus
MERKALVTGGSRGIGRAIAEALVARGYRVAIASRNPEEAAQSLGAVPLPTDLEKDDPKGLVKRALEALGGLHVLVHAAAVNVRKPALELSYEEWRRVLYLHLDVAFLLAQAAAPHMAEAGWGRVLFIGSVTTFTAGGPVPIPAYTTAKTALLGLTRALAKEWARLGIRVNLLCPGYVETEFTLPLRQNPELYEPITARIPMGRWARPEEIARVAAVLCGDEAEYLTGQAVAVDGGFLAY

SEQ ID NO: 10206 - protein, 530 aa, Chlamydophila abortus
MDRKGFLDSPSTKILQDLAVAPVDLTTPGIISQERVERFSLSIGGFTLSYATERVDEGVVSALTDLASERGLVSSMQAMQSGEVVNYIDNFPSESRPALHTATRAWVKEIPLTGNAEDIALRSKIEAQRLKDFLHQYRDAFTTIVQIGIGGSELGPKALHRALKGCCPSDKKVYFVSNIDPDNAAEVLQEIDCSKTLVVTVSKSGTTLETAVNEEFIADHFLKQGLHFRDHFIAVTCEGSPMDDRSKYLEVFHIWDSIGGRYSSTSMVGGVVLGFAYGFDVFFQLLEGAAAMDLAALAPQMSENLPMLAAMLGIWNRNFLGYPTSVIVPYSAGLEYFPAHLQQCGMESNGKSIAQTGEIIGFATSPILWGEVGTNSQHSFFQCLHQGSDVIPIEFIGFLDNQRGRDIVISGSTSSQKLFANMVAQSIALAKGRENTNPNKSFRGNRPSSLLVAERLTPYTMGALLAFYEHKIVFQGFCWGINSFDQEGVTLGKDLANQVLGIMQGQAKEGACLEAEALLKLFNSTQKKKS

SEQ ID NO: 10207 - protein, 350 aa, Xanthomonas axonopodis
MDVAVPTLPLHCTFDAADWQRLAQHWHAVALSSEVSEAPFKATLLDEPLVLYRLGSELVAARDVCPHRGVPLSMGTADGGGVVCAYHGLRFGAGGRCNHIPASPSQNIPAKMRLHTYAVAERYGLIWVCLAKPAGVSDADIQIPPMPGWDEDGFQQIVCPAFDIGGSAARQLEGFIDVAHFAFVRTATFAQPDKREVPAYTTTETPTGFNADYLSTVANYSVDMPLPDVDPNFQWLRHFEVHLPFTATLTIHFPVPGKRLVIMNAASPVSKHTTRLLVPIARNFDTHLPVEDVHAFNLRVFEEDRAMVEAQRPEYLPLDPLLEVHIPADRSSIAYRRGLRSQGYSDFFLR

SEQ ID NO: 10208 - protein, 195 aa, Zea mays
  misc_feature (96)..(96): Xaa can be any naturally occurring amino acid
MVPGVGLVHAPFSVRFPTSFFKQACELAPIFTELVDCVSLDGESLQAALSRTKQVHEFTARLLDIHDKMMLINNKEVVGNAVMLGEIINYVQSLQXQVEFMSMKLATVNPQVDLNSLPNVLPKDVHQSCGPPHFSLETSDASLSYLSQPHHGSPLGCMDNQSCMHPLDTTFCLAINPQYHFLNGVSDASSQLQLI

SEQ ID NO: 10209 - protein, 436 aa, Haloarcula marismortui
MHVDIGAALASAADPGVERATLDDLDEQVAVAHERIEQGRNKGEFGYASLNLLEATDAETIHDAVAPVADAESVITVGIGGSALGAKTITEALAEDPGSHVVLDNVDPEHVRRTLDGLSLADTAINVVSRSGTTAETLANFLVVREAYEDRGVDWTERIVVTTGESGPLRALADQHDLPTLPVPEGVPGRFSALSAVGLVPPAILGIDIEGLLAGGQQAADDLAPSLYDSPAYAYGAMAYALEEAGATVNAVMPYAERLESFGEWFAQLWAESLGKDGRGQTPARALGATDQHSQLQLYRAGHRDKVVTFVRPRERADVSIPDPDHEDLSYLAGTDLGGLIDAEYEATVASLPAADRPALEVEIDRLDAESVGELLYAMEAACVLVGELADVETFTQPAVEWGKNATRALIRGEATDETAVIDERERLRIGETESL

SEQ ID NO: 10210 - protein, 196 aa, Mesorhizobium ciceri
FAEFPELEQLPLWGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLLQRLTEKYGIDIEYHCKPLGDTDW

SEQ ID NO: 10211 - protein, 418 aa, Unknown
  Candidatus Desulfococcus oleovorans Hxd3
MTIEATIVDIAKAAKKAALAMATCPTDKKNQALLALADRLHKDAALIQAENKKDLEAAKATGLSSAMIDRLTVSDAVIASMADGLREVAALPDPVGAKSATWRRPNGLEVARMRIPLGVIGIIYESRPNVTVDAAGLCLKAGNTVILRGGSEALHSNRALAATISASLAESGLPETAVQVVPVADREAVTHLLAQEEYIDLIIPRGGEGLIRFVVQHSSIPVLKHYKGVCHVYVDQDADMEMARAICFNAKVQRPGVCNAMETLLVHRDAAQRFLPDMARQFADAGVALRGCAATRALLPGIETAEEADWYAEYLDLILAVKVVDSMDAAISHIATYGSSHTEVIVTNSYDRAMRFLAAVDSSVVLVNASTRFNDGGQLGLGAEIGISTSKLHAFGPMGLEELTTTKFIVLGNGQIRE

SEQ ID NO: 10212 - protein, 535 aa, Daucus carota
MGDMEGSPGSSMHGVTGREPSLAFSVASRIDTSAEFHVPVDSEHKAKVFKFKSFSPPHGLQFQLTWISFPTCFVSTFAARPLVVIIRDNLNPTKMDVGNAGVASVTGSILSRGAMGAICDMLGPRYGCAFLIMLSAPKVLCMSFVSSAGGYVAVRFMIGFSLATFVSCRYWMSTSMHSDIIGLVNGTAAGWGNMTGGATQLIMPLLYDIIREAGATPFTAWRIALFIPGWLHVISGILVLTLGQDLPDGNAQNEASLRKKGRVHKDKFSKILRYAATNYRTWILVLLYGYSMGVELTTDNVIAEYFFDRFDLKLHTPGIIAATFGMANLLARPFGGWSSDVAAKHFGMRGRHWNSWDLQTLGGVFCLLLVRATTSPIDALAITWMIIFSIGAQAATGVTFGIIPFISRRYLGIISQMTGANGNFGSGQTQPLEFDSTKYNTGLGLTYMGMMIIACTLPPMLVWFWQDGSMFLPPSKDPIKGTEPEHYFGSEYTEDEKVKGMHQNSIKFAENSRTEFGKKRVGSAPTPPNVYPNRV

SEQ ID NO: 10213 - protein, 415 aa, Burkholderia xenovorans
MSVQHLVIVGAGQAGFQTAASLRQAGFTGGIALVGDEPGVPYQRPPLSKAYLLGKIGTAALRFRPDEWFDQQHVERLQATVAAIDRDARCVVLADGARLAYDHLVLATGARNRVPSVDGIELDGVFGIRTLADADALSSRVDAARNVVVIGAGFIGLEFAAVAAAKGLSVRVIELGQRPMARALSEPMSALFGDAHRSWGVVFDFGQTVTRFIGKDGKVTAVETGSGEWVPADLVVYGIGVLPNTEIAAAAGLCVDNGICVDEQLVTSDPAISAIGDAVSFPCAWSATRVRLESVQNAVDQARAVAARLVGTPAPYNALPWFWSDQGDLKLQIAGLSGGHDEAVVIGSIEQRQFSVLCFREDRLIAVESCNRATDHMAARKLLARGTALRVADARTPGFDFRAYESSSRDVPVCQ

SEQ ID NO: 10214 - protein, 411 aa, Magnaporthe grisea
MSTSGKKATATALAQKYAPQIANKTVLVTGVSPNSLGATFVTAIAVASPALLILAGRNAAKVEETTKAIQAAAPHVPVRFLNLDLADRESVRKAAGEVLSWQDVPGIDVLVNNACLIGSEYKLIDGFEAHFVVNYLHPFLFTNLLLPKVIAVKGRVVNVASDCHRWHHIRFSDLNFDVSVSWKISQRSAARLQPRQNGKIYNMWQAYGQSKTANMLFSLALARRLGGRGIVTNSVHPGIIQTNAASHLDPAEILRLIAAEEVERQCGLANQAFLSYKTVDEGTATHVYAAFEPGLKDHNGAYLLDSHVADPVEDPVAPWGTSEADAEKLWRLITRRIPPSKSHIKGGKSKHLEANYYDQRLAPLLKRPDRSHPPDDFCREIPPAAPKQDKKIVYINTHNAKRINLVNLNEA

SEQ ID NO: 10215 - protein, 299 aa, Spinacia oleracea
CQYWMSCMFSPKVVGLANGQSGGWGNLGGGVANLVMPFLYSFILNKTPADTPFTAWRVAFFIPAGLQMFSAYAVMLFGQDLPDGNFLQMQKSGAMHKDKASKIVYHAVTNYRSWITAIGYGFCFGVELAVTNVVVYYFYDRFNLNLNLAGIVGALFGMVNIFSRSSGGWFSDFMAKKFGMRGRLWGWWTVQTLSGVMCIVMGRMNTLSSTTAVMMIFSFLVQAAEGLTFGVVPFVSRRSLGVVSGLSGAGGNAGAVICQVIFFRGSQFKIEHGLTYMGIVIIACTLSLGTINFPQWGCM

SEQ ID NO: 10216 - protein, 201 aa, Arachis hypogaea
MAAMATTTALSSNLIKASAFHGTPVATSRVTPIKSQQQQSQTISMSMATPPYDLQSFKFQPIKESIVAREMTRRYMTDMITYADTDVIVVGAGSAGLSCAYELSKNPSIRVAIIEQSVSPGGGAWLGGQLFSAMVVRKPAHRFLDELEVAYDEQEDYVVIKHAALFTSTIMSKLLARPNVNLFNAVAAEDLIVKGRRVGGI

SEQ ID NO: 10217 - protein, 291 aa, Treponema denticola
MAVVTMKNLLESGVHFGHQVKRWDPRMKKYIFSERNGIHIIDLQKTIVAIREAYEAVRKTTSEGKSVLFVGTKKQAQQTIQKEAERCGMFYINNRWLGGMLTNFSTIKKSLARLKKIEKMEVDGTFDNLTKKEIASLQKEKSKLEKNLGGIKEMKDLPGILFIIDTRKEEIAIREARSLGIPIIAVVDTNCNPEGIDYPIPGNDDAIRAISLFTGVIANAVIEADNEHGLKIIENLQEDEESGDSGVDPYQDREEEITDYSNYTPKDEASGDDEDEEDNSLVNDEDLYDDK

SEQ ID NO: 10218 - protein, 191 aa, Spinacia oleracea
ISDAHYKACLYAGINISGTNGEVMPGQWEFQVGPSVGIEAGDHVWCARYLLERITEQIGVVMTLDPKPIEGDWNGAGCHTNYSTKTMREEGGFEVIKKAILNLSLRHKDHISAYGEGNERRLTGKHETADINTFSWGVANRGCSIRVGRDTEKEGKGYLEDRRPASNMDPYVVTGLLAETTILWEPTLEAE

SEQ ID NO: 10219 - protein, 383 aa, Onion yellows
MQVFYYLFLFYDLIIVVEKNSTLFLIIKKTFVIFAVTFFMTVFAILITRKKLYFMKITIIGSGAWGSTLAQVLTDNNNQVLLYDINLSYVEKINQGKHPIFNAPLVNVKAVSCLKQALDYSDLIVLSVPMKFMRHLLKQIALMLTTPKSFVNVSKGIEPLTFLRVSEIVKQVIPAPLLANFASLMGPSHAEEVILRKLTLLTAASSNPAFALEIQKLFSCPNYLKVYTSSDLVGNEICSAFKNVLAFINGILVAKNFGINSQAALMSRGILEMSVLVTFYQGNPQTVLGLPGLGDLIVTAFSKYSRNFNAGAKIAAGITYQQIIDSSLQTIEGFQTLNAFYQLQLKHNLDLPIIQASYQLIFESKPFETVFATLMQRPFKSEF

SEQ ID NO: 10220 - protein, 483 aa, Zea mays
  misc_feature (191)..(191): Xaa can be any naturally occurring amino acid
  misc_feature (212)..(212): Xaa can be any naturally occurring amino acid
NSKRRYVEVEEDAGVELFYYFVQAESGAAAAADDTPFLFWLTGGDRCSVFSGLAYEIGPIRFVLEPYNGTLPRLRYNHNSWSKVSHILFVDSPVGAGFSFSRDPKGYDVGDISASLQLQEFLIKWFSDHPEYLANPFYIGGDSYVGKIVPFLRQMISEGIELGRRPFPNLKVCPSYISLRNGRCYIDVGYXLVYIQEINCSRSLRLMICRFXICHDQGYLVGNPITGESIDFTSRVPYAHGVGIISDQLYETILGHCQGEDYTSPANALCAQALDTFNNLINEVQNAQILLDTCVYASPAPNVLSRPVDGGRRILRAAGMGGGATLNHPPARPRFGCITYGYYLSYFWANDERTRTALGIKKGTVDEWVRCHDADLPYTIDLKSAIKYHRNLTSRGYRALVYSGDHDLLVPHLGTQAWVRSLNFPVVDDWRAWHLGGQAAGFTINYSNNMTFATIKGGGHTAPEYEPERCFAMFSRWILDRPL

SEQ ID NO: 10221 - protein, 524 aa, Streptococcus pneumoniae
MKFNELNLSADLLAEIEKAGFVEASPIQEQTIPLALEGKDVIGQAQTGTGKTAAFGLPTLEKIRTEEATIQALVIAPTRELAVQSQEELFRFGRSKGVKVRSVYGGSSIEKQIKALKSGAHIVVGTPGRLLDLIKRKALKLQDIETLILDEADEMLNMGFLEDIEAIISRVPENRQTLLFSATMPDAIKRIGVQFMKAPEHVKIAAKELTTELVDQYYIRVKEQEKFDTMTRLMDVAQPELAIVFGRTKRRVDELTRGLKIRGFRAEGIHGDLDQNKRLRVLRDFKNGNLDVLVATDVAARGLDISGVTHVYNYDIPQDPESYVHRIGRTGRAGKSGQSITFVAPNEMGYLQIIENLTKKRMKGLKPASVEESFQSKKQVALKKIERDFADETIRANFEKFGKDARKLAAEFTPEELAMYILSLTVQDPDSLPEVEIAREKPLPFKPSGNGFGGKAKGGRGGRRGDDRRERDRRGNGRRDEFKKGSRGNDRFDKEKRYRKDNKKPRNTLSEKQTGFVIRNKGDK

SEQ ID NO: 10222 - protein, 566 aa, Acidobacteria bacterium
MCLATPAVFAQQSAADFYKRGVQAYGRGDDASALSSFQQASKLDPNNPEYQNAVGQALFKQGRPAEAIPYFRHALKLRPDLAVIHAYLGQALLADHQADAAISEYRIAVKMAPNEVEANRGLGRSLSTKGDLDGAIAVYRSALETNSQSAPLHDDLGSLLAQKKDFVAAQQQFEQALKLDRQYEPAHFHLGVALLSQDKDPEAMLSLQEAVRLAPNDVAAHFFLGRVLETLGDNANALQNYKDAAQRSSEFPGLQERLGLTAQRVGEMPTAISAFQKAIAQSPQNPDLHNDLGLAFMQAGDGEGAIREFNQALNLKPEDVGYLGNLGAAYLQLSEFDNAVDNFRKALQIAPANASLHHDLALTLKLKDDLAGAAAELREAIRLDPKLYDAHYTLGVTLWQQGEFPAAVEELEAALAQKPDYAEAYYTLGTVYKQMNKPRESAEALRSALKIQPDFAGAHTTLAAVLRQLGDTAGASEEARIGAELAKKKTGMQAAVFATNSGIRLLNAGDLDGAVSQFRRATESAPDYAMGHFQLATALSRQGKRDEADAEFSKAATLDPHLKTQK

SEQ ID NO: 10223 - protein, 389 aa, Anaplasma marginale
MHHNFYRRAIEWFLLARSVLLMPQTPIYPPPHVFYVDKWHAKLYHAGRVFLKVEVQVTILGAGAFGTALSIALCNTGKKVRIWSRNGQVVESLRTHGENSVYLPGFKVPREVLVHSDMGLATDGPAAILMCVPAQELRSLCNTITAASALEAGVPLLVCSKGIENSSLKFPSEVVAEMFPQNPVFVLSGPALARELASGLPCAMVLAGDEITTAETLASQLSGPALAIVHSGDLMGVQVGAVMKNIIAIASGIIAGMGLGHNASAIVMVQGMSEIKAVCEAKVGVAATETLIGLSCLGDLVLTCTAPGSRNMSFGSSVGKAGRAGASGQQKPMLVEGVESVTAMVNMGKALNLELPICSAIARMLHGQLGVRQAAAEILSAPVKSRLNV

SEQ ID NO: 10224 - protein, 432 aa, Rhizobium leguminosarum
MTNASTESFFNRSLADVDPDIFGAIGKELGRQRHEIELIASENIVSRAVLEAQGSIMTNKYAEGYPGKRYYGGCQFVDIAEELAIERAKKLFGVNFANVQPNSGSQMNQAVFLALLQPGDTFMGLDLNSGGHLTHGSPVNMSGKWFNVVSYGVREGDNLLDMDEVARKAEETKPKLIIAGGTAYSRIWDWKRFREIADSVGAYLMVDMAHIAGLVAGGVHPSPFPHCHVATTTTHKSLRGPRGGVILTNDEDLAKKFNSAVFPGLQGGPLMHIIAAKAVAFGEALQPEFKDYAAQVVKNAKALAETLISGGLDVVSGGTDNHLMLVDLRKKNATGKRAEAALGRAYVTCNKNGIPFDPEKPFVTSGVRLGAPAGTTRGFKEAEFREIGNLIVEVLDGLKVANSDEGNAAVEAAVRGKVVSLTDRFPMYGYMG

SEQ ID NO: 10225 - protein, 388 aa, Coccidioides immitis
MHLKENLLRGIYAYGFESPSAIQSRAIVQICKGRDTIAQAQSGTGKTATFAISILQVIDTALRETQALVLSPTRELATQIQNVIMAVGDYMNVQCHACIGGTNVGDDIRKLDHGQHVVSGTPGRVADMIRRRHLRTRHIKMLVLDEADDLLARGFREQIYDVYRYLPPATQVVVLSATLPYDVLSMTTKFMTDPVRILVKRDELTLEGLKQYFIAVEKEEWKFDTLCDLYDTLTITQAVIFCNTRRKVDWLTDKMREANFTVSSMHGEMPQKERDSIMQDFRQGNSRVLISTDVWARGIDVQQVSLVINYDLPSNRENYIHRIGRSGRFGRKGVAINFVTSEDVRILRDIELYYSTQIDEMPMNGKPIPTPTTRTLLILTSIVADLLG

SEQ ID NO: 10226 - protein, 522 aa, Candida glabrata
MKSTRSLLLQRRYLSLTHRRVLSSSVRQPLLRRGFHSTSSVKQEFKDPYETLGVKKSSSQSDIKKAYYKLAKKYHPDINKEAGAEKKFHDLQNAYEILSDESKRKQYDQFGAAAFSGGAGAGPGGPGAGPGGFNPFGNGFGFDFSGGQAGGAGGFGGINFEDLFGTAFGGGPFGSSSNSGRRSSSMFREYKGDTIEVIQNLDFKDAVFGKKNVSIKFRALDPCGTCNGSGLKSGASKTTCPSCHGSGTTVHVRAGFQMMSTCQTCGGEGTTVNASDFCKSCHGEGVNVNTQKTITVDLPHGLQDGDVVRIPGQGSYPDIAVDKEMAKSVKLSRGDILVRIRVNKDPHFSIKNKYDIWYTKEIPITTAALGGTVSIPTIEGTKIRIKVPAGTAPEQVISIPNMGVPKSSPYRNSAVQARGDMKIQYKVVIRKPQSKAEQCLWEALADVTNDTNAKRTMESFASSVEKSVEDKLSDNDNKTSNNSKETYNTTEDNSMNPDAPSTLGRLEKFISNTFKKIKGDKN

SEQ ID NO: 10227 - protein, 351 aa, Nicotiana tabacum
MALCIKNGFLAAALVLVGLIMCSIQIIGAQSIGVCYGKAANNLPSDQDVINLYNANGIRKLRIYYPDKNIFKALNGSNIEIILGVPNQDLEALANSSIANGWVQDNIRSHFPYVKFKYISIGNKVSPTNNDQYSEFLLQAMKNVYNALAAAGLQDMIKVSTVTYSGVLANTYPPERSIFREEFKSFINPIIQFLARNNLPLLANVYPYFVHVSNTADVSLSYALFTQQGTNSAGYQNLFDAILDSMYFAVEKAGGPNVEIIVSESGWPSEGSSAATIENAQTYYRNLINHVKSGAGTPKKPGKTIETYLFAMFDENDKIGEITEKHFGLFSPDQRAKYQLNFNYLPIYILR

SEQ ID NO: 10228 - protein, 77 aa, Oryza sativa
MQVSIGQYYEAANREMSQRNQEAIEMSRQQRNIRKKRQKWFWGSVGLAVTLGTAAIAWSYLPAAQPQASQDSNTNSD

SEQ ID NO: 10229 - protein, 676 aa, Coccidioides immitis
MAANFTEDNIQELRYRLEDAARKCSERCLYQSAKWAAEMLDSLIPADEFSDGADTEPDSPMDISPSVAENPFLTNADPEEAALEAREAHKYILAKAYFDTREYDRCAAIFLPPSMSSIPLAPRPPTSTSKIRPNISSHKGKEKSISLGAHQARAASKNPFPKLSQKSLFLALYAKYLAGEKRKDEETEMVLGPADGGMTVNRELHALAQGLEGWFSDRRERGLESRGQGWLEYLYGVILLKAKNDEDAKKWLIRSVHLYPFHWGAWQELNDLLTNTDDLKRVAEKLPQNIMTLIFHLYSSQELYQATEATYHTLTELESIFPSSAFLKTQRALLYYHSKDFEEASHLFSELLISHPHRLDGLDHYSNILYVMGARPQLAFVAQMATATDKFRPETCCVVGNYYSLKSEHEKAVMYFRRALTLDRNFLSAWTLMGHEYIEMKNTHAAIESYRRAVDVNRKDYRAWYGLGQAYEVLDMAFYALFYYQRAAALRPYDPKMWQAVGSCYAKMGRADQSIRALKRALAAGSYYDSSRNTPFGRRILDPETLHQIATLYERLGDEEEAAAYMELTLQQETGQMGGNNDDEDNDDDAEDDAMSASRRTSAFTHHNDDMDEEPTGTGVTAATSKARLWLARWALRHNDLDRAEQLANELCQDGVEIEEAKALMRDVRARREGRG

SEQ ID NO: 10230 - protein, 385 aa, Silicibacter pomeroyi
MGSMQIRHYSNRFLLSTLRKNMPIQGGIVKTFVDAPVSGAVDDQALLRRALERFARIRLGHLPSPLEPLDRLSEALGGPRIWVKRDDCTGLSSGGNKTRKLEFLMASACEAGADTIITQGAIQSNHARQTAAAAARLGLHCHLLLEDRTGAADLAYTLNGNVLLDRLHGATISRRAGGSDMAAEMERLAATLRGKGKRPYVIPGGGSNRVGALGYVNCALELSEQALSMGLDIDALIHATGSCGTQAGLVAGLAGLSWNTHLLGIGVRAPQERQEAMVFDLACETMDYLGMGIPIVRSGVRANCDHVGPGYGLPTEAMCEAVRMLARLEGLLLDPVYTGKAMAGLIDLTRQGYFDGMANIVFLHTGGSAALFGYPEIFGLPGYQP

SEQ ID NO: 10231 - protein, 1048 aa, Unknown
  delta proteobacterium MLMS-1
MLNKKITFKFLFIPPVLAAAVATLVIILLSLYLLKNEYAKQQTEVMQYYQQQEGTSTAALRRHQAGWEEFDRRYRQVMLSSIAGLALMLVVSFLVMRRFINPMYKIVAALRDLAYASGKPPDLEGIEQLQNDRILELTELANAVLSFHDALNDRHRVEKELRKLSLAVDQSPSGIIITDLDGNIEYANQAFLACTGYQKMEVLGRNPRFLKDESTLESHYQEMWNTIAAGHTWKGEFYNRRKDGREYIEANTVAPIKQADGSITNYLAIKDDVTDKMKMEVELLRHRDHLAELVEEQTVSIKAIVETAADGIITIDQQGKILSFNPAAEVIFGYPAGEMIGSKINRLMPEPHRSQHDQYLRNYLQSGTAKVINTQVEVMALRRDGSTFPLSLAVSAMEIGGEKRFTAIFRDISSQKEAEKALVTARQAAEAANRTKSDFLANMSHEIRTPMNAVIGLSHICLQTELTPKQRDYLEKVHNSAHSLLGILNDILDLSKIESGRLEVEEIPFNLEEVLDRLHTLVDARIAAKPLQFKLDLPPEVPVNLRGDPLRLGQVLTNLVGNAVKFTEEGEIAVTVAVVAEAEQEITLSFTVRDNGIGMTQEQCARLFQPFSQADTSTTRKYGGTGLGLSISRQLVELMGGEIRVESEAGKGSSFIFTLPLQKDAAISPALAAPLQTAQAAAKLSGAHLLLAEDDEVNRLVARELLARVGIRLTTVEDGAQALERLAREEFDGVLLDLQMPVMDGITAAGKIREQAKFKDLPIIAMTANAMTEDLKRCFQAGMNDHIGKPIEPDKMVATLGKWITPARPQPMPPESLSPLDKTGEPAASTPESPPPATTPGVEPPQLPGVRVKESIQRLNGNVELYYRILTRFRDDQAQVIDRLRQLLSHGDRQQAERLAHTLKGLAGTIGAITIETSAAKLEQQLAQGLDDDRETLLHSLDEELSPLFKAIDLALEQRRRQPAQAPGPTAPGPDREALAHLVNQARAQLEDFDSGAEETVTRIKAALGADKQTEESLARLNACLGRYDYEDGLQELQKLAQLIGLPW

SEQ ID NO: 10232 - protein, 155 aa, Oryza sativa
MALDHGRDPCPWVILNDFGGAFAMGAIGGTIWHGIKGFRNSPYGERRIGAITAVKMRAPVLGGNFGVWGGLFSTFDCAIKGVRKKEDPWNAIGAGFMTGGSLAIRGGYKAARNGAIGCAILLAVIEGVGIGLSKMMAGSTKLEVPQPPPNEQALA

SEQ ID NO: 10233 - protein, 99 aa, Leptolyngbya boryana
MATYQVRLINKKRNLDITLPVDEDTTVLEAAEEAELDLPFSCHSGACSSCVGKVVEGEINQDDQTFLDEEQVAKGFVLLCVTYPRTDCTIRTHQEAYLV

SEQ ID NO: 10234 - protein, 465 aa, Oryza sativa
MAVRLCCCCFLLFVTIAAAGGSLTRTNVATLPGFDGALPSRLETGYVTVDEENGAELFYYFIESEGDPSTDPVLLWITGGDRCSVLSALFFEIGPLKLVIEPYNGSLPRLHYHPYSWTKVASILFVDSPVGAGFSFSRDPKGYDVGDVSASMQLIKLLREWFTEYPHYLSNPFYVGGDSYAGKIVPFIVQKISEDIEAGVRPTFNLKGYLVGNPSTGERIDLESRVPYSHGVGIISDQLYEMIMEHCEGEDYDNPSNVICQQALARFDSLLHEGSRAQILNPNCIYVSPKPNHETIDRKILKGEHGGLKHPPPQPSIKCGVYANYLSYFWANNNFTRRTLGIKKGTINEWVRCHEHDLPYNIDIRSSIKYHRNVTLKGYRALVYCGDHDAVVPFLGTQAWVRSLNYPIVDDWRAWHIDGQSAGFTIAYGNNLTFATVKGAGHTAPEFEPERCFAMFKRWISSIPL

SEQ ID NO: 10235 - protein, 132 aa, Triticum aestivum
TCVIPIEFYDKRLEIRGSEASIFAHPHGRGLRALSRAQIDSVLDLARCTIVSELSNKDFDSYVLSESSLFIYSQKIVIKTCGTTKLLITIPKMRDLAEQLHMLFATVKYYGGMFIFPDAQSDTHRSFSEEVD

SEQ ID NO: 10236 - protein, 323 aa, Thermotoga maritima
  misc_feature (182)..(182): Xaa can be any naturally occurring amino acid
MEMRFFVLGAGSWGTVFAQMLHENGEEVILWARRKEIVDLINVSHTSPYVEESKITVRATNDLEEIKKEDILVIAIPVQYIREHLLRLPVKPSMVLNLSKGIEIKTGKRVSEIVEEILGCPYAVLSGPSHAEEVAKKLPTAVTLAGENSKELQKRISTEYFRVYTCEDVVGVEIAGALKNVXRIAAGILDGFGGWDNAKAALETRGIYEIARFGMFFGADQKTFMGLAGIGDLMVTCNSRYSRNRRFGELIARGFNPLKLLESSNQVVEGAFTVKAVMKIAKENKIDMPISEEVYRVVYEGKPPLQSMRDLMRRSLKDEFWAS

SEQ ID NO: 10237 - protein, 315 aa, Clostridium litorale
MENVYDIAIIGSGPAGLAAALYGARAKMKTLLLEGMKVGGQIVITHEVANYPGSVPEATGPSLIGRMEEQVEEFGAERVMDNIVDVDFTDKIKVLKGAKGEYKAKAVIVATGASPKLAGCPGEKELTGKGVSYCATCDADFFEDMEVFVIGGGDTAVEEAMFLTKFARKVTIVHRRAELRAAKSIQEKAFKNEKLNFMWNTVIEEIKGDGIVESAVFKNRETGEVTEFVAPEEDGTFGIFVFIGYDPKSALVEGKLELDETGYIPTDDNMKTNVEGVFAAGDIRVKSLRQVVTATADGAIAAVQAEKYIEELFAE

SEQ ID NO: 10238 - protein, 455 aa, Oryza sativa
MSLRLRLAFRLLFCYCLLLAAAHPSSRRLLPLLVVSAAERTNVASLPGLDGALPSRFETGYVTVDEENGGELFYYFIESEGDPGADPVLLWINGGNRCSVLSALFFEIGPVKLAIEPYDGGVPRLRYNPYTWTKVASVLFVDSPVGAGFSFSRDPRGYDVGDVSSTLQLTKFVNKWFSQHREFLSNPLYVGGESYAGKLVPFLLQKISEDVEAGVKPVLNLKGYLVGNPGTGESIDYESKVPYAHGVGIISDQLYETILEHCGREDYANPKNATCAQALNRFSELMGEVSEAHILYKKCIYVSPKPDDGTIGRKILEEIVVGNHRPPRPPMDCSGTVDEWVRCHDDGLPYSQDIESSIKYHQNLTSRGYRVLVYSGDHDSVVPFLGTQAWVRSLNYPIVDDWRAWHIDGQSAGFTITYANDLTFATVKGGGHTAPEYQPERCLAMFGRWISEKSL

SEQ ID NO: 10239 - protein, 487 aa, Kluyveromyces lactis
MSSTESYPKFPAISTKKLQDGLQSEIFRWALTNGLAMYPPNFKPELATVAPITLFPTPLPNEAFQKAIDVQTIYNALYASISQNKNDWLAKETEKLAKSDPEFTGRLWTLYKRAKEYGIVQDLALGVFRSDYLINSDNNQIKQVEFNTVSVSFGGLSTKVGELHDYLNKSGNYSDNGEVFYDQDIPISPSAELLATGLATAINKYQPADKNKRPIVAFIVQNGERNVFDQSILALNLLSKYDTKSVRLTIHEIHEATRLDPETKRLYHKTTGQEIGLVYFRSGYAPSDFVSEQDWENRLTLEISYAIKAPNLLTQLSGTKKIQQLLTDPKILKEFLSDTESLDHLLPTFVKIYPLDSSVLGEIGKKLALTEPENYVLKPQREGGGNNIYKEDIPGFLESVDEDEWSAYILMELITPKSTEENFVIRGQELFNVPILSELGIFGTILFDHNNIYSNEYAGWLLRSKFSSSNEGGVAAGFGCVDSVVLY

SEQ ID NO: 10240 - protein, 255 aa, Streptococcus pyogenes
MAVISMKQLLEAGVHFGHQTRRWNPKMAKYIFTERNGIHVIDLQQTVKLADQAYEFVRDAAANDAVILFVGTKKQAAEAVADEATRAGQYFINHRWLGGTLTNWGTIQKRIARLKEIKRMEEEGTFDVLPKKEVALLNKQRARLEKFLGGIEDMPRIPDVMYVVDPHKEQIAVKEAKKLGIPVVAMVDTNADPDDIDIIIPANDDAIRAVKLITAKLADAIIEGRQGEDADVAFEADTQADSIEEIVEVVEGDNA

SEQ ID NO: 10241 - protein, 315 aa, Eubacterium acidaminophilum
MENVYDLAIIGSGPAGLAAALYGARAKMKTIMIEGQKVGGQIVITHEVANYPGSVREATGPSLIERMEEQANEFGAEKVMDKIVDVDLDGKIKVIKGEKAEYKAKSVILATGAAPRLAGCPGEQELTGKGVSYCATCDADFFEDMEVFVVGGGDTAVEEAMYLAKFARKVTIVHRRDELRAAKSIQEKAFKNPKLDFMWNSAIEEIKGDGIVESAVFKNLVTGETTEYFANEEDGTFGIFVFIGYIPKSDVFKGKITLDDAGYIITDDNMKTNVEGVFAAGDIRVKSLRQVVTACADGAIAATQAEKYVEANFEE

SEQ ID NO: 10242 - protein, 155 aa, Brassica napus
  misc_feature (138)..(138): Xaa can be any naturally occurring amino acid
MENTDELVSIELPAPASWKKLFYPKRAGTPRKTEIVFMAPTGEEISSRKQLEQYLKAHPGNPVISEFDWTTGETPRRSSRISQKVKATTPTPEREPHMKKRRSSLTKKDLVEAAEKENKEGEKKEGGAEVAEAEKENXEGKKTEADNKEGEVVTA

SEQ ID NO: 10243 - protein, 376 aa, Unknown
  Acidovorax sp. JS42
MSKRDFYEVLGVPKNASDDEIKKAYRKLAMKYHPDRNQGDAAKPAEEKFKEAKEAYEILSDAQKRAAYDQYGHAGVDPNMRGGMGGAEGFGGFAEAFGDIFGDMFGGARGRGGRQVYRGNDLSYAMEITLEEAAKGKEAQIRIPSWESCETCHGSGAKPGTSAKTCGTCQGSGTVQMRQGFFSVQQTCPHCRGTGKIIPEPCTACHGQGRVKKQKTLEVKIPAGIDDGMRIRSTGNGEPGTNGGPPGDLYIEIRIKKHDIFERDGDDLHCQVPVSFITAALGGEIEVPTLQGKAAIDIPEGTQAGKQFRLRGKGIKGVRSSYPGDLYCHIIVETPVKLTEHQRKLLKELDESLKKGGAKHSPSTESWTDRLKSFFS

SEQ ID NO: 10244 - protein, 445 aa, Unknown
  Candidatus Desulfococcus oleovorans Hxd3
MDHTKILHLLKAKTPLSGVRVCGWVKTCRNSKALSFLEINDGSCLQSLQVVAPAQLDNFEQVQKLLSGSAVAVSGDLVASPAKGQQWELAARRVDIVSRTDETYPLQKKRHSDEFLRTIAHLRPRTNKYSALFRLRSEAGFAIHSYLRDQGFFHVHTPILTGSDCEGAGELFSVTSRSPLFDRDVFLTVSGQLAAEMFALCLGRVYTFGPVFRAEHSNTARHAAEFWMVEPEIAFCNLEQNMDFAQAFVKQTVTHMVENCGPDMDLFSRFVDPELPATLDNILASEFERISYKTAIDLLVRSGTAFSFTPEYGNDLQTEHERYLTETVFKKPVFVYDYPRAIKPFYMRVNDDGRTVAAMDLLVPRIGELIGGSQREERLDVLEQQMDNSGLSKDHYGWYLDSRRYGSVAHSGFGMGFERFLMLVSGVSNIRDVIPFPRTPGTIEF

SEQ ID NO: 10245 - protein, 243 aa, Chromobacterium violaceum
MSTNVTMRQMLEAGVHFGHQTRFWNPKMAKYIFGSRNKIHIINLEKTLPLFVEAQEYVRRLAANKGTVMFVGTKRQAREIVREEAARCGMPFVDHRWLGGMLTNYKTVKQSIKRLEEKRAILEGAGETGYNKKELLDLQREVEKLERSLGGIKDMKGLPDAIFVIDTGYQKGTIVEAKKLGIPVIGVVDTNNSPDGIDYVVPGNDDSSRAIRLYARGIADAVLEGRAHSLQEIVAAAETAQAE

SEQ ID NO: 10246 - protein, 579 aa, Phaseolus vulgaris
MCGILAVLGCSDSSQAKRVRVLELSRRLKHRGPDWSGLHQYGDCYLAHQRLAIVDPASGDQPLFNEDKTIAVTVNGEIYNHEELRKQLPNHTFRTGSDCDVIAHLYEEHGENFVDMLDGIFSFVLLDTRDNSFIVARDAIGVTSLYIGWGLDGSVWISSELKGLNGDCEHFESFPPGHLYSSKEREFRRWYNPPWFSEAIPSAPYDPLALRHAFEKAVIKRLMTDVPFGVLLSGGLDSSLVAAVTARYLEGTNAAKHWGTKLHSFCVGLEGAPDLKAAREVADYIGTVHHEFHYSVQDGIDAIEDVIYHIETYDVTTIRASIPMFLMSRKIKSLGVKWDICGEGSDEIYGGYLYFHKAPNKEEFHQETCRKIKALHKYDCLRANKSTFAWGLEARVPFLDKEFIEVAMNVNPEYKMIKKEEGRIEKWVLRRAFDDGEHPYLPKHILYRQKEQFSDGVGYGWIDGLKGHAEKHVTDRMMLNAANIFPFNTPTTKEAYYYRMIFERFFPQDSARLSVPGGPSVACSTAKAVEWDAAWSNNLDPSGRAALGVHASAYGNQVKAVEPEKTIPKMEVSPLGVAI

SEQ ID NO: 10247 - protein, 467 aa, Solanum lycopersicum
MAIFLIIFVVFFGFCILSTPLFRWIDIVYNKKNLPPGTMGWPIFGETREFLNQGPNFMKNQRARYGNFFKSHILGCPTVVSMDAGLNVYILNNEAKGLIPGYPQSMLDILGKCNIAAVHGATHKYIRGALLSLINPTMIKDHILPKIDKFMRSHLSGWDNCNVIDIQQMTKEMAFFSSLDQIGGFATSSSIAQEFRAGFLNIALGTISLPINFPTTNYYRGLQGRKTIVKLLRKIIEDRRGSKKIQQDMLGLMMNEEAKNRYTLSDEELIDQIITIMYSGFETVSTTSMMAVKYLHDHPKALEEIRKEHFAIREKKSLEDPIDYNDFKAMRFTRAVIYETLRLATIVNGVLRKTTQDMELNGYMIPKGWRIYVYTRELNYDPLIYPDPYTFNPWRWLENNLDHQSSFLMFGGGTRLCPGKELGVAEISTFLHYFVTRYRWEEVGGNKLMKFPRVEALNGLWIKVSAY

SEQ ID NO: 10248 - protein, 311 aa, Magnaporthe grisea
MTDITSYKFNHTMLKVKDPKASIAFYKHLGMDLLSEYKVPDHKLELYFVAGDSAISASHGTHQSDREGVLELSYSYGIENTSGGDQEPRGLRPVCLSVDNVKTTCKALCDAGYRINCNSEEETAHVLDPDGFWIKLIAHRSLGRIDDTATADCKGSKVHHTMIGVRDKNVSRKFYEQVFGMTWKYEQHSTQAGRDRFLLGCGKPHTSGPSVDISKPDVKCEGLLELLCSEDTKNKDGMEHHNGNLEPDDPGHICISVDDVHAACERLESLGVQWQKRLMDGPFRVAFVHDPDGNLIEIIQNEMYKPVKHEA

SEQ ID NO: 10249 - protein, 102 aa, Oryza sativa
MGGKLQHLMERLHLAGKGGGGGAARDVPRGHFAVYVGEARARFVVPTAYLRQPAFVALLKSVEEEYGFDHCGGGGLTIPCSERDFSALLGRLASSPPPPSWR

SEQ ID NO: 10250 - protein, 246 aa, Crocosphaera watsonii
MTNQQTATIENTDENLSQLTDKFINGKQKDQLQLIPQLIALREEGWQVLMKFLQTSDVNEVDIVRGKVYGQLYTLKEPITEEFIKAHFPDGIIPLNSQRNLDYQPLNQLLVEQKFQDADTLTRRLLCELAGHGAVQRKWVYFTEVDQFPTTDLQTIDNLWRLHSEGKFGFSVQRKLWLSVGKDFPKLWPKIGWKNDNNWTQYPNQFTWDMSAPVGHLPLLNQLRGVRVAASLFAHPAWSEFTMNNG

SEQ ID NO: 10251 - protein, 122 aa, Oryza sativa
AAAPSRRGATLRVQAKKQTFSSFDELLEKSEKPVLVDFYATWCGPCQYMVPILQEVSEKLGDKIQVVKIDTEKYTSIANRYQIEALPTFIIFKNGKPCHRFEGALPANQLIQQIESALEVAK

SEQ ID NO: 10252 - protein, 153 aa, Lupinus luteus
GALTESQAALVKSSWEEFNANIPKHTHRFFILVLEIAPAAKDLFSFLKGTSEVPQNNPELQAHAGKVFKLVYEAAIQLEVTGVVVTDATLKNLGSVHVSKGVADAHFPVVKEAILKTIKEVVGAKWSEELNSAWTIAYDELAIVIKKEMDDAA

SEQ ID NO: 10253 - protein, 546 aa, Triticum aestivum
MGLDLGALALKYTGLAVSDHDSIVAINIFIALLCGCIVFGHLLEGNRWVNESTTALVLGLITGGVILICTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAEDRS

SEQ ID NO: 10254 - protein, 210 aa, Brassica juncea
MLCSEYESPVTLGGEYCPKLASSCPKKPAGRKKFRETRHPVYRGVRLRKSGKWVCEVREPNKKSRIWLGTFLTAEIAARAHDVAAIALRGKSACLNFADSAWRLRIPETTCPKEIQKAAAEAAVAFQAELNDTTADHGLDVEETIVEAIFTEESSEGFYMDEEFMFGMPTLWASMAEGMLLPPRPYNSDLTMTSTEMLTCPFGVMSTCNH

SEQ ID NO: 10255 - protein, 577 aa, Zea mays
KLVYGRKHFAVEKEKPSQLFGTYDFDSSPFDWGDNYKLPNLPETDLVIYEMNVRAFTADESSRLAPAIRGSYLGVIDKIPHLLELGVNAVELLPVFEFDELELKRFPNPRDHMVNTWGYSTINLFAPMSRYASAGGGPVAASKELKQMVKAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKERGKDSVLSRCKIIAEPWDCGGLYLVGRFPNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 10256 - protein, 59 aa, Unknown
  Oceanobacter sp. RED65
MSQEFTKWQCIVCGWIYDEAEGCPEEGIEPGTKWEDIPEDWLCPDCGVGKEDFEMIELA

SEQ ID NO: 10257 - protein, 293 aa, Zea mays
  misc_feature (35)..(35): Xaa can be any naturally occurring amino acid
  misc_feature (109)..(109): Xaa can be any naturally occurring amino acid
  misc_feature (266)..(266): Xaa can be any naturally occurring amino acid
MASSVAAAASTFLGTRLADPVPQNGRIVARFGFGXGKPKAAVPKKVAKTSISSDRPLWFPGAVAPDYLDGSLVGDYGFDPFGLGKPVEYLQFELDSLDQNLAKNEAGGXIIGTRFESSDVKSTPLQPYSEVFGLQRFRECELIHGRWAMLATLGALTVEWLTGVTWQDAGKVELVDGSSYLGQPLPFTISTLIWIEVLVIGYIEFQRNAELDPEKRLYPGGSYFDPLALAADPEKKERLQLAEIKHARLAMVAFLGFAVQAAATGXKGPLNNWATHLSDPLHTTIFDTFGGSS

SEQ ID NO: 10258 - protein, 339 aa, Zea mays; identical to SEQ ID NO: 555

SEQ ID NO: 10259 - protein, 684 aa, Botryotinia fuckeliana
MMEKGGDMAGPSANNSSDFVSIHTQHTCTFSRRDGANIEISSLTDVSFTGPKIIQVRKYLVRMLEDPTYESIVRWGEAGESFVVLENEKFTKQILPKHFKHSNFASFVRQLNKYDFHKVRQNNEDNTQSPYGQNAWEFKHPEFQANKKDSLDNIRRKAPAPRKVAQSNEETYPAHAQQQMDLLGNQLAATQQQLQGLSRSYQDLAQLNIMLLQQVVDAQKFIKNHEGVMHGLVGHLFSQDAQRRNGRAPGLSNGAGPNMLGRPTEDGHPSTPLLQARSLLGQLSAENFPSKELEQMSHDYHLRQDYSTPPNDPGGLVSMPPISESVTAPSAGYSMDKSELDNLVYPVGAIVGIDPIDQQHVNNIPYALPPQGLMPRDSMPPAELMPQPPRAPGPRKKGMVSIWGERKPRILLVEDDQVCARIGTKFLESFECGVDIARDGLEAVSKINLGAENHFDLILMDIIMPHLDGVSATVCIREIRANIPIIAMTSNIRTDDIEMYFRYGMNDVLPKPFTKEGMMKALEKHLAHFRKDAPSIGFSSPGPMSHPGGFVTPTQSQSHPPLGLNMGQLTATQSIVDDTASGKSPQTATSWQSPIQLPGGSPVVTSAPGSYMQPTNGMRDPSYSVTPTHPHSQSGFAPPLSGLGNQRPPHRRGISDISGASTPDGNSDQKRQRMYAPPGNYQQG

SEQ ID NO: 10260 - protein, 422 aa, Oceanicola granulosus
MFDQLPPTDISDRAVSDAIAEELDRQKSQIELIASENIVSPAVMAAQGSVLTNKYAEGYPGRRYYGGCEFVDKVEALAIDRLKQLFGAGFANVQPHSGAQANQAVFLALLAPGDRIMGMSLAHGGHLTHGSPVTMSGKWFDVVSYEVDPETHLIDMDEVRARALETRPKLILAGASAYPRRIDFAAFREIADEVGAYLMVDMAHYAGLIAAGHYPNPVPHAHVVTSTTHKTLRGPRGGVILSNDEALAKKFNSAVFPGNQGGPLMHVIAAKAVAFGEALEPSFRDYAAAVIDNARALSQVLLAGGLGIVSGGTDSHMVLVDLRPKGVTGKVAEIALERAGLTCNKNAIPNDPEKPFVTSGVRLGSSAGTTRGFGRAEFETIGRLILQVLDALADSPEGDAAVEAEVRAEVRALCDAFPIYGG

SEQ ID NO: 10261 - protein, 788 aa, Medicago truncatula
MACIPHILSPLSHSTTLANLINITNFEIHNRTSIIISPNSRPKKKKKKIFAIGNRVGVDTETAVIEIEKRQLQLSKGHPSPYGATPQEDGVNFAINSLNSLSATLCFFTLSDFKNNKVTEYITLDPLVNKTGCVWHVFLKGDFKDMLYAYKFDGKFSPQQGHYYDSSRILIDPYAKAVISRGEFGEVGPDGNCWPQMAGMVPFDNEEFDWEGDLPLKYPQKDLIIYEMHVRGFTKHESSKAEFPGTYLGVVEKLDHLKELGVNCIELMPCHEFNELEYYSYNAIQGDYRVNFWGYSTINYFSPMIRYSSAGIQNCGRDGINEMKLLIKEAHKRGIEVIMDVVFNHTAEGNEKGPIISFRGVDNSVYYMVAPKGEFYNYSGCGNTFNCNHPVVRKFIVDCLRYWVTEMHVDGFRFDLASIMTRSSSLWNGVNVFGAPIEGDFLTTGTPLSSPPLIDMISIDPILRGVKLIAEAWDAGGLYQVGTFPHWGIWSEWNGKYRDTVRQFIKGTDGFAGAFAECICGSPNLYQGGRKPWNSINLVCAHDGFTLADLVTYNNKHNLPNGEDNNDGENHNSSWNCGEEGEFVSASVKKMRKRQMRNFFLSLMVSQGVPMIFMGDEYGHTKGGNNNTYCHDNYLNYFRWDKKEESSSDFFRFCRLLTKFRQECESLGLDDFPTSERLQWHGHFPVTPDWSESSRFVAFTLMDLVKGEVYVAFNTSHLPFTITLPERPGYRWEPLVDTSKKAPYDFLTPDLPGRDIAIQQYAQFLDANMYPMLSYSSIILLRTPDVNA

SEQ ID NO: 10262 - protein, 181 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 10263 - protein, 199 aa, Medicago sativa
YSHNLEFSEEKIELTFATNYLGHFLLTKMLLEKMIDTANKTGIQGRIINISSVIHSWVKRSCFCFKDMLTGKNYNGTRAYAQSKLAMILRVKEMARQLKARNARVTINAVHPGIVKTGIIRAHKGLITDSLFFIASKLLKTISQSASTTCYVALSQKIEGVSGKFFTDCNESSCSRLANDESEAKKLWNNTNNLLHKPT

SEQ ID NO: 10264 - protein, 183 aa, Hevea brasiliensis
MASSMLSTAAVACINRASPAQASMVAPFTGLKSTSAFPTTRKTTTDITSIASNGGRVQCMQVWPPRGKKFYETLSYLPPLTREQLAKEVEYLLRKGWVPCLEFELEHGTVYREYHRSPGYYDGRYWTMWKLPMFGCTDAVQVLQELDEMIKAYPDCYGRIIGFDNVRQVQCISFLAYKPKGAE

SEQ ID NO: 10265 - protein, 952 aa, Silicibacter pomeroyi
MAFKLTDYEAYDFANRRHIGPSPREMADMLQVIGFKTLDQLIDATVPPSIRQKEALDWGPAMTERDALYHMKQVASKNKVLTSLIGQGYYGTTTPAPILRNILENPAWYTAYTPYQPEISQGRLEALLNFQTMVSDLTGLDVANASLLDEATAAAEAMAMAKRSSRSKANNAAFFVDKNCHPQTVAVIRTRAEPLGVDVQVGDPSELEAGAVFGAIFQYPGTYGHVRDYTAEIAALHEHNAIAIVAADILSLALLKSPGEMGADIAIGSTQRFGVPMGYGGPHAAYMATTDKLKRAMPGRIIGVSIDARGNKAYRLALQTREQHIRREKANSNVCTAQALLAVMASMYAVYHGPDGIKAIAQSVHRKTSRLAAGLEEHGFKVAPEVFFDTITVDVGPLQKTVIEAAVARGVNLRKVGSDRIGISLDEQTRSETIEAVWGAFGIDKKDDSVKNRAYRLPDYALRETPYLTHPIFHKNRAEAEMTRYMRRLADRDLALDRAMIPLGSCTMKLNATIEMIPVTWPEFANLHPFVPEDQAQGYLEMIDDLSEKLCQITGYDAISMQPNSGAQGEYAGLMTIRNYHAAQGQGHRNICLIPTSAHGTNPATAQMVGYQVVPVRSDDHGNIDLADFRAKAEQHSANLAACMITYPSTHGVFEETVREVCDITHEHGGQVYIDGANMNAMVGLAQPGEIGGDVSHLNLHKTFCIPHGGGGPGMGPIGVKAHLAEHLPGHPEYGTAVGPVSAAPFGSPSILPVSWAYVLLMGGAGLTQATKVAILNANYIAARLKDAYPILYTSATGRVAHECILDTRPLNDEGGVSVDDVAKRLIDSGFHAPTMSWPVAGTLMVEPTESEPKDELDRFCEAMLSIRAEAQQIIDGKIDPENNPLKHAPHTVRDLVGDWDRPYSREQACFPPGNLGVDKYWPVVNRVDNAYGDRHLVCTCPPMDAYEEAAE

SEQ ID NO: 10266 - protein, 257 aa, Silicibacter pomeroyi
MALPEFSMRQLLEAGVHFGHQTQRWNPRMSPFIYGARNGIHILDLTQTVPMLDQALKAVRDTVAKGGRVLFVGTKRQASGPIAEAAEKSAQYYMNHRWLGGTLTNWKTVSQSIQRLRMIDEKMEGGAEGLTKKERLGMERDQAKLQASLGGIREMGGVPDLLFVIDVKKEALAIAEANKLGIPVVAVVDTNCSPDGVDYIIPGNDDAARAISLYCDLAARAALDGMTAQLGAAGVDLGELEEAPAEEALAEEAAAEA

SEQ ID NO: 10267 - protein, 1274 aa, Anabaena variabilis
MFNCTTSLTQSELKSAIIRDPLIIKPETTVMDAIAQMSAVRAICDTDKLDEVHLEARSSCVLIVEAGRLLGIFTERDVVRLCSQRRCLENLAIREVMIHPVVSLHESEFTDLFFAVNLLQQYRIRHIPILDEEERVVGLLTNESLRQTSRSVDLLRLRLVSEVMTCEVICAAPDSSMLAIAQLLTENRVSSVMIVQLCECPANPQKIPVGIVTERDIVQFQALGLNLETCQVQTVMSTPIFAVRPDYSLRFVQQIMEQRLIRRLAVTGEQGELLGIVTQSSLLQALNPLEVYKLAQMLEERVVRLETEKVQLLENRTVELEQQVADRTASLKAKAGREQILSDISRQIRSSLSLQTILDTTVEQVRQLLGCDRVNIWHFEAEWESIVMAESTTSSRSLLGKRIQEICFQQRCAELYRYGRIRIVPDIYTTEMTDCHRELLIRLQTRAKILVPLLCGDELWGLLNVTESQHAREWQTEEIELLQGLSVHLAIAIQQATTHQKLQEQLIALQEGSDRLQESEQRYIALNQNLEAKVEERTAELQAREAQLQKISERLALSLKSAAIGCWDWDIGENTIFWDERMYELYGVTKTTDSRLVYDTWANGLHPDDRTNTEILVQQAVLGQAEYDTEFRVIHPDGSIHFIKAYGVVVRDAEGNPQKMIGVHFDISDRKKAEEIIRQQAEREKLLREITQRIRQSLDLQTIFDIACQDIRQVIQADRVGIFKFYPESNFNDGEFVAESVVDEFPSVIAIRVHDQCFGENYSSLYALGRSYVVDDIYNSDMTTCHTDILAQFHVRANVIMPLLCGAELWGLLCIHQCATTRHWEQSEIDFTQQLATQLAIAIQQASLVEQLQQELAERQQAELKLTQSNQQLAISNQELARATRLKDEFLANMSHELRTPLNAILGMTEGLQEGVFGMINDKQFKALETIERSSSHLLDLINDILDVAKIEAGQIKLDCTAISVAALCQSSLVFIKQQALQKRIQVEIKIPLNLPDLFVDERRIRQVLINLLNNAVKFTPETGRISLEVTQVSPDISTVQNFLQIAVIDTGIGIMQENINKLFQPFIQIDSALNRQYEGTGLGLALVKKIVELHGGRVGLTSELGVGSCFTIELPCTPSTPSSPELIRDLLTTPNSELDFANAEEAASLAPVILLAEDNEANIKTFSSYLSAKGYGILLATNGEQALELATIHQPDLILMDIQMPGIDGLEAIRQIRLDPELVNIPIVALTALAMTGDRDRCLQAGANDYLTKPVKLKQLATTIQQLLMETKK

SEQ ID NO: 10268 - protein, 381 aa, Anabaena variabilis
MNLPSILVIDDLPDNFDVIETLLSEQDYTLHYVASGQEAIASLNLFQPDLILLDVMMPGMDGIEVCQRIKAMPQWQSVPIIMVTALTAKEDLARCLKSGADDFISKPINALELRARLHSMLRIKQQYDKIQTLSNIQTSTIKVLESTLDELRGNLAAALPHELNTPLNGIVGTISILMADIENMDTGEIQELLGWVDLSARNLERLIKQLLLYLELELSTNQQQNIASESTHFSIAVIEAILQSHAPSVNRRDDLMFAIEEAEVSISARYLAIIIYELVDNALKFSRRGTTIKISSQVVAGMLNVYIHDFGRGMTEEQISKIGAFMQFERKTYEQQGIGMGLKLAKQIIESHGGLFSISSVYKKETMVHIALPIAYSRYLS

SEQ ID NO: 10269 - protein, 232 aa, Lachancea kluyveri
MTEPAQKKQKQTVQERKAFISRITNETKIQIAISLNGGYIQIKDSILPAKKDDDVASQATQSQVIDIHTGVGFLDHMIHALAKHSGWSLIVECIGDLHIDDHHTTEDCGIALGQAFKEAMGAVRGVKRFGTGFAPLDEALSRAVVDLSNRPFAVIDLGLKREMIGDLSTEMIPHFLESFAEAARITLHVDCLRGFNDHHRSESAFKALAVAIREAISSNGTNDVPSTKGVLM

SEQ ID NO: 10270 - protein, 542 aa, Streptococcus pyogenes
MTIDKKKVVYQIYPKSYKDTTGNGVGDLLGIIDKLPYLQELGIDMIWLNPFYPSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAEEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPPRYQHGQVLISNYEKVSICEKVILKPYQTLAILADN

SEQ ID NO: 10271 - protein, 222 aa, Candida albicans
MADNSDDYSYDYEYLYKIVLIGDSGVGKSNLLSRFTRDEFNLESRSTIGVEFATRTLEIDGKRVKAQIWDTAGQERYRAITSAYYRGAVGALIVYDIAKTESYESVSRWLKELKEHADANIIIELVGNKSDLDHLRAVPTEEAKNFAMENNLLFTEASALSSDNVDLSFHQLLKNIYEMISKHQLENNDSKQTNTAGGPTISLTPAPQEKKNKNNGWLLLRH

SEQ ID NO: 10272 - protein, 966 aa, Prochlorococcus marinus
MIRQFSDCEEFCDRHIGIDACAQESMLAALGFTDLEDFVASVIPNQILNQNSSSNLLSKGSNELQALEQLNEIARKNIVNRSLIGLGYFGTLMPPAIKRNILENPAWYSSYTPYQAEISQGRLEALFNFQTLISELTGLPISNASLLDEATAAAEAMSLSLLVHKASHARKFFVDQAVFPQTIEVLRTRAEPLNIVLEQIDPRNCEIDEKVFGLLIQLPGSDGRLWDPSLAIEKAHRVGALATVAIDPLAQVLLKPVGELGADIAIGSSQRFGVPMGFGGPHAAFFATKETFKRQVPGRLVGQSVDQDGQIALRLALQTREQHIRRDKATSNICTAQVLLAIIASFYAIYHGPEGLEAIAKRIACFRKRLEDVLRILGYPLEPISGFDTISVNCEEATEIHKLAALKGFNFRILPLGASIEKATGFAISLDELSNEEEINSLSEIFAKVKGEVYKTPSTCDLNIEDCLSELPLRQTPWLNQKVFHSFRSETELIRYIQLLASKDFSLVHGMIPLGSCTMKLNATAELIPVSWKEFSSIHPLAPIEQSQGYEQLIKELESWLSELTGFNGASLQPNAGSQGEYAGLLVIREWHKSRGHQNRNVCLIPTSAHGTNPASAVMSGFRVVSIICDEQGNIDLRDLVQKVEVHSSELAALMITYPSTHGVFEPKIREICELVHDHGGQVYLDGANLNAQVGLCKPGEYGADVCHLNLHKTFCIPHGGGGPGVGPIAVAKHLLPYLPGHPFRKCGGVNSIGAVSAAPFGSASILPISWMYIRMMGLNGLRKASSVAILSANYLASRLDPYYPILFRGPNGNVAHECILDLRPIKTKTGIEVDDIAKRLMDYGFHAPTVSWPVAGTLMVEPTESESLAELDRFCDAMISIRKEIEAIESGDSDLNNNVLRLSPHTLQTVTSEDWDRPYSRQQAAFPLKGQIKNKFWPAVSRIDNAFGDRNLVCSCPSMEDFAEN

SEQ ID NO: 10273 - protein, 432 aa, Aspergillus nidulans
MDTSQVRILPKLDISAGHNFTKPSKRINESQDVAEFLSSKAYVDLMTFLLQLNRSLFPTKLPDGRVLTWELNSEAVEYSAPVRQLQQLLSKLEAILDEAPPDTGPRRFGNISFRRWYEMVESRAASLLEECLSKEILQMPSSDPGAPTAEVELLAYFLGSWGSPQRLDYGTGHELSFLAFLAGIWKLHGFPENSPGVEERAIVLGVIQPYLELVRTIIKRYTLEPAGSHGVWGLDDHSFIPYIFGSAQLAPAISESDRIPEEGSLSDAPAPGGVTKANVVERERKHNLYFSAIGFIYDVKRGPFWEHSPMLYDISGIQAGWAKINKGMIKMYNAEVLSKFPVVQHFPFGSLFSWERDPNAPSPAADAHIAATTRRTDEASTSSYLYSPKYIKATSWSYGSYKGALGNISTRWTGSPWRFYVCRPYANESSVG

SEQ ID NO: 10274 - protein, 358 aa, Idiomarina loihiensis
MSQKPILFIDRDGTLVEEPVTDKQLDSLEKLVFEPNVVPALLKLQQAGYQLVMVSNQDGLGTDSFPQADFDAPHNLMMAVFESQGIRFEDVLICPHFDSDNCSCRKPALGLVKSYLKEGRVDFTNSYVIGDRETDLQLAENMGIEGLRYSRSELNWDAIVHQLLDNPRTASVTRTTRETDINIKVDLDSQTPREFNTGIGFFDHMLEQIATHAGFSLSVKVKGDLHIDDHHTIEDTALALGQALRSALGDKRGIGRFGFALPMDECRAECLIDLSGRPYLKWEADFTRDKVGELSTEMVEHFFRSLTDAMAMSLHLSTTEGNTHHQVESLFKVFGRALRQAITKTGDQQLPSSKGMLA

SEQ ID NO: 10275 - protein, 539 aa, Cryptococcus neoformans
MRLSTLALMATPALALPNYLRLSNGPSELASDLATHAISSAQAWLQGAVSSTRSSVQNGWKGVQDGLDQGLKVETVDEAGIEYLALSHPAFPLHRLRVVEPKLCDPSVKQLSGYLDISETRHLFFWFQESRENPDEDPLVLWLNGGPGCSSTTGLLFELGGCNIRDKGENTTFNEHSWNSVANVLYLDQPIGVGYSYADEGEVNNSPAAAEDVYAFLVLFISKFREYSKLDFHVAGESYAGTYIPNIASVVHKNNIALDLVPTPSVPKINLKSVMIGNGLTDPYAQFGSVPDWACNSPYAPYDDPSPECDSLRTRANRCQGLISGCYKTNSRFTCVPAALYCWSMFNELQDLGRNMYDVRKTCDKSPEKDGPLCYREMGWMETYLNKPEVKKELGAPERVTFQSCNMQINQNFLLHGDGMHYAGGLLPDLVEDDIRVLIYAGQADMLVNYIGCASVLDNLQTSYLASYLAAPFVNFTSPDGEVSGYTKSASKDGKGSGNVAFVAFHNAGHMVPHDDPEGALRMVGRWLKNEPLAVAEDE

SEQ ID NO: 10276 - protein, 326 aa, Erwinia carotovora
MKIGLVISGGDVSGINNFIFQVNRMTASDIVIFDGGINGLIDNCCKVLTRRDLVDYSLSSMPLVTSGRKTGKCRKTDYEKIVKNIQKQKLDALIMAGGDGSFQFLKKLSCYGIHCYGIGMTIDNDISGNSYTIGFSTACEQVMSEVEKLRNTGRGLQGRVFMIELLGGYCGELTLQAALKSNADIALIPESPWDIDALSQCILDKIAEQNSVIILCSEGYTHEYTPGFQGAIDTIIKKLEHKIGIRIRKTILGYGLRNGAPTGEEIIQGTLLAEEVVRCINAGLTNKIIIINNNNKAIPIDLEDSERRLVDIESHFYKLAKSHHLI

SEQ ID NO: 10277 - protein, 956 aa, Ralstonia eutropha
MDCRDVIDFGTPASESTEMVTLEIDGVSVTVPAGTSVMRAAMEAEVSVPKLCATDSLKSFGSCRLCLVEIEGRRGYPASCTTPVEAGMKVKTQSDKLSDLRRGVMELYISDHPLDCLTCPTNGNCELQDMAGEVGLREVRYNDGGPIATHTDMKKDESNPYFTYDPSKCIVCNRCVRACEETQGTFALTISGRGFDSRVSPGTSQSFMESDCVSCGACVQACPTATLTETSVIKLGQAPRSVVTTCAYCGVGCSFKAEMKGNEVVRMVPYKDGKANEGHACVKGRFAWGYATHQDRILKPMIRAKITDPWREVSWEEAINYAASEFKRIQAKHGKDSIGGIVSSRCTNEEGYLVQKLVRAAFGNNNVDTCARVCHSPTGYGLKQTLGESAGTQTFKSVEKSDVIMVIGANPTDGHPVFASRMKKRLRAGAKLIVADPRKIDLVDSPHIRADFHLQLRPGTNVALVTSMAHVIVTEGLLADEFIAERCEDRAFQQWRDFVSQPENSPEAMAEVTGVPADTLRGAARLYATGGNAAIYYGLGVTEHAQGSTTVMGIANLAMATGNVGREGVGVNPLRGQNNVQGSCDMGSFPHELPGYRHVSDSTVRALFESAWNVEISPEPGLRIPNMFEAALGGSFMGMYCQGEDIVQSDPNTQHVAEALSSMECIVVQDIFLNETAKYAHVFLPGSSFLEKDGTFTNAERRISRVRKVMPPKAGYADWEATILLANALGYPMNYKNPSEIMDEIARLTPTFHGVSYKRLDELSSIQWPCNEDAPEGTPTMHIDRFVRGKGKFIITKYVPTTEKITRAYPLILTTGRILSQYNVGAQTRRTENVHWHDEDRLELHPHDAEERGIKDGDWVGVQSRAGETVLRAIVSERMQPGVVYTTFHFPESGANVITTDNSDWATNCPEYKVTAVQVMPVAQPSEWQKQYQAFNAQQLQLLEAASTDSAQAAVG

SEQ ID NO: 10278 - protein, 420 aa, Thermus thermophilus
MGPLLVWHRGDLRLHDHPALLEALARGPVVGLVVLDPNNLKTTPRRRAWFLENVRALREAYRARGGALWVLEGLPWEKVPEAARRLKAKAVYALTSYTPYGRYRDAKVQEALPVPLHLLPAPHLLPPDLPRAYRVYTPFARRFLGVEAPLPAPEALPKGPEEGEIPREDPGLPLPEPGEEAALAGLRAFLEAKLPRYAEERDRLDGEGGSRLSPYFALGVLSPRLAAWEAERRGGEGARKWVAELLWRDFSYHLLYHFPWMAERPLDPRFQALPWQEDEALFRAWYEGRTGVPLVDAAMRELHATGFLSNRARMNAAQFAVKHLLLPWKRCEEAFRHLLLDGDRAVNLQGWQWAGGLGVDAAPYFRVFNPVLQGERHDPEGRWLKRWAPEYPSYAPKDPVVDLEEARRRYLRLARDLARG

SEQ ID NO: 10279 - protein, 349 aa, Zea diploperennis
MGGSGTAALLLALVAVSLAVEIQADAGYGYTPTPTPATPTPKPEKPPTKGPKPEKPPKEHKPPKEHGPKPEKPPKEHKPTPPTYTPSPKPTPPTYTPTPTPPTPKPTPPTYTPAPTPKPTPTPKPTPTPPTYTPSPKPPTPKPTPPTYAPSPKPPATKPPTPKPTPPTYTPSPKPPTPKPTPPTYTPSPKPTPPTYTPSPKPPTPKPTPPTYTPSPKPPATKPPTPKPTPPTYTPSPKPPTPKPTPPTYTPSPKPPATKPTPPTYTPSPKPPTPKPTPPTYTPSPKPPTPKPTPPTYTPSPKPPATKPPTPKPTPPTYTPTPKPPATKPPTYTPTPPVSHTPSPPPPYY

SEQ ID NO: 10280 - protein, 415 aa, Roseovarius nubinhibens
MTILQISSLLIVLAGVFGAINYLFLKLPSAIGILVVALVASFGMMGVDWMLPHLGISDEIRRLVTGLHFSDALLEGMLGLLLFAGALHVKISDLRAQWRAVFLMATLGVGLSTLVIGTGFSWLTGAPFLIALVFGSVVSPTDPVAVLGVLREANLSKALETKIAGESLFNDGVGYVVFLVLVGLAFPTGDAHGSGLAGAAKLFIQEALGGAALGLALGWLTFRVMRHIDDYSLEVLLTLGLAFGGYELAVYLHVSAPIMAVCAGLLIGEVGAKHGMSETTRQYVDGFWKLIDEILNAVLFLMIGFEVFAVAFETDYLLIGAASIALALFGRLAAVLVPIYILRPFRTFENGVIPIMTWGGLKGGISVALALSLPDSEWKPVILTATYLVVIFSIIVQGLTVARLANRFGREPDLV

SEQ ID NO: 10281 - protein, 529 aa, Thermoplasma acidophilum
MKVLLIKPLNPTGSGYTTKFGFLPTPLGLQVLAAQARAIGINDVRIVDMEADDLTADQMVEYVERWRPDVIGITLHATAAHAFSQDLAKRIKAIYNPLIVAGGHQATFVPGELLDNGFDIIVLGEGDEAFRDVLEHYRDNADFSDIPGIIFKSGNMKIRTEKRELIDDLDRLPIPAFDLVDKERYTFKVFGEGSVATVETARGCPYACDFCSVTPTWGNKWRNKSNDRIMEELRIVKSLGYRWVFFTDDIFVVYPNVKQRSDLFDRIIEEDLGLKFIVQMRADVTSKNPDLIRKASQAGLTIAFLGIESGSEEVLKAMHKGIMTSASVNAVKILTQNNIVVLGGMMLGAPYESFRDMMKTIKFSRVLARAGIDAIQISTYTPLPGTRIFLDALRKNEIFTLDWSRYDILTPVAKTRVNPAIIQALTAYGYYSFYAYKWLHDRLHEVRAVGFKDQIMMNAQKFIMRMMPSYIKDIFRLPSDIMKTAILYRNGIRKRIATDEHVRELIADSSSIVYKETDVKNPYFKIKTQ

SEQ ID NO: 10282 - protein, 361 aa, Brassica napus
  misc_feature (201)..(201): Xaa can be any naturally occurring amino acid
MSENMEQPLSPSLPDDVIIDIVARVPRSYYPTLSLVSKSFRKLIASPTFYKRRSFPGITQHRIYAVLRNRKTRDDFSFYILHRKLKCSNRLVIVGSRTLHHMCSRGSYVLVGSKVYGFNDLHALSIDCTSHTSQPISDIPQLMTNKVANVIDKKIYLIGGSFLPDESGSREAWKNAVAVFDTETQSWECKLVKEDMHVGLXSLWSDSMVMEGKIYLKDYSHSNFFAYEPEERKWELMDEVLSSQAWVGACVVDDVLYYHDCRGKVLKAYDPKQMCWSVVNGLEEFLAVETAHSIWSNAVSYGEKKLALFFLKIHDGKQVICCAEIALERRQGGEIWGKMESCDVVIEDGLVDMVKFVSVTV

SEQ ID NO: 10283 - protein, 336 aa, Thermobifida fusca
MTKVAVLGSGSWGTAFANVVADAGIAETVLWGRRPEIVEAINTKHENPDYLPGITLNPRLTATTDVAEAMAGADFTVIAVPAQTLRTNLAAWSEALDPGTVVVSLMKGIEVGTCLRMSEVIAEVLELPDHRIAVLSGPNLAREIAERQPATAVVACTDEQTAVRLQHLCKSPYFRPYTNTDVIGVELGGAVKNVIALAVGVAVGMGFGDNAKAALITRGLAETVRLAVALGADEHTLAGLAGLGDLVATCSSPLSRNRTFGEKLGSGMTVDEVIAETKQTAEGVKSSTSILELARAHGVEMPITEAVVAMMYHGLPPAEALLAFMSRSAKPERYGV

SEQ ID NO: 10284 - protein, 875 aa, Glycine max
NGVVRPLKPGPDIPRPKKLPQPPPPLSDSSSDEEEDTTLNLKDLIRKGTTEVESSIFDPRDDGTSDHWIQRNSSLVRLTGKHPFNSEPPLPRLMHHGFITPVPLHYVRNHGPVPRARWEDWTVEVTGLVTRPTCFTMEQLLHDFPSREFPATLVCAGNRRKEQNMVKQSIGFNWGAAAISTSVWRGVPLRTLLKSCGIYTRTKGALHVCFEGAEDLPGGGGSKYGTSILREVALDPSRDIILAYMQNGEPLSPDHGFPVRMIIPGFIGGRMVKWLKRIIVTTDQSQNYYHYKDNRVLPSHVDAELANAQAWWYKPDYIINELNINSVITTPCHQEILPINSWTTQMPYFIRGYAYSGGGRKVTRVEVTLDGGETWQVCTLDCPEKPNKYGKYWCWCFWSVEVEVLDLLGAREIAVRAWDEALNTQPEKLIWNVMGMMNNCWFRVKTNVCRPHKGEIGIVFEHPTQPGNQSGGWMAKEKHLEKSSESNPTLKKSVSSPFMNTTSKTYTMSEVRRHNNADSAWIIVHGHVYDCTRFLKDHPGGTDSILINAGTDCTEEFEAIHSDKAKQMLEDYRIGELTTTCYNSDSSSSNPSVHGSSDTIPLTPIKEVITPMRSVALNPREKIPCKLISKTSISHDVRLFRFALPSDDLLMGLPVGKHIFLCATVDEKLCMRAYTPTSSVHEVGYFDLVVKVYFKGVHPKFPNGGIMSQHLDSLPIGSVLDVKGPLGHIEYTGRGNFLVHGKPRFATRLAMLAGGTGITPIYQVVQAILKDPEDCTEMHVVYANRTEDDILLKEELDEWAKKYDRLKVWYVIQESIREGWEYSVGFITESILTEHIPNASPDTLALTCGPPPMIQFAVQPNLEKLGYDTQNNLLV

SEQ ID NO: 10285 - protein, 426 aa, Unknown
  Acidovorax sp. JS42
MNALNIAEYTHTLGLQAKTASAQMARAPAAIKNKALLALARLLRQNVDALQGDNARDLERARAAGLAEPMVDRLKLTPKVLETCAQGCEQLAAMPDIIGEIQGMKQQPSGIRVGQMRVPIGVFGMIYESRPNVTIEAASLSIKSGNACILRGGSEAIDSNKALARLVAQALAEAGLPEHGVQLVQTTDRAAVGQLIAMPQYVDVIIPRGGKGLIERISAEAKVPVIKHLDGNCHTYVDDPCDIAMAVQVADNAKTQKYSPCNASEGLLVARGVAAQFLPQIGAVYAAKGVEMRGCPEALAILRAVPGVQLAEATEADWSEEYLAPIISVKVVAGVDEAIAHINRYGSHHTDAILTRDHMHAQQFLRDVDSASVMVNASTRFADGFEYGLGAEIGISTDKFHARGPVGIEGLTSLKWVVLGEGEVRT

SEQ ID NO: 10286 - protein, 529 aa, Unknown
  Candidatus Desulfococcus oleovorans Hxd3
MKCLLINPFYPISETPSPPLGLAYLAAELERAGEEVLLVDFVVFPYSRAAIEETVKTFAPDFVGITAVTMTFDHAAEIVRDLRAVAPKLLIVMGGPHVSMCARETLDALPELDMVVVGEGDDTVVRIAEELAGDRRWETIDGIVYRDKTGICSTPVREYAVDVKALPLPARHLVPLGRYRALNMPVSMTTSRGCPFKCIFCVGRKMVGAKVRYRDPVSVVDEMEYLKSLSFSQVNIADDLFTASRPHCFGVCDEILRRGMNIQWSSFARVDLVSYDLLKKMREAGCVAVSFGVETANPEILKTIKKGITLEQVEAAVKACADAGVLPHVSFILGLPGETPDTIEETRTFGEKIKAMGASYGFHLLAPFPGTEIRDRAAELGIRILTDDWRDYHANKAIVETEKANAAMMDRVAGQWKDEFDEYLGDVKRKMDENIATEEEAWQLISLENTVINYDLMMKSSLETKGTWSVESAGADTDALLTDLAGRVCDDTDYGVARVTQALKWAMDKGSLACAVENGRVTWGWKDYL

SEQ ID NO: 10287 - protein, 950 aa, Neisseria gonorrhoeae
MKLSELFNPNEFAARHLSFGDEAALLAAVGEKSMDEFVGNTLPQSIRMPSELDLPEALTEADALAKLKGIASKNVINKSYIGLGYYPTRVPNVILRNVLENPGWYTAYTPYQAEIAQGRLEALLNFQQVCIDLTGFPVAGASLLDEATAAAEAMAMAHRVGKVKSERFFVDARVYPQTLDVMKTRAKYFGFELVVSDFAQADEGEYFGALFQYVGKDGDVQDLQDVIGRLKAKGTIVAVAADIMSLVLLKSPAELGADIALGNTQRFGVPMGFGGPHAAYFAFKDEFKRSAPGRIIGVSKDASGKPALRMALSTREQHIRREKATSNICTAQALLANLAGMYAVYHGPKGVKRIANRIHTLASVFADALVSDGLKVVHEVFFDTVTVDFGSKEKADQVFAAALESGYNLRSVNNTQVAAAFHETSVYEDLADLYRAFTGKDTFTFADDVKGRLNAELLRQDDILQHPVYNSYHTEHEMLRYLKKLEDRDLAMNRSMISLGSCTMKLNATAEMLPITWTEFSDIHPYAPEAQTAGYRELLADMENSLKAITGFDAISFQPNSGAQGEYSGMLAIRRYQEAQGEAHRNICLIPKSAHGTNPATAAMLGLKVVVVDTDEHGNVNIDDLKAKAEQHRDALSAIMITYPSTHGVYEEGIRDICRIIHENGGQVYMDGANLNAQIGIMQPAEVGADVLHMNLHKTFCIPHGGGGPGMGPIGLKAHLAPFAPGHTLTDTHSASAGQTSVAAAAFGSASILPITWMYLTMMGKQGMEQATRWALLNANYVAKRLSEDYPILYTGKNGRIAHECIVDLRPLKAESGITETDIAKRLMDYGFHAPTVSFPVAGTLMIEPTESESKAELDRFIAALKSIRREVQKVIDGEWPKDDNPLVNAPHTAADITGEWAHPYSREEAVFPLPFVREHKFWPFVNRVDDVYGDRNLVCSCPPMENYED

SEQ ID NO: 10288 - protein, 96 aa, Euglena viridis
ATYSVKLINPDGEVTIECGEDQYILDAAEDAGIDLPYSCRAGACSSCTGIVKEGTVDQSDQSFLDDDQMAKGFCLTCTTYPTSNCTIETHKEDDLF

SEQ ID NO: 10289 - protein, 322 aa, Streptomyces avermitilis
MNTAQHKIGSGFGATSTAVDVLHGIDLSGQLAIVTGGYSGLGLETTRALTGAGARVVVPARRPDVAREAVAGIDGVEVDELDLGDLESVRGFAERFLASGRTIDIVINNAGIMACPETRVGPGWEAQFATNHLGHFALVNRLWPAVEPGGARVVSVSSGGHHLSGIRWDDVHWTHDYDKWEAYGQAKTANVLFAVHLDRLGRESGVRAFSLHPGGILTPLQRHLAKEEMVERGWIDENGDLVHPDAFKTPEQGAATQVWAATSPQLAGMGGVYCEDCDIAEPASADGERGGVKDWATDPEQAARLWDLSAELTGVNAFASRA

SEQ ID NO: 10290 - protein, 417 aa, Silicibacter pomeroyi
MKDIADISATMTELGKRARAAAAQLAFASAEAKRAALIGAADAVWARRGEIIAANARDLEFGRDKGLSPAMMDRLMLDEARIQGIVDGLRTVADQDDPVGEVLAEWDMPSGIHIQRVRTPLGVIGVIYESRPNVTADAGALCLKSGNAVILRGGSESFHSSGAIHACLVAGLRAAGLPEDAIQLVPTRDRAAVSELLTMTDYVDVIVPRGGKGLVGLVQREARVPVFAHLEGIVHIYIDKAADPEKALRVVMNAKTRRTGICGAAECLLIHKDIADNLGADLVRALIEAGVEVRAEGLPGSLAATEADWGKEYLDMIIAAKVVDDVDAAIAHIRQYGSNHTDCVITEDDAVAARFFERLDSAILMHNASTQFADGGEFGMGAEIGIATGKMHARGPVGAAQLTSFKYLVRGNGTTRA

SEQ ID NO: 10291 - protein, 95 aa, Gleichenia japonica
AIFKVKFLTPDGERTIEVPDDKFILDAGEEAGLDLPYSCRAGACSSCTGKLLDGRVDQSEQSFLDDDQMAEGFVLTCVAYPAGDITIETHAEEKL

SEQ ID NO: 10292 - protein, 307 aa, Bacillus cereus
MNVYRGVHELIGHTPIVEITRFSLPIGVRLFAKLEFYNPGGSVKDRLGRELIEDALEKGLVTQGGTIIEPTAGNTGIGLALAALEHDLRVIVCVPEKFSIEKQELMKALGATVVHTPTEQGMTGAIAKAKELVNEIPNSYSPSQFANEANPRAYFKTLGPELWDALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 10293 - protein, 96 aa, Leucaena leucocephala
AFKVKLLTPDGPKEFECPDDVYILDQAEELGIELPYSCRAGSCSSCAGKLVEGDLDQSDQSFLDDEQIEEGWVLTCAAYPRSDVVIETHKEEELTG

SEQ ID NO: 10294 - protein, 569 aa, Hordeum vulgare
LGGACRVLAGMPAAGATALAGGVNFAVYSAEPPRALCLFTPEDLKADRVSEEVPLDPLMNRTGDVWHVFLEGELHGMLYGYRFDGTFAPHCGHYFDVSNVVVDPYAKAVISREEYGVPAHGNNSWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSSLWDPINVYGAPIEGDMITTGTPLVTPPLIDMISNDPILGGVKLIAEAWDAGGLYQVGQFPHWNVWSEWNGKYRDIVRQFIKGTDGFAGGFAECLCGSPQLYQAGGRKPWHSINFVCAHDGFTLADLVTYHNKYNLPNGEDNRDGENHNLSWNCGEEGEFARSSVKRLRKRQMRNFFVCLMVSQGVPIFYMGDEYGHTKGGNNNTYCHDSYVNYFRWEK

SEQ ID NO: 10295 - protein, 95 aa, Marchantia polymorpha
TFKVTLNTPTGQSVIDVEDDEYILDAAEEAGLSLPYSCRAGACSSCAGKVTAGEVDQSDESFLDDDQMDEGYVLTCIAYPTSDLTIDTHQEEALI

SEQ ID NO: 10296 - protein, 271 aa, Triticum aestivum
  misc_feature (192)..(192): Xaa can be any naturally occurring amino acid
AYLGDTIEQVCTKKQAGTGPEFPGYRRPTRPCKARVHNRCPTCRQELGDIRCLALEKVAESLELPCKYYSLGCPEIFPYYSKLKHESQCNFRPYSCPYAGSECSVVGDIPFLVSHLRDDHKVDMHSGCTFNHRYVKSNPREVENATWMLTVFHCFGQYFCLHFEAFQLGMAPVYMAFLRFMGDENDARNYSXYSLEVGANGRKMIWEGTPRSIRDSHRKVRDSHDGLIIQRNMALFFSGGERKELKLRVTGRIWKEQQNPDSGACIPNLFS

SEQ ID NO: 10297 - protein, 327 aa, Triticum aestivum
DLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLVAEAWDAGGLYQVGQFPHWNVWSEWNGKYRDIVRQFIKGTDGFAGGFAECLCGSPHLYQAGGRKPWHSINFVCAHD

SEQ ID NO: 10298 - protein, 97 aa, Medicago sativa
ASYKVKLVTPEGTQEFECPDDVYILDHAEEEGIVLPYSCRAGSCSSCAGKVAAGEVNQSDGSFLDDDQIEEGWVLTCVAYAKSDVTIETHKEEELTA

SEQ ID NO: 10299 - protein, 1099 aa, Magnetospirillum magnetotacticum
MTTPAPLHRLLQRQLARASRGREGGAPDFETLLRLISDSYEEHDKERRLSDRSARLMEEELRAANQESRRQAKAHLQAILNTVGEGIVIADQTGTVVSVNPALLSIFGYERDEVIGNNIDMLIPLAALKAAGSSGMERIFDLGRESMALRRGGTSFPIELAAGDLTPTGSAQFVVIMRDISERKRIEREMAESEERFRDFAQSTSDWFWEMGPDLRFTGFSGQFTEHTRALPSHYVGHTRDEMISDDTPMEARLQNLADMEARRPFRDFVYHTKNMDGPGRFLRVNGKPVFDPSGEFKGYRGTASDITEEIEAADRLKASQAEIERLAERNNSILESVDDGIVGIDLNGRATFVNRAAAKLLDFEPAELVGSDILPLMALDMETAESLYQILLRLADSIRDDTASFKRRDGSPLPVEYIASPVMDKGNQVGVVLGFRDITQRRLVERQLREAKEAAEAGNRTKSEFLATMSHEIRTPMNGVIGMTGLLLDTKLTEEQRHFAETIRDSGESLLTVINDILDFSKMEAGKLDLDYTEFELVPLVESVVDILAPRAHAKGIEIASLIDPRLRMLVRSDPGRLRQVLMNLGGNAVKFTEKGGVSIEVTLLERPGAQPMVHFDVRDTGIGIPPEAQGRLFSMFMQVDASTARRYGGTGLGLAICRRLAELMGGEVGLESQPGKGSRFWMSVPMELLAPQSAAPPDLTGHRVLVVDDNPVNCDVIERQLRAFGVEVHACLDAGSGMGELTRAAAMGTPWEVAVIDSQMPVVTGSEMVRMMRAIPMLGGSRIIVTSSQGMPAEQQDGQPAIDAFLHKPLRQSTLLDTIGRVLGLSGPEEQPAAPAEEHNAPDSTAKRLRILVAEDNPVNQQVALGLLRKLGHTVDVVGDGAEALEAVRLLPYDVVLMDVQMPEMDGLEATRAIRSLASAAARIPIVAMTANAMRGDDQMCFDAGMDGYISKPIDRHKLAEALAKYSGAPEPKPAEPTSAQDSKAVDLDVLDALAADIEADTVVEILVKFMEDARTRHANAAVAAPEGDLEKVRREAHTIKGAAASLGLMAVRDACLALEQAARAGEGVAPLVVQLHDRIEALPGQLSTTAYALPPS

SEQ ID NO: 10300 - protein, 332 aa, Solanum tuberosum
DLPLKFPQRDLVIYEMHVRGFTNHESSETKYPGTYLGVVEKLDHLKELGVNCIELMPCHEFNELEYYSYNSVLGDSKFNFWGYSTVNFFSPMGRYSSAGLSNCGLGAINEFKYLVKEAHKRGIEVIMDVVFNHTAEGNENGPILSFRGIDNSVFYTLAPKGEFYNYSGSGNTFNCNNPMVRQFIVDCLRYWVTEMHVDRFRFDLASILTRSSSSWNAVNVYGNSIDGDVITTGTPLTSPPLIDMISNDPILRGVKLIAEAWDCGGLYQVGMLPHWGIWSEWNGKYRDMVRQFIKGTDGFSGAFAECLCGSPNLYQKGGRKPWNSINFVCAHD

SEQ ID NO: 10301 - protein, 457 aa, Olea europaea
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGL

SEQ ID NO: 10302 - protein, 432 aa, Brassica oleracea
MDGVTGGDSKSGEATTAPPLRNPHPATLLGTNALPPPFLSKTYDMVEDPASDAIVSWSPANNSFVVWDPPEFSRSLLPRYFKHNNFSSFVRQLNTYGFRKVDPDRWEFANEGFLRGQKHLLKTISRRKSTQGHGSSSSSNPQSHQGHMASLSSCVEVGKFGLEEEVEQLKRDKNVLMQELVKLRQQQQSTDSKLQSMVKSLQTMEQRQQQIMSFLAKAVQNPTFLSQFIQKQTDSGNMHVTEASKKRRLTEDAAAASDGQIVKYQPIRSDSTMSMMWNMMNTDEKFPFSPNRDSGVTFQEVLLPTTSGQSQAYAPISSASTSLMPMIPPMPQESISDSPTENYMNAEKDVSEAFISPSPFLDGGSVPNQLEGLPQDLDIDELMSNCDIFEEYLAQSPVFGDETTLESSDANGGHVDKLIEELGHLTSETKQL

SEQ ID NO: 10303 - protein, 110 aa, Oryza sativa
  misc_feature (9)..(9): Xaa can be any naturally occurring amino acid
  misc_feature (15)..(16): Xaa can be any naturally occurring amino acid
  misc_feature (19)..(20): Xaa can be any naturally occurring amino acid
  misc_feature (25)..(26): Xaa can be any naturally occurring amino acid
  misc_feature (31)..(32): Xaa can be any naturally occurring amino acid
  misc_feature (38)..(38): Xaa can be any naturally occurring amino acid
  misc_feature (44)..(45): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(58): Xaa can be any naturally occurring amino acid
  misc_feature (64)..(64): Xaa can be any naturally occurring amino acid
  misc_feature (66)..(66): Xaa can be any naturally occurring amino acid
  misc_feature (69)..(69): Xaa can be any naturally occurring amino acid
  misc_feature (72)..(74): Xaa can be any naturally occurring amino acid
  misc_feature (77)..(77): Xaa can be any naturally occurring amino acid
  misc_feature (87)..(87): Xaa can be any naturally occurring amino acid
  misc_feature (92)..(92): Xaa can be any naturally occurring amino acid
  misc_feature (98)..(99): Xaa can be any naturally occurring amino acid
  misc_feature (104)..(104): Xaa can be any naturally occurring amino acid
  misc_feature (106)..(108): Xaa can be any naturally occurring amino acid
TPASFFLVXRLSNKXXLEXXVEATXXFLNKXXKPVLVXGPKLRXXKAGKAFXDLXHXXGYAYEXMXSAXGLXXXTYXHLIGTYCGAXSTAFXAEIFEXXDGYLXAXXXFN

SEQ ID NO: 10304 - protein, 202 aa, Unknown
  Nocardioides sp. JS614
MTRTARIERQTSESKVLVEVDLDGTGRHDVSTGVGFYDHMLTAFARHALVDLTVQTDGDTHIDAHHTVEDTAIALGQALRQALGDKRGIRRFGDATVPLDEALVQAVVDVSGRPYCVHTGEPEGQQYVQLGGTTPAYLGSLTQHVFESIAFHGHFALHVRVLAGREPHHIVETQFKAVARAFRDAVALDPRETGIPSTKGAL

SEQ ID NO: 10305 - protein, 314 aa, Cryptococcus neoformans
MARKITVAAAQVGAVHKDSQRPETLSRLISLLEQASQNGVEVLVYPETTFTTFFPRWKGLDDDREELDRWFEHGDITTNPNIAKIDTILQPLISRAKDLGIDIVIGYGEKTDDSHYYNTCSYIHAGKEISKYRKVHLPGNKEPYPDPEFIDQLEKRYFEPGDYGFKSVMTVVGLNHGAVSVCRALSWCAWAITLALGLQDYADPEVIKAQSEFQHLLVMQAHSYTNATFSIAAARAGFDDGKFGLIGCSCIVHPEGHIIAQSKTMDDELVIATIDLDDAKIGKQKVFNFGLHRQPHQYSIITQQAGVTAPPRLN

SEQ ID NO: 10306 - protein, 328 aa, Prochlorococcus marinus
MTPIYEDNSLAIGNTPLVKLHSVTKNCKATVLAKIEGRNPAYSVKCRIGANMIWDAEKKGLLNKQQTIIEPTSGNTGIALAFTAAAKGYKLTLTMPESMSLERRRVMAVLGAELILTEAAKGMPGAIAKAKEIAESDPNKYFMPGQFDNPANPEIHFKTTGPEIWNDCNGNIDVLVAGVGTGGTITGVSKFLKQEKRKQVLSVAVEPSHSPVISQTINGQEVKPGPHKIQGIGAGFIPKNLDLSLVDQVEQVSNEESIAMALRLAKEEGLLVGISCGAAATAAIRLAEQEQFAGKTIVVVLPDLAERYLSSVMFAEVPTGIIEQPKTN

SEQ ID NO: 10307 - protein, 401 aa, Scherffelia dubia
VAAASVSRAANKGRNAALSVRAAAGAEVAAASKSYGVFKLSYSIDNEPKQRTQSWKATINVVVSGAAGQISNHLLFMLASGSVFGNDQPIALRLLGSERSKEALEGVAMELEDSLYPLLREVVIGIDPLEVFAEADWALLIGAKPRGPGMERADLLDINGRIFVDQGQALNRVAKKTCKVLVVGNPCNTNALIAMLNAPNIPRKNFHALTRLDENRAKCQLALKSGKFYTSVTNVTIWGNHSTTQVPDFVNAKIGGKPATSVITDTAYLKEKFTPLVQTRGGALIKKWGRSSAASTAVSIADAIKSLVVPTPAGDWFSTAVCTDGNPYGIQEGLVFSMPCRSTGDGDYEVVPGLVIDDYLREALRKTEDELVKEKECVGHLIGNPDAACAITEDTMLAGEN

SEQ ID NO: 10308 - protein, 175 aa, Triticum aestivum
NSPDGTYDAIIVDSSDPIGPAQELVEKPFFETIARALRPGGVLCNQAESMWLHTHLIQDMLSICCETFKGSVHYAWASVPTYPSGAIGFLLCAKEGPPVNFLAPINPIEKLEGAMTAGRDIRFYNTEMHRAAFVLPTFAKRELEAYGGSTRRAQEEKSAEPAKVAVAPHSEILTA

SEQ ID NO: 10309 - protein, 706 aa, Bifidobacterium longum
MYPLGASYDGAGVNFALYSQVAQKVELCLFDEHDAETRIEMTERNSYVWHNYIPGLHPGQRYGYRVYGPYDPVHGLRCNPNKLLLDPYAKAIEGNIDGDESLFSYWFKSPDDNSAMNDLDSAAHTMKSAVINPYFDWGNDQHPYISYHDSVIYEAHVRGMTNLNMDVPPDIRGTYAGLAYPSVIEYLKKLGITAIELMPIHQFVNDSFLQEKGLSNYWGYNTIGFFAPHNAYSSSGERGEQVNEFKSMVKAYHRAGMEVILDVVYNHTAEGNHMGPTLSFKGIDNASYYRLVEGDQQHYFDTTGTGNSLLMRSPHALQLITDSLRYWVTEMHVDGFRFDLAATLARQFQEVDKLSAFFDIVEQDPIISRVKLIAEPWDLGSGGYQVGGFPSSWSEWNGRYRDTVRDFWRSQPSTLPEFASRLMGSSDLYQVNGRRPVASVNFITAHDGFTMNDLVSYNEKHNEANGEGNRDGESNNRSWNCGVEGPTNIPDVNDLRQRQMRNMFATLLFSQGIPMICGGDEVARTQQGNNNAYCQDNEISWTNWHLDKGRKELLAFVSKLIHLRLDHPVLHRRRFFTGREPGDDSNMIPQVEWFDHTGSIMDMDDWQNTHAFSMMIYLNGSDIPEVDWYGNRMVDNDFILIFNAHYEPIMFTLPDERYGRKWQLVVDTHNPDGPELSYEAGFMITAQSRSFLMLMSDKKPKKPMGL

SEQ ID NO: 10310 - protein, 152 aa, Oryza sativa
  misc_feature (32)..(32): Xaa can be any naturally occurring amino acid
  misc_feature (49)..(49): Xaa can be any naturally occurring amino acid
ATHKVNYILNRREKHYPTGGRGVNGTVAHQSXMERRGDKTTAGIEPKDXAKRGKDYGYHAPTMRGPVPGTPTMEPTESESKDELDRCWDALSSIREKIAENERGKADANNNVLKRAPHPPKLLMNDPWTKPNSREYAAVPAGRLQSAKNGPT

SEQ ID NO: 10311 - protein, 129 aa, Unknown
  Burkholderia sp. 383
MRLLHTMLRVGDLDRSIKFYTELLGMKVLRRDDYPEGKFTLAFVGYGDESDNTVIELTHNWDTPAYDLGNGFGHLALEVDDAYAACDKIKAQGGKVTREAGPMKHGTTVIAFVEDPDGYKIEFIQKKAH

SEQ ID NO: 10312 - protein, 223 aa, Oryza sativa
MARFEAYENNGGTCVAVAGADYCVVAADTRLSVGYSILSRDSSKIAHLADKCVLASSGFQGDVKALQRNLAAKELLYEHNHNKKMSCPAMAQLLSNTLYYKRFFPYYAFNVLGGLDSEVAAHQYERMITTCENIFSSFAGYSAQGTGAALMMPVLDNQLKSPSPLLLPARDAVTPLSQSDAVDLVKDVFASATERDIYTGDKLEIVVINSAGSHREFIELRKD

SEQ ID NO: 10313 - protein, 228 aa, Vitis vinifera
MALPVSAIGFEGYEKRLEISFFEPGIFADPVGMGLRSLSKTQLDEILEPAECTIVSSLSNDEVDSYVLSESSLFVYHYKIIIKTCGTTKLLLSIPPILKLANSLDLSVRSVKYTRGSFIFPGAQSFPHRNFSEEVVELDGHFGELGAGSKAYMMGSHDKPQKWHVYTAAAEFTGRSDPVYTLEMCMTGLDRKKASVFYKTDTSSAAVMTENSGIRKILPNSEICDFDF

SEQ ID NO: 10314 - protein, 466 aa, Acidobacteria bacterium
MSLSTMIPGAIATPRTYVNEVLALVKAKNPAEKEFHQAVQEVLESLIPALERHPEYISHKILERVTEPERLLMFRVPWFDDKGEIQVNRGFRIEMNSAIGPYKGGLRFHPSVNLGILKFLAFEQVFKNSLTTLPMGGGKGGSDFDPKGKSDNEVMRFCQSFMTELQRHIGPDTDVPAGDIGVGGREIGFLFGQYKRLRNEFTGVLTGKGLNWGGSLIRPEATGYGCVYFAEEMLKTVKQTLEGKVCLVSGSGNVSQYTIEKLLDLGAKPIACSDSNGIIHDPAGIDREKLAYILDLKNTKRGRISDYAEKFKTAKYIPVDPKLDHNPLWDIKADCAFPSATQNEINAKDAKNLIKNGCKVVSEGANMPSTLEATNLFLEAGVLYGPAKAANAGGVATSGLEMAQNSARLAWTREEVDHRLHNIMIAIHKNCFETAEKYGKPGNLVVGANIGGFLKIADSMLDQGLV

SEQ ID NO: 10315 - protein, 416 aa, Oceanicola granulosus
MERLTQRSMAFVLAGGRGSRLKELTDRRVKPAVYFGGKTRIVDFALSNAMNSGIRKIALATQYKAHSLIRHCQRGWNFFRAERNEFLDILPASQRMGGEAWYRGTADAVTQNFDIVDDYDVDYVIILAGDHIYKMDYEIMLRQHVETGADVTIGCLTVPRMEATAFGVMAVDDNGQITDFLEKPADPPGTPDDPDVALASMGIYVFSWKLLRELLLKDADDPDSSHDFGNDLIPDLVKNGKAIAHRFDISCVRDAGAPAYWKDVGTVDAFWEANIDLTNFTPDLDLWDTKWPIWTYSEGVPPAKFIHDERDRRGVAISSMVSGGCIISGTEVRNSLLFTQVHTNSYAVLDHAVVLPHVVVHRSARLRKVVIDSGVEVPEGLVVGEDPLVDQEFFRVTEKGVTLITQPMIEKWKAAQ

SEQ ID NO: 10316 - protein, 681 aa, Oceanicola granulosus
MGATFDGDGVNFAVFSQHAQRIALCLFDEDGRETLNINLPERSGHVWHGYIPGLRPGQLYGYRAHGPYRPDEGHRFNAHKLLLDPYARRLHGKLTWDGSLFGYDVDARHADLTFDTRDSAAHMPRCVVVEEDDGFDWQGDRPLETPMEETVIYEAHVKGLTMLKPGLEQRGTYAALASDPMLEHLTKLGITAIQLLPIHAFLDDEHLLEKGLVNYWGYQTIGFFAPDPRYLSGDDLREIKEMVRRFHAAGIEVILDVVYNHTGEGNHLGPTLSFRGLDNRSYYRLAESPRYYFNDSGTGNSLNVAHPMVLRMVLDSLRHWVETYHVDGFRFDLATSMGRTEHGFDRDAPFFQAIAQDPVLSRVKLTGEPWDVGPGGYQLGAFPNPWCEHNDKYRDEVRSFWRGDADRVRALSARVAGSAMHFDHDGRAASASVNFLSCHDGFTLMDTVSYNHKHNEANGENNADGHDHNASDNCGVEGPTDDPDILEARARRRRNMLATLLLSQGTPMLLAGDELGNSQGGNNNAYCQDNEIGWVTWDGADPAFLDFARQIIHFRRTHPTLRQKRFLHARERLFDGVPDLFWRNRDGSEMTDADWTDPDRRHLIAELRTASGTPAYANVSYAIMAIFNVGGALTVTLPPPKEGWTWIRELDTADPSLGPFAVTKPLKVHANSVVALILRPQ

SEQ ID NO: 10317 - protein, 112 aa, Bordetella pertussis
MKQVTAIIKPFKLDEVREALAEVGVSGLTVTEVKGFGRQKGHTELYRGAEYVVDFLPKIRVEVVLADDMVDPAIEAIVKAARTGKIGDGKIFVTPVEQAIRIRTGESDEEAL

SEQ ID NO: 10318 - protein, 492 aa, Kluyveromyces lactis
MSEPAGDIGLIGLAVMGQNLILNAADHGFTVVAYNRTVSKVDHFLANEAKGKSIIGAHSVEELCRNLKRPRRIILLVKAGDAVDAFIQQLLPFLEKGDIIIDGGNSHFPDSNRRYDELKEKGIYFVGSGVSGGEEGARYGPSLMPGGAEEAWPHIKDIFQSISAKSDGEPCCDWVGPAGSGHYVKMVHNGIEYGDMQLITEAYDIMKRIGGFTDKEIGEVFSQWNKGVLDSFLVEITRDILLYDDVDGTPLVEKILDSAGQKGTGKWTAINALDLGMPVTLIGEAVFARCLSSLKDERVRASKLLPGPQIPKDAVKERQQFVDDLEQALYASKIISYAQGFMLIREAGKTYGWKLNNPAIALMWRGGCIIRSVFLGEITKAYRENPELENLLFNKFFADAVEKAQSGWRKTIGLAVSYGIPTPAFSTALSFYDGYRSERLPANLLQAQRDYFGAHTFRVLPEAASENLPADQNIHINWTGKGGNVSASSYQA

SEQ ID NO: 10319 - protein, 72 aa, Silicibacter pomeroyi
MAKEDTLEFPGVVKELLPNATFRVELENGHEIIAHTAGKMRKNRIRVLAGDKVQVEMTPYDLTKGRINYRFK

SEQ ID NO: 10320 - protein, 544 aa, Bordetella pertussis
MSLARVGIAQINACVGDLAGNAARVLQAARQAAGQGADVLVTPELVLTGYPPEDLLLRPRFIQEQQAVFERLCQDLAGLAGLHVVIGHVLARQDRLYNAATVVCEGRVLGSYCKRELPNYSVFDEQRYFSAHGEAFGFTVKGVRFGLNICEDIWFERAPRAAAADGAQVLLVPNASPYNTGKQEERLSVARRSVQDTGCALIYANLVGGQDELVFDGASFALDAQGRMSARLPDFTEGVNVLEVDARSTVRPVTEQAAVQPYGLEEQVWNALVLGVRDYLGKNGFPGAIIGLSGGIDSAVVLAVAVDAVGADNVRAVMMPSRYTADISLTDAADMARRLGVQYDVIAIGEVVDRFEAALAPQFAGLPVDATEENIQARARGTLLMALSNKTGRLVLTTGNKSEMTTGYCTLYGDMAGGFAVIKDVPKTLVYRLANWRNQRQPIIPERIITRPPSAELRPDQTDQDSLPPYDILDGIIERYMEHNASAADIVAAGFPREAVGQVVRLIRINEYKRRQAPPGPRITPRAFGRDWRYPVTNGFRETV

SEQ ID NO: 10321 - protein, 93 aa, Peridinium bipes
FKVTLDTPDGKKSFECPGDSYILDKAEEEGLELPYSCRAGSCSSCAGKVLTGSIDQSDQAFLDDDQGGDGYCLTCVTYPTSDVTIKTHCESEL

SEQ ID NO: 10322 - protein, 484 aa, Staphylococcus aureus
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 10323 - protein, 338 aa, Brassica oleracea
MGRSPCCDQDKGVKKGPWVPEEDDKLTAYIEKNGYGNWRSLPKLAGLNRCGKSCRLRWMNYLRPDIRRGEFSDEEESTIVRLHALLGNKWSKIASHLPGRTDNEIKNYWNTHMRKKMLQMGIDPITHEPRTNDLSPILDVSQILAAAIGNGQFGNSNLINNNTALEDLLKLQLIHKMLQIITPKAIPNITSFTTNSLNPKLDSVVNSFTTNSVNPKPEQAAIQLNANEPHDFINQSANEDFMMPPFENIWDGFEDNQLPGLVTVSQKNLNSGTGMMPGYYGDQLSEIPSNGSISVSPETSGLNYPGTTQHLTGSDVLEDWEKFLDDETSHSCWKSFLE

SEQ ID NO: 10324 - protein, 1240 aa, Arabidopsis thaliana
MVSDADASTSSSSIDIMPSANIQNDVPEPSVHTSHRRTRKPAYLQDYYCHSVASLTIHDISQFLSYEKVSPLYHSFLVCIAKAKEPSTYNEAKEFLVWCGAMDDEIGAMETTHTWEICTLPPNKKPIGCKWVYKIKYNSDGTIERYKARLVAKGYTQQEGIDFIETFSPVCKLTSVKLILAISAIYNFTLHQLDISNAFLNGDLDEEIYMKLPPGYAARQGDSLPPNAVCYLKKSIYGLKQASRQWFLKFSVTLIGFGFVQSHSDHTYFLKITATLFLCVLVYVDDIIICSNNDAAVDELKSQLKSCFKLRDLGPLKYFLGLEIARSAAGINICQRKYALDLLDETGLLGCKPSSVPMDPSVTFSAHSGGDFVDAKAYRRLIGRLMYLQITRLDISFAVNKLSQFSEAPRLAHQQAVMKILHYIKGTVGQGLFYSSQAEMQLQVFSDASFQSCKDTRRSTNGYCMFLGTSLISWKSKKQQVVSKSSAEAEYRALSFATDEMMWLAQFFRELQLPLSKPTLLFCDNTAAIHIATNAVFHERTKHIESDCHSVRERSVYQATLSYSFQAYDEQDGFTEYLSPILRGTIMYIVSMFGLAGLEALICFIFLFLFSFLTSFKASAQNPFYLNHDCPNRTTYSSNSTYSTNLKTLLSSFASRNASYSTGFQNIRAGQTPDRVTGLFLCRGDLSPEVCSNCVAFSVNESLTRCPNQREAVFYYEECILRYSHKNFLSTVTYEGELIMRNPNNISSIQNQRDQFIDLVQSNMNQAANEAANSSRKFSTIKTELTSLQTLYGLVQCTPDLARQDCFSCLTSSINRMMPLFRIGARQFWPSCNSRYELYAFYNETAIGTPSPPPLFPGSTPPLTSPSIPALVGYCFLAQRTKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQTQLDWMQRYNIIGGIARGILYLHQDSRLTIIHRDLKASNILLDADINPKIADFGMARIFGLDQTQDNTSRIVGTYGYMAPEYAMHGQFSMKSDVYSFGVLVLEIISGRKNSSFDESDGAQDLLTHTWRLWTNRTALDLVDPLIANNCQNSEVVRCIHIGLLCVQEDPAKRPTISTVFMMLTSNTVTLPVPRQPGFFIQSSPVKDPTDSDQSTTTKSTPASIDDELITDLYPR

SEQ ID NO: 10325 - protein, 299 aa, Caulobacter crescentus
MSLIGEKPAPSSKSDHIKDGTDASFMADVIEASKTQPVIVDFWATWCGPCRQLTPTIEKVVTAAKGAVKLVKIDVDKNPGFAGQLRVQSIPTVYAFVDGRPVDAFQGALPESQVRAFVEKLAGAAEGGALDEIIAMGKESLEIGDLGGAAQAFAQALQIDPTSAKALGGMARVYLANGDPEGAAEVVAMAPADAKDPDLDAARAALALAAEAPSETAAFEQRLAADPDDHEARLELAKALAGVGRLQDAADHLLTIIARDRTWNDDAARKQLLTVFEAAGPTSEVAKQGRRKLSSILFS

SEQ ID NO: 10326 - protein, 610 aa, Zea mays
METLLAGNPANGVAKPTCNGVGALPVANSHAIIATPAAAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIAMATGDKKDCLCFIEVIVHKDDTSKELLEWGSRVSAANSRPPNPQ

SEQ ID NO: 10327 - protein, 554 aa, Clostridium perfringens
MNKKWWKELIAYQIYPKSFMDSNGDGIGDIQGIISKLDYLKDLGIDLIWLCPMYKSPNHDNGYDISDYKDILDEFGTMDDFNELLNEVHNRGMKLIIDLVINHTSHEHPWFIESRSSRDNPKRDWYIWREGKGYEEPNNWESIFKGSAWEFCENSEEYYLHLFAKEQPDLNWENKEVRRELYNMINWWLDKGIDGFRVDAISHIKKEEGLKDMDNPEGLKYVSSFEKHMNVEGINSHLKELKEETFSKYDIVTVGEANGVSANEADHWVAEDEGTFNMIFQFEHLNLWNYEEGQGFDVKAYKDVLTNWQNSLEGKGWNALFIENHDIPRVVSTWGNDKEYLTECAKAFGAIYFLQKGTPFIYQGQELGMTNVKYHSICEYDDVKTINTYNERIESGVSEEIALKEAWVTSRDNSRTPMQWNSSKNAGFTCGKPWIGVNENYKTINVEVEERDENSVLNFYKKLIKLKKSNEALIYGVYDLILEEDENIFAYTRTLNNDKFLIMANLTGENAKYVYEKEKLNSKDLILNNYEVCEHKNLTEFILKPYECRVYKLS

SEQ ID NO: 10328 - protein, 184 aa, Pseudomonas aeruginosa
MKPRVLLSVLALAGLPLSGWAADCPELLQGQLTKLRSKESIDLCQRYAGKPLVVVNTASHCGFTPQFKGLEALYQRYKGQGLEVLGVPSDDFKQEAADTAETAKICYGNYGVTFAMTQPQHVRGDEAIPLFRQLAEQSGQAPRWNFYKYVVDRQGRVVAQFSSKTTPDDPQLQAAIEKAIASQP

SEQ ID NO: 10329 - protein, 406 aa, Mycobacterium tuberculosis
MNAHVTSREGVNEFDDGIVIVGGGLAAARTAEQLRRAGYSGRLTIVSDEVHLPYDRPPLSKEVLRSEVDDVALKPREFYDEKDIALRLGSAAVSLDTGEQTVTLADGTVLGYDELVIATGLVPRRIPSLPDLDGIRVLRSFDESMALRKHASAARHAVVVGAGFIGCEVAASLRGLGVDVVLVEPQPAPLASVLGEQIGQLVTRLHRDEGVDVRTGVTVAEVRGKGHVDAVVLTDGTELPADLVVVGIGSTPATEWLEGSGVEVDNGVICDKAGRTSAPNVWALGDVASWRDPMGHQARVEHWSNVADQARVVVPAMLGTDVPTGVVVPYFWSDQYDVKIQCLGEPHATDVVHLVEDDGRKFLAYYERDGVLVGVVGGGMAGKVMKVRGKIAAGAPIAEVLDQTQA

SEQ ID NO: 10330 - protein, 554 aa, Bacillus thuringiensis
MSRKIIVVGGVAGGASVAARLRRLSEEDEIIMVERGEYISFANCGLPYYIGGVITERQKLLVQTVERMSKRFNLDIRVLSEVVKINKEEKTITIKNVTTNETYNEAYDVLILSPGAKPIVPSIPGIEEAKALFTLRNVPDTDRIKAYIDEKKPRHATVIGGGFIGVEMVENLRERGIDVTLVEMANQVMPPIDYEMAAYVHEHMKNHDVELIFEDGVDALEESGAVVRLKSGSVIQTDMLILAIGVQPESSLAKDAGLALGVRGTIKVNEKFQTSDPHIYAIGDAIEVKDFVTETETMIPLAWPANRQGRMLADIIHGHTDSLYKGTLGTSVAKVFDLTVASTGVNEKILKRLNIPYEVVHVQANSHAGYYPNATPVLIKLIFNKDSGKIYGAQALGRDGVDKRMDVIATAIKANLTVLDLPDLELSYAPPYSSAKDPVNMVGYAASNIVDGFVDTVQWHEIDRIVENGGYLIDVREPNELKQGMIKGSINIPLDELRDRLDEVPVDKDIYITCQLGMRGYVAARMLMEKGYKVKNVDGGFKLYGTVLPERIAY

SEQ ID NO: 10331 - protein, 477 aa, Leptospira interrogans
MSLLPTVCIIGAGPSGIAVCKALKDKGIPFECYEAGSEVGGNWKFKNDNKMSSIYKSLHTNTHKDKMQYKDYPMPNSYAAYPDHQKISEYFINYVNHFGFRDHIFFKTPVTHVKHEEDGTWSILTQDGKQKYYDVLIVSNGHHWSQRWPKPDFPGKFTGDIIHSHSYIDPNKPIQLTGKRVVILGMGNSAMDIAVELCRPGISSKVFLAARRGAYIIPNYLFGKPLDKIATLFPVHTPFWLKSLIIKFALKLGVGNVEDFGLQKPDHKPGAAHFTISQDILVRLGRGDIIPKPNIESYNGNKVKFVDGSEEEIDVIIYCTGYDVKFPFFDENFLSAKDNHLPLFHRMVKPEFKNLFFVGLFQPLGPIAPLSEFQGKWISEYLVGNYEFPSEEKMNQSIEKYESKMKRRYITSARHTMQVDFEVFLYDMKSELKKGIKRAAKNGNKLPVPALARNKSILSNDIPVKRFKNKTELFSEI

SEQ ID NO: 10332 - protein, 337 aa, Pyrus communis
MGVESVERERESNEGTIPAEFIRSENEQPGITTVHGKVLEVPTIDFSDPDEEKLTVQITEASSNWGMYQIVNHDIPSEVISKLQAVGKEFFELPQEEKEAYAKPPDPGSIEGYGTKLFKEISEGDITKKGWVDNLFNKIWPPSVINYQFWPKNPPSYREANEEYAKHMHKVVEKLFRLLSLGLGLEGQELKKAAGGDNLEYLLKINYYPPCPRPDLALGVVAHTDMSTVTILVPNDVQGLQACKDGRWYDVKYIPNALVIHIGDQMEIMSNGKFKSVLHRTTVNKDKTRISWPVFLEPPADHVVGPHPQLVNAVNQPKYKTKKYGDYVYCKINKLPQ

SEQ ID NO: 10333 - protein, 109 aa, Pseudomonas chlororaphis
MSSDLIKHVSDASFEADVLKAEGAVLVDYWAEWCGPCKMIAPVVDEIAETYKGKLTVAKLNIDENQETPAKHGVRGIPTLMLFKNGNVEATKVGALSKSQLAAFLDANI

SEQ ID NO: 10334 - protein, 722 aa, Oryza sativa
MPPIPSLWIRVFFSWLLLSLPAAAAADFSHCGGCDDGDGGGGIWSTDNILQCQRVSDFLIAMAYFSIPLELLYFATCSDLFPLKWIVLQFGAFIVLCGLTHLITMFTYEPHSFHVVLALTVAKFLTALVSFATAITLLTLIPQLLRVKVRENFLRIKARELDREVGMMKRQEEASWHVRMLTHEIRKSLDRHTILYTTMVELSKTLELQNCAVWMPSESGSEMILTHQLRQMETEDSNSLSIAMDNPDASNFKGGTPEVMETSYAILVLVLPEDGSLGWGEEELEIVEVVADQVAVALSHAAVLEESQLIREKLAAQHRDLLRAKHETTMATEARNSFQTAMYDGMRRPMHSILGLVSMMQQENMNPEQRLVMDAIVKTSSVASTLMNDVMQTSTVNREYLSLVRRAFNLHLLVKEAISVVRCLTGCKGIDFEFEVDNSLPERVVGDEKRVFHIVLHMVGTLIQRCNAGCLSLYVNTYNEKEERHNQDWMLRRANFSGSYVCVKFEIRIRESRGNLLSSSSSRRLQGPNSTSSEMGLSFNMCKKIVQMMNGNIWSVSDSKGLGETIMLALQFQLQHVTPVSGASSDLFRSAPIPNFNGLQVILVDSDDTNRAVTHKLLEKLGCLVLSVTSGIQCINSFASAESSFQLVVLDLTMRTMDGFDVALAIRKFRGNCWPPLIVALAASTDDTVRDRCQQAGINGLIQKPVTLAALGDELYRVLQNN

SEQ ID NO: 10335 - protein, 357 aa, Pyrus communis
MVSSDSVNSRVETLAGSGISTIPKEYIRPKDELVNIGDIFEQEKNNEGPQVPTIDLKEIESDNEKVRAKCREELKKAAVDWGVMHLVNHGISDELMDKVRKAGKAFFDLPIEQKEKYANDQASGKIQGYGSKLANNASGQLEWEDYFFHCVYPEDKRDLSIWPQTPADYIEATAEYAKQLRELATKVLKVLSLGLGLDEGRLEKEVGGLEELLLQMKINYYPKCPQPELALGVEAHTDVSALTFILHNMVPGLQLFYEGKWVTAECVPNSIVMHIGDTLEILSNGKYKSILHRGMVNKEKVRISWAVFCEPPKEKIILKPLPETVSEDEPAMFPPRTFAEHIQHKLFRKSQEALLPK

SEQ ID NO: 10336 - protein, 376 aa, Bacillus anthracis
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKEADVSISVIEVPWDEASRFGIMNTNEEMEIVEFEEKPQFPRSNLASMGIYIFNWAILKEYLEMDARNPESSNDFGKDVLPLLLDEGKKLMAYPFEGYWKDVGTVKSLWEANMDLLRDETSLNLNDRDWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 10337 - protein, 893 aa, Carboxydothermus hydrogenoformans
  misc_feature (353)..(353): Xaa can be any naturally occurring amino acid
MADVTLKINGIEVTVPEGTTILEAAQIAGFKIPTLCYDPELSKPGACRICVVEVKGARNLVASCVTPVAPGMEVLTHSEPVINARREILDLLLSNHPEDCLTCDKMGECALADYAYEYGVRRGSYQGEKNVYPIEDNNPFIVRDMNKCILCGKCVRVCDEIVGYSVIDFINRGFKTKVAPPYDGTLAESNCVFCGSCVTVCPTGALTVKDTRGKFRPWEVKRVKTTCPYCGVGCNFDLLVKDDKVVGVAPNPTSEVNGRFMCVKGRFGYKFIHSDDRLTKPLIKKNGELTEASWDEALTLVAEKLGEIKAKYGSDSIGVLASAKCTNEENYLLSKFTRAVLGTNNIDHCARLXHSPSVAGLAAAFGSGAMTNSFEDIMETELIMLIGSNTTESHPVAGYKIKQAVKKGAKLIVIDPRNIELASYADLHLQLKPGTNLPLLNAMAHVIIEEGLYNEQFIRERTEGFDSYKDTVKDYSPEAVAEICGVPAEKIREAARMYAKAGKAMILYTMGVTQFSFGTYGVLAVANLAMLTGHVGKDGAGVNPLRGQNNVQGACDMGGLPNVFTGYQRVDDPAANEKFSKAWGVKLPEKPGLTLGEMFDGALKGNIKAMYIMGENPVLSDPDARHIEEALKKLDFLVVQDIFLTETAKFADVVLPAATFAEKDGTFTNTERRVQRVRKAIPCVGEAKPDWEIIALVATKMGYPMSYSSAEEIFDEMRTLTPSYAGITYERLEKKSLQWPCPAPDHPGTKFLHSDKFVRGKGLFHPIPFKEPEEKPDSEYPFTLITGRRLYHYHTGTMSRRSMMGEHVPEDHLEMNPADAKKLNIKDGDRVRVTTRRGSVEIKVALTDKVPEGTVFASFHFFESPVNQVTNPARDPMAKTPELKYSAAKIEKL

SEQ ID NO: 10338 - protein, 366 aa, Prochlorococcus marinus
MQQMNENSSQTTKELSENKEFKNSPELDNNSMPKNEEDLSFEKSDIPSADASSSRTNTDLDNAGFTQEEFASLLGKYDYNFKLGDLVKGTVFALEPKGAMIDIGAKTAAFMPVQEVSINRVEGLDDVLQPSESREFFIMSEENEDGQLALSIRRIEYQRAWERVRQLQKEDATIYSEVFATNRGGALVRVEGLRGFIPGSHISARRVKDDLEGEYLPLKFLEVDEERNRLVLSHRRALVEKKMNRLEVGEVVVGSVKGIKPYGAFIDIGGVSGLLHISEISHEHIETPHNVLNVSDQMKVMIIDLDSERGRISLSTKALEPEPGDMLTDPQKVFSKAEEMAAKYKQMLFEQTDEAEETASASSETV

SEQ ID NO: 10339 - protein, 318 aa, Wolbachia endosymbiont
MKNYRFGTKVLIIGSGAAGYAAAIYAARANLEPVVVTGMQPGGQLTITMGVENYPGFVSIQGPELMKQMRLHVEKVGAEIVNDEIKSVEQLEYSNEYKFRSSGNNDDYYSNAVIIAAGSQAKWLGLESERKFQGYGVSACATCDGAFFRNKIVAVIGGGNTAVEEAIFLTRFAKEVILIHRRDKLRAEKIMQDRLFANNKIKVIWNHTVEQVLGEENPKKVTGITIKSTKIDEIQELRVNGVFIAIGHAPNTGVFKSFIEMDEQGYIITKPGTTLTSRAGVFAAGDVQDKVYRQAVVAAGTGCMAALDAEKFLECTSK

SEQ ID NO: 10340 - protein, 160 aa, Prochlorococcus marinus
MPLDLEAKKVLLRKIPHGLFICTVREGDVINGFTASWVTQGSFAPPLVVMAVRSDGSSHAIIKRTNNFCLNVLRSDQKDLAAVFFKPQEGLGGRFESTTYQFGELGLPVLEDAIGGLECSVVGAVEHGDHSVFVAEVVSAKLIKDSESLNLSSTGWSYGG

SEQ ID NO: 10341 - protein, 902 aa, Chromobacterium violaceum
MDKTETRTTCCYCGVGCGVLISSENGRIVGVRGDPDHPANYGRLCGKGLSLAASAASDSGRALHPEMRMARDVPRLRVGWDQALDAAADRFADIIRRHGPDAVAFYASGQLLTEDYYLFNKLAKGVAGTNNIDTNSRLCMSSAVTAYKMAFGADGPPACYEDLESAGCVLFAGSNMAYAHPVLFRRLEDARRDWSDARWIVVDPRRTDTAAMADLHLQIQPGTDVALFHGMLHHLIWEGLTDAGYIAAHTEGFDALKRMVRDYTPKMAAEICGVRAEDIATAAEWFGRSPASLSLYCMGLNQSSQGTAKNLALINLHLATGQIGRPGSGPFSLTGQPNAMGGREVGGMATMLAAHRDIANPDHRREVAAHWGVPEARLSSRPGLPAVAMFEALARGEIKAVWIVCTNPAHSLPDLALARQALSRAELVVVQDAFAATDTTAFADILLPAASWGEKEGTVTNSERRVSRVRAAVPPPGEARPDGWIAAEFGRRLAARLHPGEADHFAYADAGQVFDEHRALTVGRDLDMGGLDYRLLEEKGPQQWPLPAGQAEGQARRYVDGVFATDNGKARFHAIDYQPPVDKISAHYPFRLITGRLRDQWHGMSRTGRVPGLFSHSPEPELCMHPEDAERRNLCDGDLVRVASKRGQWVLPLKTDGDLMRGCVFAAMHWSRQFLSSGGCNEATIPAVDGLSFQPELKHAAVRVEKAELPWRALAALRHPDLPALQARLAPLLGDMDYAAMALAGRDTLLLRAAGASPRLDWLMRVLDALALFPGPDVLEYRDDGRGALKRVAWDGDRLAWLVFAGGAQDDRDAGERLLQSLLDGEPWRGPRLAAFSPAAAGAARRDRIVCQCKQVGEAAILARLAQGGGVAELQAELGCGMVCGTCAPELARMASGYRQHA

SEQ ID NO: 10342 - protein, 291 aa, Streptococcus pneumoniae
MRNVRVATIQMQCAKDVATNIQTAERLVRQAAEQGAQIILLPELFEHPYFCQERQYDYYQYAQSVAENTAIQHFKVIAKELQVVLPISFYEKDGNVLYNSIAVIDADGEVLGVYRKTHIPDDHYYQEKFYFTPGNTGFKVWNTRYAKIGIGICWDQWFPETARCLALNGAELLFYPTAIGSEPILDTDSCGHWQRTMQGHAAANIVPVIAANRYGLEEVTPSEENGGQSSSLDFYGSSFMTDETGAILERAERQEEAVLLATYDLDKGASERLNWGLFRDRRPEMYRQITD

SEQ ID NO: 10343 - protein, 337 aa, Glycine max
LFYNKNNDSLITVSVYASENFCSLKCRSTKIEYIRRGKPDAGFPLFQSESLKWPGFVEFDDVNGKVLTYSAQDCIYKVFDLKNYTLLYSISDRNVQEIKISPGIMLLIYNRTSGHIPLKIISIEDGTILKVFNHLLHRNKKVDFIEQFNEKLLVKQENENLQILDVRSSELMEVSRLEFMTPSAFIFLYENQLFLSFRNRTVSVWNFRGELVTSFEDHQLWHPDCNTNNIYITSDQDLIISYCKADSDDQWIEGTAGSINVSNILTGKCVAKITAISSSAKADECRSSGCSCKKSHSCLMRSPVAEALEDITALFYDEDRNEIYTGNRHGLVHVWSN

SEQ ID NO: 10344 - protein, 450 aa, Bacillus anthracis
MSTHVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGRDDFGTSELEENPAYQYAVVRNALYNKGKTIEMLINYEPALQYFAEWWKQLFGESEGKDQKGIFPSSANFSTDLHSLGQYVQEGRRDLFETVLKVGKSTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 10345 - protein, 135 aa, Brassica napus
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGRA

SEQ ID NO: 10346 - protein, 275 aa, Gibberella moniliformis
MLEDPAHQDVARWGKDGDTFVVVENEKFTRSILPKHFKHSNMASFVRQLNKYDFHKVRQTNDSGSAANGANTLEFKHPNFRVGSKDDLDNIRRKAPAPRRTQATEDFTTSHHISVMTEQLTATQQQVQQLQELFTEVSQTNRLLVNEVLTLQKMLNAQKQSQHEMLNYLSPSNNRHQQSMHLNVGTSPLDGSDDSAPELRRARELLSSVTPDQIADRELERLQGVYGSPADSAVVIPQASMPMMHDPMNDINRYPVYPVGQTVGIDPFHSDHIHK

SEQ ID NO: 10347 - protein, 112 aa, Prochlorococcus marinus
MKKIEAIIRPFKLEDVKIALVNLGIVGMTVSEVRGFGRQKGQVERYRGSEFTVEFLQKLKIEVVVADESVDGVIKAIAEAAKTGEIGDGKIFVSSIETVLRIRTGESDDSAL

SEQ ID NO: 10348 - protein, 219 aa, Methanococcoides burtonii
MSKDILEKGAIVQRDKETFAIAPHITGGIATPDLLRKIADVSEKYGAAAIKVTSAQRLAIVGLKEDDLDNAWDDLGMKPGAAIGLCVRSVKICPGTTFCKRGQQDSVGLGIKLDEKYHGMELPSKFKIGVSGCMNSCAENAIKDVGIMGTPKGFTVMVGGSAGLKPRLADTIAEELDEDEVLSLVDTIISFYKSHAKKQRIGKVIEEIGLDAFKKEVGL

SEQ ID NO: 10349 - protein, 535 aa, Oryza sativa
MGMEVAAARLGALYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 10350 - protein, 321 aa, Colwellia psychrerythraea
MKYFPVFLDGSKINAMVVGGGDVAARKIELLLKTTTNITIMAENVTDGVERLINENKLNWLKHNYQAGLLTKITLVIAATDDTTVNEQVYHEAVEFNILANVVDQPALCTYITPAIIDRSPMIIALSSSGSAPILIRMLREQIEKILPQGYGRLADFSLKFRDHVKARIKGIRNRRTFWENTLRGSIGQALLDGKHQEAEQLLIVSLKEKIAPPQGEIIFIQTLEGNPDNLTLKAHRALQFADAVFYDDDVNIELIEYVRRDAEKYPQSVSSTLMLNYQHALELAQEGQQVIYLLSGNEELPSNAALISSGISTTIITNGS

SEQ ID NO: 10351 - protein, 332 aa, Onion yellows
MKNENQKAKTKTKENKKIAVLTSGGDAPGMNAAIRALVFESAKQGFEVFGVKDGYLGLFNNQIEILNPQTFPRVLNVSGTFLGTSRFLDFQNNLDVRKQCAQNLKTLGIDKLVVIGGDGSYKGASKLHELGIKCVGLPATIDNDICATDFTIGFSTALNNIVDAIEKLRDTSVSHNRCSIIEVMGRHKGDLALFGGLAAGADVIVTRENLLSQKTICQKIKSLRQANQRHAIVVVTEHIFDVASLAKEVENYSGFETRAQVLGHIQRGGKPTAEDLVLAFRMGSYAVSLLQQNIFNCAVGTCGLNLHYTTFGDLFEKTYEKNELFNVVAKLL

SEQ ID NO: 10352 - protein, 426 aa, Onion yellows
MLKLNLEGIYNFLDWHNYAQTFAPQIKVIHQKLHQDQQLKEKYLGWLELPLHFDFQELEKMKQLKNSHPNLDVLVVIGIGGSYLGAKAGIEFLQTPFKKTKPEILFAGHQASGNYLTNLLHYLKDKNWAINVISKSGITLEPALAFRILKKEIEEKYGKQLAKNRIFVTTDSQKGVLLNLALKEGYQTFVIPDSVGGRFSVFTSVGILPFVFANLDVVSMMKGALQAYHDTFQEDLFQNQAYQYALARYLLHTQQNKKMELLVSYEPHLLSFSEWWKQLFAESEGKEEKGLFVGATNNSTDLHSLGQFIQEGTKMLFETVLNVTSIKDDCVVPHIPNELDNLNYVAGKTYSQINQKILQATKQAHIEGKVPNLEIVIPTLDAYHFGYLAYFFQKACAMSGSLLGINPFNQPGVEIYKQKMFALLKS

SEQ ID NO: 10353 - protein, 319 aa, Zea mays
MDLVVESVVHGRLPVRPSRFPLLPGSLPSTTVALSAAFSGRPCPPIVRRNAPAVVPFAKKKRNEYIEDPPDEEVADDFTDELEEDFDDAKEDEGDVMDDDEEYEDDYDFEDDFESDDEQDLYAGDGGAGGGISLAGAWWDKEALALAEQVSASFNDDLKIYAFKTAANLTIRVRIEKMSTRYGSPTIDDIEAYTIAYRAKLDEAESAGKIPKNISLEVSSPGVERVIRIPEELERFKERAMYVRYTTASDEATTPQEGDGVLTLISYDMDLRECTWGIADVKINRQQSGKGRPLSKKQREWRLQTPFESLKLVRLYSEC

SEQ ID NO: 10354 - protein, 705 aa, Colwellia psychrerythraea
MLNPITKKFQLGKHTVTLETGAIARQASAAVMASMDDTCVLVSVVGKKEAKPGQDFFPLTVNYQERAYAAGKIPGSFFKREGRPSEEETLIARLIDRPIRPLFPEGFTNEVQVIITVVSVNPEIAPDIISLIGTSAALAISGLPFSGPVGAARVGYTDGQYILNPLQSELPTSQLDLVVSGTDSAVLMVESEADVLSEEVMLGAVVYGHEQMQVAVSAIKEFKAEVNTPSWDWVAPVKNAELLAKIAELSEAQVNEAYQITEKAVRYEKIKEIRSSVLEALLAENADVDVQEAKDLFHDLEKTVVRGRITDGNPRIDGRDPESIRALDVMTGVLPRTHGSAVFTRGETQALVTATLGTQRDAQRLDTLMGDKTDPFMLHYNFPPYCVGETGFVGSPKRREIGHGRLAKRGMLAVMPSLEEFPYAVRVVSEITESNGSSSMASVCGTSLALMDAGVPIKASVAGIAMGLVKEGEKFVVLSDILGDEDHLGDMDFKVAGTTGGITALQMDIKIEGITQEIMQIALNQAKAARTHILSVMDEAIGGHRDDISEFAPRIHTMKVSQDKIRDIIGKGGATIRQLTEETGTTIEIEDDGTVKIAATSGEQAEDAINRIKALTAEIEVGTLYTGKVVRIVDFGAFVNVLPGKDGLVHISQISEERVNNVSEVLTEGQEVKVKVLEVDRQGRVRLSIKEAMEKPAAEATPAAE

SEQ ID NO: 10355 - protein, 97 aa, Rhodymenia palmata
AVKYTVTLSTPGGVEEIEGDETTYVLDSAEDQGIDLPYSCRAGACSTCAGIVELGTVDQSDQSFLDDDQLNDSFVLTCVAYPTSDCQIKTHQEEKLY

SEQ ID NO: 10356 - protein, 266 aa, Myxococcus xanthus
MREQTRGRVFLVGAGPGDPELLTLRAARVLREADTVVHDRLVHPGVLEHARPHARLIYVGKEGGGDSVSQEEIHVILIAQALLGRRVVRLKGGDPFVFGRGGEEALALEEAGIPYEVVPGLTAGTAVPAAAAIPVTHRGVSGAVTFATAYRGGSAPAWDFLAKAQTLVLYMAGSRLEETVRALVGAGRSASTPAAVVEAGTWAHQRVVEAPLSHIAQAATRDAIGSPSLLIVGEVVSLRGRLPSLVAQGTSEHGHAPARVAEGGHE

SEQ ID NO: 10357 - protein, 599 aa, Arabidopsis thaliana; identical to SEQ ID NO: 368

SEQ ID NO: 10358 - protein, 533 aa, Ostreococcus tauri
MSVAQRLTPPTCARARVRTRASTTPPEVKRAIDAARWRAGLEPASNVPWTACQVVRGEIPPELTGTLYRAGPGRCRLGSTKYAHWFDGDGYVSAIELDAGDNSVRCSGRYVETARWRRQRDADGGDGGNDDTVGSSGVAMRGAWTQASSVMANLGRFPTNPSNTSIIAHAGEVLACCEGGAPVAMDPATLATKGEISFGSSLPMGFSAHSKQDPRDGTLYTWGLKKPPFIGISVAKVSANGEVLKVVDMPFPTGVPEFALLHDCAMSENYLTFFMCPWVLPKENIAGALSGLSSFGHSFRWSDERETWMVVVRKSDLSVVHAKNVPAFSSYHTCDSYEENGKLKVLYCKLRGSRAELEKNFGDMYASEWTAAQYNDLHEMTIDIATGDVTDAIAMPTNADGERDMTKMIGMEFPLVSPLTQSRHKPKYVYTLANTCGEHGYFDSIQKLNLETKTAETRLSPSGCFPHECAFVPQSDGVDEDDGYLVHVEYDASRAAANVLILDAKRVQDEPVAEIQLPMHIPYSFHGAFVPKM

SEQ ID NO: 10359 - protein, 97 aa, Sambucus nigra
ASYKVKLITPDGPQEFECPDDVYILEHAEELGIDIPYSCRAGSCSSCAGKLVAGSVDQSDQSFLDDEQIEEGWVLTCVAYPKSDVTIETHKEEELTA

SEQ ID NO: 10360 - protein, 417 aa, Hyphomonas neptunium
MTDTAPARLPGKNAFFFVLVTVFIDHLAFGLIIPVLPTLIQDLANVPASGATLWIGGLAATYAVMTFLFGPLIGALSDKFGRRPVLLVSMAMLGLDFLLMALAPNIWILFLGRALAGISGATYSTANAYIADTTTPEERGRAFGFIGASFGLGFIFGPVIGGLLGELGPRIPFFAAVGLAFLNFLYGVFVLPESLPKARRRNLNLKRANPLGAARHFSKLPKVSWFLIASGIFFLAHTVFPATWSVHGEIRYDWSPMQIGLSLGLVGVGAATVQAGLMGFILKRLGSVRTIMFGYCVTIIAMTGFAFAGQPLFAYLIIPFSALGGVTMPAANALMSSLTPPDAQGELQGAASSLNALGMIIGPLIMSGALFSFSREDAPLQFGGAAFLLAAILTALAFLPFLRGVAANRDVLPAAAP

SEQ ID NO: 10361 - protein, 96 aa, Scenedesmus quadricauda
ATYKVTLKTPSGDQTIECPDDTYILDAAEEAGLDLPYSCRAGACSSCAGKVEAGTVDQSDQSFLDDSQMDGGFVLTCVAYPTSDCTIATHKEEDLF

SEQ ID NO: 10362 - protein, 420 aa, Unknown
  marine gamma proteobacterium HTCC2080
MTVSIENSVKELGRQAREASRIVAASTAAARNQALLAIRDSIADNRNDLLSANAQDLAAGVKSELAPALLDRLELNAQSIASLMVSLEQVAALPDPVGAIDGVRTMDSGIRVGKMRVPLGVIGIIYESRPNVTVEAASLCLKAGNAAILRGGSEAINSNLALGRCIQEGLTSAGLPAAATQVVATTDRAVVDALIRLSGYVDMVIPRGGKGLIERISGAATVPVLKHLDGICHVYIDGQACPDRAQAITVNAKTQRYGTCNTLETLLVDEAAIALLPPIADALAAAGVELRGCPKACAASASVSVLASEADWQTEYLAPVLAIRVVAGVDGAMAHIAEYSSGHTESIVTENHGTAMRFLREVDSSSVMINASTRFADGFEYGLGAEIGISTDKLHARGPVGLEGLTSSKYVVFGDGHVRQ

SEQ ID NO: 10363 - protein, 146 aa, Silene latifolia
MASTLSTLSVSASLLPKQQPMVASSLPTNMGQALFGLKAGSRGRVTAMATYKVTLITKESGTVTFDCPDDVYVLDQAEEEGIDLPYSCRAGSCSSCAGKVVAGSVDQSDQSFLDDDQIEAGWVLTCAAYPSADVTIETHKEEELTA

SEQ ID NO: 10364 - protein, 231 aa, Raoultella terrigena
IFTKKDEDGKYLVDVILDEAANKGTGKWTSQSSLDLGEPLSLITESVFARYISSLKDQRVAASKVLTGPQAQPASDKAEFIEKVRRALYLGKIVSYAQGFSQLRAASNEYSWDLNYGEIAKIFRAGCIIRAQFLQKITDAYEENAGIANLLLAPYFKQIADEYQQALRDVVAYAVQNGIPVPTFSAAIAYYDSYRSAVLPANLIQAQRDYFGAHTYKRTDKEGVFHTEWME

SEQ ID NO: 10365 - protein, 558 aa, Bacteroides fragilis
MCGIAGIFNIKIQSRELRNKALRMARKIRHRGPDWSGMYCGGSAILAHERLSIVDPQSGGQPLYSSDRKQVLAVNGEIYNHRDIRAQYAGRYEFRTGSDCEVILALYRDKGIHFLEELNGIFAFALYDEEKDEYLIARDPIGVIPLYIGKDAEGHVYFGSELKALEGFCDEYEPFLPGHYYHSKEGTMKRWYTRDWMEYKEENDKQADSRSPTRQIQDALENAVHRQLMSDVPYGVLLSGGLDSSVISAIAKKYAAKRIETDGASDAWWPQLHSFAIGLKGAPDLIKAREVAEYIGTVHHEINYTLQEGLDAIRDVIYFIETYDVTTVRASTPMYLLARVIKSMGIKMVLSGEGADEIFGGYLYFHKAPDARAFHEETVRKLSKLHLYDCLRANKSLAAWGVEGRVPFLDKEFLDVAMQLDPEIKMAPGKVIEKKVLREAFADMLPSGIAWRQKEQFSDGVGYSWIDTLKEITATAVSDEQMAHAAERFPIHTPMNKEEYYYRSIFEEHFPSESAARSVPSIPSVACSTAEALAWDTAFKNLNDPSGRAVKGVHEEAY

SEQ ID NO: 10366 - protein, 429 aa, Thermoplasma acidophilum
MLSIAEVSTKAYVGSKVSIRGWVYRIRSSGGVTFVVVRDSSGIIQCTARKNELPEDVYDTISSLGIESSVEFHGTLKEDRRSPSGYEIAVDSFRVYQKNDVFPITKDQGEEFLLDNRHLWLRSREFTSVLKIRSTIFRSFADFFYENGYYQVQTPFMVSTAVEGGSTLFKVDFFGEPIYLNQSAQFYLETMIYSLEKVFTIAPSFRAEKSRTRRHLTEYWHAEAEVAWIDNNEMMDIEERMIYYIVSRVTEDNEDELKMLNRDPEVLKAMKPPFPRIRYSEIIKVANSIGLPLKYGDDLGADEERQITMKYDRPIFVTNYPKDLKPFYMPVDPENPGEVLNHDMLAPEGYGEIIGGSQRIWNYDELMQRIREANLDESAYYWYVDLRKYGSVPHSGFGLGLDRLAMWIMHLDNIREAIPYPRTIRRTKP

SEQ ID NO: 10367 - protein, 486 aa, Oryza sativa
MDNSVSDRSFLIDSDEEDDAAAAVEDGKRRGHGGDESDDGSDSSSSCGTPRVAAAGGGGRGRGSQPSSYTQQWPQSYRQSIDMYSSVQSPNLSFLGTPTLSRLSNSFLTASFRGKPPEIISGLIKPLLPTTAAAAAADDEGDRRQQQHEDGRKSSQYLLPPRRPSSLQKIPEDQKPLVVGHHEVGPYRQCTYTQGVLNGVNVLCGVGVLSTPYAVKQGGWLGLIILALLAVLAWYTGILLKRCLDSKEGLETYPDIGHAAFGTTGRIVISVILYMELFNIGNIFIGPNVSLQACCIEYLILESDNLSKLFPNAHLIIGTCTINAHILFAILTTLIVMPTTWLRDLSCLSFISAGGVIASIVIVACLFWVGLVDHIEAKDEGTALNLPGIPIAVGLYGYCYSGHGVFPNIYSSMKKRSQFPAVIFTCIALSTVLFAGAAIMGYIMFGESTESQFTLNLPSNLVASKIAVWTTSSLAFSVTSGDKSNN

SEQ ID NO: 10368 - protein, 220 aa, Capsicum chinense
MANDEVILLDFWPSMFGMRLRIALAEKEVKYESKEEDLRNKSPLLLQMNPVHKKIPVLIHNGKPICESIIAVEYIDEVWKDKAPLLPTDPYERAQARFWADYIDKKFFDSSRKIWTTKGEEQEAAKKDFIECLKVLEGALGEKPFFGGDNFGFVDVALIGFYSWFFAYETCGNFSTEAECPKFVTWAKRCMQRDSVAKSLPDQHKVLEFVQTLRKKYGIE

SEQ ID NO: 10369 - protein, 809 aa, Leptospira interrogans
MEEIKSSTIIPENIAVLGGGPMGIYLSTYLSPKAKEIYLWYDDRKRAAKIEKERIATILEDSISIPENVRIQSEFDFLKNGSWALIIAVPSRLMEGILDELSKVLDKNSSHFIFTFTKGLLSSSTRKKTNCITYSEYLQKLCVAGKFKNIEYTAVNGPNLLGELKRGHHSFYCLASSGTQSIEIFETLFCGSRNHTKTYEDLIGLEVSGAMKNPIAIACGIASGIPECGSNFEGELISLGYSEIITLLKALEIPIQPVQEYGLADLIASCTSRYSRNKAYGHRFVHKLISGEDRPNLIERIELFFNPAEFIQKEVSQSESHVEGAFALASIISLAEEKKVEIPLYDTLFQILTRRVSPTELIRFVSKSTSDEVHHISKIATKRSGLGMASGKKFQEALSKNVLRRINGQPGMTDRILKQSSLLIKSLEKRYQEAKESNDVTDLLQIPKEIQFWSEVEKKFQETGNKDLTKILDFYVTEIADDYKPFLRDTLIHLIAPARYVLSGFKSGAGLPKIGGCVKEVKALASRYDILYTPTHRSHLDSIEVAFGLKWLGLPVPRYAADKKVMATPGLASVLKSLGAYMVDRKRNRNILYLECLTQYSTMMLEAGIPTLVYPEGTRSRTGGILPIKTGILSTSVEAYKHTGSEVIVVPIVLSYENVPEDEEFCGKDKKSGFKDFFYKRKEVYMDLCEPIPVSRYIHEEDPTGSIGFEITQGWKKYRRILPNQLVARMIVESGGEVNTNELRNLIKETLLTKKGNYLIQDSNEILKRGLKILKQKKIISLENGNLKILDKNLIQYYANMCSDESSYS

SEQ ID NO: 10370 - protein, 216 aa, Wolbachia endosymbiont
MLAIKTRVKTAKGRKLSSTRWLHRHLNDQYVQKTNKDSYRSRSAYKLIEIDNKFKLLQAGQKIVDLGASPGGWSQVASQKGVKVVAIDIKPVNTISGVKYIQYDINELETLRERFKDQKFDVILSDMAPESCGLKSLDHIRIMLLCEAALNFAKHFLNYGGKFVVKIFQGESDKDFYNELKKMFKIVKYFKPKSSRSESTEMYLVGLGFISNSFPI

SEQ ID NO: 10371 - protein, 350 aa, Unknown
  Acidovorax sp. JS42
MRVGVLTGGGDCPGLNAVIRAVTKSLIHHGHCEVLGIEDGFEGLRGEASRARLLTWDQVSGIVHMGGTILGTSNSANPLKDEATLAQVERNVRALGLDVVVAIGGDGTMSLAHGLARIGLQCVGVPKTIDNDIALCERSFGFDTAVATATDAMRRIESTAYSHHRVMIVETMGRHAGWLALESGIAAAADVILLPEIDYDLQPIIERCRRREQRQRYTVICIGEGAKERGAGLTVREQVAHSPDPVRLGGVGHVLRQRLQPHLQSEVRTTVLGHVQRGGDPTAFDRVLATRFGHRAAQLVIDGQFGHMVTLQGGHIASVPIAQVANTQRKVPLDHELIAMARAIDVCLGE

SEQ ID NO: 10372 - protein, 369 aa, Streptococcus pneumoniae
MKYKRIVFKVGTSSLTNEDGSLSRSKVKDITQQLAMLHEAGHELILVSSGAIAAGFGALGFKKRPTKIADKQASAAVGQGLLLEEYTTNLLLRQIVSAQILLTQDDFVDKRRYKNAHQALSVLLNRGAIPIINENDSVVIDELKVGDNDTLSAQVAAMVQADLLVFLTDVDGLYTGNPNSDPRAKRLERIETINREIIDMAGGAGSSNGTGGMLTKIKAATIATESGVPVYICSSLKSDSMIEAAEETEDGSYFVAQEKGLRTQKQWLAFYAQSQGSIWVDKGAAEALSQYGKSLLLSGIVEAEGVFSYGDIVTVFDKESGKSLGKGRVQFGASALEDMLRSQKAKGVLIYRDDWISITPEIQLLFTEF

SEQ ID NO: 10373 - protein, 1622 aa, Magnaporthe grisea
MGCETGTNEGQGYSLPSAPQLTINHDVAQDLDSSGPEKLLEVWFAPSPSALPLGTKENGLKSVPSDNWVEMLDIVNCKILSVVQSSVVDAYLLSESSMFVFPHKIILKTCGTTTLLLGLAQLLRIAAVDAGFPVHNASSVEDEKAAATPYRVFYSRKNFLFPDRQRGPHRSWKQEVKYLDSMFEGGSAYMVGKMNGDHWYLYMTSPGSTALTPPQTPPAGELMRIPTGLQTAASREDDETLEVLMTDLDPENAKQFYLEQASALACKQATLAQQAREEAHAALDKAASTDEQLVSEALTTEGHALGTVVSDTCGLSDVYPKSKYPDARIDAYMFEPCGFSANGVVPAPPDATGAQGGNEHYFTVHVTPEPNCSYASFETNVPGGQNGRETADIIGHVVGIFKPGRFSVTLFEGKGRRGENGTKADQRLRVDNVPGYRQLDKIVHEFDDYDLVFRFYQREGWVGKEGARPQYPTDIITDRFTRQKHADKIVHRQLHRQQHLQKVTTFAGWGRDCKDTPPTSGPSMGVAADGGFAAGAVDFRHYWLRCQLHRAERARGPAGIVPGAGVFVLCVAATRNLPVDRQRALQHPLQSWATVVARIALVFWILSAIAVPASFVKVDKKTTDLRPGHVDIVVCVFGLISISIVTFVIEYSDAPFTLPRITPEHITCRLSALGAEEAFVSVSRQCSAEMVPEKLKEIKEADHSQHPTAQEQIQKAAFARQKFGKPAAGEQPNRVVSSPLGPRPMPGTIPEGIEPRALIPVTHQPREPITQVILPQEPRPAHVGVQAEGWKTQWRELKSEAGITSEGSTPTITPATSVSTRPYSHARRAPSRDALRRQQNERISLRVPPMPRGQPVRESRYAGQQGRPLYPPLPPSRPPLGCNGTSAVRAHQGALSPGMQRTPPAPTAALNPRPRMPTGAVPPGHYRRVFEQPVRGPRAEDFVSGRDGLDNGMISQSMRQSSNPRVPGSWNEVTIYTCRARKVRCDGRRDVCTNCERLGFGCTYHDAGPGSGSTEGETAMSSALALALPRRRVRLACANCHSRKARCSGSLPKCDRCRARGIECVYQPGKRARPSSVIVGETTGNASSTPDRPGSGNGTDLGSGTRDFGARCIDEAETTVLRELEKPSTLKLQTLVLIIKHRILMRRFPSAFMLHAVASRFAVALRLNHENPRLCFLAQESRRRLMWAVYMIDTGIAAGHPDFGLWENKAPSNIRIQLPCNERNFDFDLPEVTEPLEQPAPGPDGVIPPMTDDIGFLALHIRVCLLRSRILQYTKNMIHGNPTPEQIANLPARFAELESQLGAFAARLPVSFNWSEANVRLRAYSPRLCVFVMTHMWWEQCHIDLYRVAAHSGVSRDALPQNMMARIEASHPGFAGICRRQIFEHARAMADMFSLMLALDGVPVTDMDLPVCLYQCARMLYLSLHTSGVEFGITTESVQEMGNVCLRVLKQTITAPAAMGIRADLERLLATGIPSDLAPSIPESPEIPIGGQGRNQVPALLGQSVLPNNANQIGMNAVQYQSPIASLPNGAQTSSTQTVAGPFQAASTQPTPMAQLDQPTTETDEAPKSPSAASLHPSNAFDGPFDGLDFNMDQFGMDSQSWYSIEWLGGEFSSAAGNGQPT

SEQ ID NO: 10374 - protein, 420 aa, Streptococcus pneumoniae [sequence omitted]

SEQ ID NO: 10375 - protein, 294 aa, Thermobifida fusca
MQLGMIGLGKMGGNMAARLRDKGHEVIGYDVNPELRDVDSIAELVERLSAPRTVWLMVPAGEPTRNTIRELADLLDEGDLVIEGGNSHYRDDRVHADELARRGIEYLDAGVSGGIWGRENGYGIMVGGSAENVARAKPIFDALTPEAGSGFVHAGEIGAGHFVKMVHNGIEYGMMQAFAEGYELMAASGIVKDVPGTLASWRQGTVVRSWLLDLLVRALEEDPELEQLRGYAEDSGEGRWTVQAAVDHAVPAPVITAALYARFASRQEDSPAMKVIAALRNQFGGHAVVKKNTD

SEQ ID NO: 10376 - protein, 555 aa, Photobacterium profundum
MCSVFGILDIKSDPSALRATALEMSKKMRHRGPDWSGIYSSDKAILVHERLAIVDLNSGEQPLYNQDKTHILAVNGEIYNHKELSAEFAPDYPFQTESDCEIILALYKEKGPELLDYLNGIFGFILYDAVEDAYLIGRDHIGIIPLYQGYDEHGNYYIASEMKALVPICKTISEFPPGSFLWSKKGEPTRYYKRDWMEFETVADAPTDKVALKEALESAVKRQLMTDVPYGVLLSGGLDSSIISAITKKFAARRIEDDEKSQAWWPTLHSFAVGLEDAPDLKAAKIVADSIGTVHHELTYTIQEGIDAIRDVIYHIETYDVTTIRASTPMYLMSRKIRAMGIKMVLSGEGADEVFGGYLYFHKAPNKREFHEETVRKLLALNMFDCARANKSMAAWGIEARVPFLDKEFLEVAMRINPEDKMCGNGKMEKHILRECFEDHLPESVAWRQKEQFSDGVGYSWIDSLKEVAEAKVTEQQLETASFRFPYNTPTTKEGYMYREIFDELFPLESAAKCVPGGPSIACSSAKAIEWDESFKNSADPSGRAIAAVHNEAYK

SEQ ID NO: 10377 - protein, 236 aa, Zea mays
MAGGGDELKLLGTFASPFVMRAKLALSFKGLSFEDVEEDLANKSQLLLESNPAEKKVPVLIHNGKPVCDSRVIVQYIDEAFSGNGAPLLPADPYERAVARFWAAYVDDKLLASWLQAARGKTEEEKAEGLKQTLVAVETMEAAFKTCSKGKPFFGGDRVGYLDVTLGGLVVWVHAGAALYGMRLFDDAKSPFLAAWVERFGALDAAKAVLPAVERVVEFAKMRQAQAAAPATAGGN

SEQ ID NO: 10378 - protein, 453 aa, Listeria monocytogenes
MEASLLKKNQSIELTIEDLTHDGSGVGKIDGYPLFIPNTLPGEKVTAKIIKLNKNYGFARMETIESVSADRVEPPCAVYSKCGGCSLQHLSYEGQLAFKRNQVEETMKRIGKLNVDVPETLGMENPWRYRNKSQVPVGFVNGKLTAGFYQKRSHAIIDMSTCLIHNEQGDFAVQKTREILAKYGTEPYDEQTGKGDIRHIMTRFAHTTGQLMIVLVTTKERMPFKEEIVRELVEQLELTSIVQNINPHKTNVIFGDRTKTLWGKDIIEDTIHGIRFAISARSFYQVNPIQTEVLYQQAIDAAELTGEETVIDAYCGIGSISLCLAKKAKHVYGVEIVDQAIQDARANAELNELANTTFETGKAEEVIPAWYKAGIVADVLVVDPPRKGCDEKLLETILAMKPKKVVYVSCNPGTLARDMKILTDGGYVAKKVQPVDMFPMTTHIEAVTVLHLN

SEQ ID NO: 10379 - protein, 464 aa, Bacillus cereus
MDKNLKKDLKIRHITMISIGGVIGAGLFVGSGAVVHSAGPGSIVSYALAGLLVIFVMRMLGEMAAVNPTSGSFATYAREAIGPWAGYTIGWLYWFFWVIVIAIEATAGAGIIQYWIPQIPLWLLSLILTILLTLTNVFSVKSFGEFEYWFSFIKVISIVLFLCLGLAVILGFVPGTEAPGTSNLIGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKSFLKLNSSGVPVRAVLFGTFFAYIGVVFSYISPDKVFLFLVNASGGIALLVYLVIAVSHLKMRKKMGKVEQQNLKVKMWLFPYVTYVTIAAIIAVLVAMFAIDTLRSQALLTMFVTVLIILSYFIFNRNKNSTVLNPKSKNEESVRF

SEQ ID NO: 10380 - protein, 524 aa, Solanum tuberosum
MFKSNNVTARLFERQICTPAPGTSIHRARRFYENIVPSYTIYDVECPDHSFRKFTDDGLYLVSFSRNHQDLVVYRPTWLTFSCKEEDCDTHDLPLKARKFESFFTQLYSVTLASSGELICKDFFLYMESNQFGLFATSTAQIHDAPPTGGAIQGVPSVEKITFHLLRLEDGAILDERVFHNDYVNLAHSIGAFLYDDLLAIVSLRYQRIHILQIRDSGDLVDVRAIGEFCREDDELFLNSNSQVLVNHVGNGFHHSLPESETSFLSGIKQRLLSFIFRGIWNEETDQTMRVQCLKKKFYFHFQDYIDLIIWKVQFLDRHHLLIKFGSVDGGVSRNADSHPSFFAVYNMETTEIVAFYQNSADELYFLFELFSDHFHVSSKSSLHMNFMSSHSNNIHALEQLRCTKNKATNFSQFVKKMMASLPFSCQSQSPSPYFDQSLFRFDEKLISAIDRHRQSTDHPIKFISRRQPNILKFKMKPGPEAGSTDGRTKKICSFLFHPILPLALSVQQTLFLQASVVNIHFRR

SEQ ID NO: 10381 - protein, 602 aa, Oryza sativa
WPPPPPPPPPPSPATTSASASALASPPSPSAPSPPPPPSPSPAHPLTPSPPPRHRALRASASAAPAAPPSQPPKPVLQGAAIKPLVATIGTGVLIWLVPPPAGVARNAWQLLSIFLATIVGIITQPLPLGAVALLGLGAAVLTRTLTFAAAFSAFGDPIPWLIALAFFFARGFIKTGLGSRVAYAFVSAFGGSSLGLGYALVFAEALLAPAIPSVSARAGGIFLPLVKSLCEACGSRAGDGTERRLGSWLMLTCFQTSVISSAMFLTAMAANPLAANLTAGTIGQGIGWTLWAKAAIVPGLLSLVFVPLILYLIYPPEVKTSPDAPRLAKERLEKMGPMSKEEKIMAGTLFLTVGLWIFGGMLNVDAVSAAILGLSVLLISGVVTWKECLGEAVAWDTLTWFAALIAMAGYLNKYGLISWFSETVVKFVGGLGLSWQLSFGVLVLLYFYSHYFFASGAAHIGAMFTAFLSVSSALGTPPLIAAMVLSFLSNIMGGLTHYGIGSAPVFYGAGYVPLAQWWGYGFVISIVNIIIWLGAGGFWWKMLGLCAFTNLHLQIAELVVVLSQNTKFKFKMANFAQVLYLTFTGVACLNMGSLCLTFSGV

SEQ ID NO: 10382 - protein, 412 aa, Solanum lycopersicum
MNALAATNRNFKLAARLLGLDSKLELSLLIPFREIKVECTIPKDDGTLASFVGFRVQHDNARGPMKGGIRYHPEVDPDEVNALAQLMTWKTAVANIPYGGAKGGIGCSPSDLSISELERLTRVFTQKIHDLIGIHTDVPAPDMGTNPQTMAWILDEYSKFHGYSPAVVTGKPVDLGGSLGRDAATGRGALFATEALLNEHGKSVAGQRFVIQGFGNVGSWAAKLIHEQGGKVVAVSDITGAIKNEKGIDIESLFKHVKETRGVKGFHDAHPIDANSILVEDCDVLIPAALGGVINKDNHKLKIKAKYIIEAANHPTDPEADEILSKKGVTILPDIYANSGGVTVSYFEWVQNIQGFMWDEKKVNDELKTYMTRGFKDVKDMCKTHNCDLRMGAFTLGVNRVARATVLRGWEA

SEQ ID NO: 10383 - protein, 958 aa, Myxococcus xanthus
MSSPARFPKNLVACLLFLSGGTALVYELVWSKYLGNVLGNSGQAHAVVLATFMGGQALGAFVFGRTADRAKNPLALYGLLELGVGLYALVFPYVLDVLGALWLNVAPSVPDGWRLGPRLLVSSASLLIPTLLMGGTLPALVRHFASSLSGVRYELARLYAVNSLGAAVGVFIAGTKLVPAIGLSSSAGLAAGLNILVALASLGLARRFPPALVPGQTPPAEAGDAEVSYPRIAVRAALIGVLLSGFTSMLYQVTWIRLLSIVLGASTYAFTLILTAFIMGIGLGSFWLMTRKGQVDSLRLFGRLQVALVASICVALPLYVRLPHLFRKAQWMMTRSLDTWPLFQVLTFGFCCLVLLVPTFFMGAAFPAAARVATAKVSEVGRQLGGVYLWNTVGTITGSALGVLVLMPWWGMEGNFIAGVAANLLGAGLAFHAAPGRPAQHARALWPVAATAVLALVVLGGMSGWAVRLSGIASIRSHEKPPESYAKLVADTEAIIRPIFYQDDTFATVMVADVPVDNLRFMKLNGKVDASNGSDVETQVVAGHLGALLHPREPKSVLLVGAGAAITAGSVLVHPVEHLDMVEIAPAVIDAARLFKADNRNAVDDPRTHVHVDDAKTFMALSPRKYDLVVSVPSNPWVSGVSGLFTRDFFQTVDRHLADDGVLVQWIHTYESNEDLIKLVVRTLRDTFPHATTWLGPHDLVMVASRKPLAFDAARLAERMGHPEVRKDLSRVGINDVFALLSKQVHSEAGQLEFAGEGPINTDDHNLLEYASPIAFFVSNLDVRVKDERRAPEGADRLFLHDYVQQHPPTAEQAAGLYRNIERYHAPNDPMVRGAAAQWRRLAPDSPESALALGKAALAQQDLTLAASLLEPEVARGGRAPALVTAYLRLVTAQTWASRTMWTPVGALHDTVALGREVASRHPDDEHLARALRSLCEALPRSSCEGTAQTPVAAPGGP

SEQ ID NO: 10384 - protein, 510 aa, Colwellia psychrerythraea
MTQDKVLCDIGFIGLGVMGKNLVLNLADNGFNIAAFDLSDEKVQAVIAQDEAENATDTPRVYGCSSYTELLSQLKAPHLIVLSVPAGAPVDQVCENLIGAGIQPDDIIIDTGNSLWTDTVAREKKYKSNFLLFSSAVSGGEVGARFGPSLMPSGSPYAWARVKPIWEAIAAKVDAETGKPIDRTKPGQVITEGEPCAAYIGPAGAGHYVKMVHNGIEYADMQIICEAYHVLKSGLNLTCDEIADIFAQWNDGPLDSYLMEISVEVLRHKSTDTNTPLVELILDKAGQKGTGLWTAMSSLEVGCPAPTIAQAVYARSISSFKELRTQASSLLEGPQLAPLSAAEQQQVIEQLHDAMYCAKICAYAQGFQLMKLAAKEHGWVLDFASIAKIWRAGCIIRAAFLQSITNAYERNENLDNLLLDDFFVKELNKRQLNWRKAICHATMQGVPIGALSSSLAYYDSMRSETLPANLLQGQRDFFGAHTFERIDKTAGKKYHVQWSTKGKETILVDG

SEQ ID NO: 10385 - protein, 1329 aa, Unknown
  Vibrio sp. Ex25
MDNKTFKLSTIAKTVLPLISVAVISGCGSDSTNEDTTNPGSGLYPAGENEVVIYYKRDVASASTASDYEGWGLHLWNGEGCTSTDLDAMGIPGTGTDWSAPHPFDGINDTYGAYYVLKVNPDASDPHECMNFILHKGDEKAFGSANSKVELTKIGESKGLFGFHGSSELYYEPIEERPVDIDGQKAHWLDANTIAWEAVANADSMKLFYSLSNDIKMDEDKQISGGTAVELTKAGDLSDGLKSRFRHLASLQAAGIDVDDATLRTILKSQIVMVAYNANGDVISATEVQKPGVLDAVFADSKAGNAIGQELGAIVEGGAATFKLWAPTAQDVDLIIYDENLAEEATVAMTEDPATGIWVSEAQSNVVNKYYRYQVKVYHPTTGVVETRLVTDPYSMSLSKNSRYSQVVDLDDPSLMPQDWKNYARPMVKKDEDHVLYESHIRDFSFNDSKGTPSLDGKYLALTESERESVSHLQALKDAGLTTLHILPAFDIATVDEDADQRVDITDTVGKLCGIKPEASICETEDDGKVIEEVLNSYDPTTGKAQALMNDLRMLDSFNWGYDPYHYTVPEGSYATDPNGSKRILEFREMVQATHKMDLKLVMDVVYNHTNASGVNEKSVLDKIVPGYYHRLNVNTGGVENSTCCDNTATENLMMGKLMVDSLMVWADDYKVDGFRFDLMGHQPKDVMVYALEKVREIDPNTLFYGEGWDFGEVAQNARFDQATQVNMAGTEIGTFSDRLRDAVRGGSPFDGGVDSEGKHPLRFNQGFGNAAYPNEETKTDAESVNGRLHNQDLVRLGMAGNLADYVLLDYKGETKLGKNVDYNGAPAGYTKVPSENISYVSKHDNQTLWDNNAYKIATGTSSAERARMQSVSLSTVMLGQGIPFIHMGSELLRSKSMQRDSYDSGDWFNRVFFDGSDNNWNVGLPREDKDGANWELIKTIVGDSTAKPDSTDIELTKQQFLELLKIRSTSELFRLDTAQEVMNRVDFRNVGKDQVEGLIVMSIDDGTSAGADLDSNYDAIVAVVNSTSTEKSFKVAGATGFELHEVQQNSADDIVKGASFANETFTVPALTTAVFVQPQDGAQGAGLPVNTDNKDVSSIPPYGETVVYVKGTMNEWSDSSDWAMTFIGNGMYSVTGVLEAGEHEFKFADSGWANPNIGCDAADLASGSLDLGSAGNCTLSVAETGKYNFTLNALHVQDESVEKPVVSVTKSADAPTFGERALYLRGTITTWDTPAQDSTAKFSYVANDVYSLDIDLAAGNYEMKVASADWAADTNFGGEGSVELGKALTMEVGGGSANLKIAIAEAGNYNFHFNAADKSAPIVTVTKN

SEQ ID NO: 10386 - protein, 607 aa, Bacillus thuringiensis
MCGITGWVDWKEDLSNQHVILKKMANRIQHRGPDAEGFWFSPRAAFAHRRLIVIDPEGGTQPKTFRAGDYTYALTYNGEIYNFRELREQLRKCGHLFETHSDTEVLLHAYLEWKEDCVQHLNGIFAFALWDDQKQRLFLARDHLGVKPLFYTERNNSIIFGSEIKALLAHPSVPAEIDADGINEIFGLGLFRTPGCGVFKHIQEVRAGHSITFTRDKKVVTKYWNLESKIHTDSIEDTSSRILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKTTSPLLLHEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPHYLQTIRNLTLEMCSNKNSPIFSLINHSTLLAIADGSNKEINNFEARSAMEYMLQVNEWLKTYHIHIA

SEQ ID NO: 10387 - protein, 501 aa, Ostreococcus tauri
MKTSSHGVVWVKAKSDRGSWWPASEVSDRNAAIERLGELALRHFEKRNDARVFQYFGSGGSYELEKTSTACVAWEEGLEHKYHQMKPLSAKRAKAIENAFAFAERGDLSAEIEANVVWWSEPLPPPIECVEEVAVVSRRKRSREAEVNVEADDVETPVNDGDEFKFPIAASEFRAGVKRTEYTPPLSVLSMGKPAAYERINRSTFVSVPPPVKMHISESATCECKQPLRDGGGTPTLRNGCGPECINRKLRFSCDSRTCPCGDACSNRPLSQLPTPKTKIIRTENRGWGLMLQEPVTAGTFIVEYTGEILNEADVANRLWLDKQEGEENFYLMEISTNYVIDAKFKGSLARFINSGCHPNCETQRWVDASTNETRVGIFAIEDIPAGTELTYDYHFAHFGDASATSFVCMCGHPKCRGTLDAAKREAHFHRRIRVEAMLAPKSAGPKARKKKQYVKGTIVDHDRAKNRYKVEVDASADEAERVCIWVRLEGEGAAKHAWLK

SEQ ID NO: 10388 - protein, 183 aa, Clostridium perfringens
MIRDIKDDVKKVLYSEEQLAKRVKEIAEEISKDYAGKDLLVVGILKGSVLFTSDLIKNITIPCEIDFMAVSSYGNSAQTSGVVRILKDLDSDIENKHVLIVEDIVDTGTTLSYLLEYLKARKAASIEIVALLDKEARRTSNISAKYKGFDVPDEFIVGYGIDYAEKYRNLPFIGALKEEIYNK

SEQ ID NO: 10389 - protein, 159 aa, Unknown
  marine gamma proteobacterium HTCC2080
MTTAYDFQASAANGDNINLDDYRGRVLLIVNTASKCGFTPQYEGLEALQAQYHDKGFDVLAFPCNQFGGQEPGSEEEIVEFCTTRFSSTFPIFAKIEVNGADTHPLYGWLKGQAKGIMGTERIKWNFTKFLINTDGKVAKRYGSQTKPAAIAKDIEQLL

SEQ ID NO: 10390 - protein, 418 aa, Idiomarina loihiensis
MLKSEMNIADFDADLWQAMQDEVERQEQHIELIASENYTSPRVMQAQGSQLTNKYAEGYPHKRYYGGCEFVDKVEDLAIERAKELFGAKYANVQPHSGSQANTAAFMAMMEAGDTFLGMSLAHGGHLTHGSGVNFSGKLYNAVSYGLDESTGEIDYAEVEKLAQEHKPKVIVAGFSAYSGIVDWAKFREIADKVDAYLMVDMAHVAGLVAAGVYPNPVPYAHVVTTTTHKTLAGPRGGLIISGSDDEKLHKKLNSAVFPGNQGGPLCHVIAGKAVAFQEALQPEFKDYQKQVLVNANAMVKTMQARGYKIVSNGTQNHLFLVDLIDKDITGKDADAALGNAFITVNKNAVPNDPRSPFVTSGLRLGTPAITRRGFKEAEAEQVANWICDVLDDIADESKINQVREQVKALCAKFPVYG

SEQ ID NO: 10391 - protein, 112 aa, Unknown
  Synechococcus sp. WH 5701
MKKVEAIIRPVKLDDVKTALVNAGIIGMTITDCRGFGRQKGQVETYRGAEFTVEFINKVKVEVVVDDDKVDTAIDAIAGPSRTGEIGDGKIFVTAVEKAVRIRTSETGTIAL

SEQ ID NO: 10392 - protein, 91 aa, Glycine max
  misc_feature (30)..(30): Xaa can be any naturally occurring amino acid
IAFLKSRRGFVRIAMEKGKPLVPVFCFGQXPIPFKHPMHVVVGRPIELEKTPEPTPEEVAKIHSQFVEALQDLFERHKARAGYPNLELRIV

SEQ ID NO: 10393 - protein, 644 aa, Xanthomonas axonopodis
MSTCPIDPPALRAAFAGPLDPQHAEVLLSRYDQHASRLLDALHALYGQRADYASWLAQWLGEVGDIARQRPQALQTLDSTRHAGWFGQPHMLGYSAYADRFAGTLQGVAERVPYLQELGVRYLHLLPFLRARAGDNDGGFAVSDYGQVEPSLGSNDDLVALTSRLREAGISLCADFVLNHTADDHAWAQAARAGDARYLDYYHHFADRTVPDRYEATLGQVFPHTAPGNFTWVDDTAQWMWTTFYPYQWDLNWSNPAVFGDMALAMLRLANLGVEAFRLDSTAYLWKRIGTDCMNQSEAHTLLVALRAVTDIVAPAVVMKAEAIVPMTQLPPYFGSGVDEGHECHLAYHSTLMAAGWSALALQRGDILHNVIAHSPPLPRHCAWLSYVRCHDDIGWNVLQHEACGNAAQPPFSLRDVARFYANAVPGSYARGESFQSSGDGVHGTNGMAAALAGIQAAQEAGDAAALAVAVDRLVLLYAIALAMPGVPLIYMGDELAMVNDPGYRDDPHRQHEGRWLHRPAMDWQLAAQRHDAKSLSGTVYRRLRGLIRQRAALGALAADQALASIALNDPRVFALTRGDSFIALHNFSDQLLDVELAAIGVDGWTLLAIDDAIGGAAARGDGSIVLPPYGVRWLQRGTEHAPE

SEQ ID NO: 10394 - protein, 384 aa, Candida albicans
MSKVPAIYQLGHLPIKDHVFSPDRSILAITKGNDVEVYQISPSNLSSKPQLIAVLKDHDKTVTSVDISPDGSKILTCSQDRNALVWEYANGEYKPTLVLLRINRAATVCRWSPDGSKFAVGSSDRIIAVCYYEEENDWWVSKHLKKPLKLTITTIDWHPNGVLLACGSTDGHVRVFSGYIKGIDAKPDPSVWGTKLPFQTLCGDYTNETNAWIHGVKFSPDGNALAYVSHDSSVGFVYPQGEGLPPRAIFNVKTDNLPFKSVVWLNDQQVCAGGFTCNLVVFQGDENGWQQAYQVEEQKDLTKEVPHSKLGEGDDDDEEISSHQALNMFKQMDLKGRVSKPSAGGKPAKALNTIHQNTINSIRNFDQGRVSTSGIDGKVVIFNV

SEQ ID NO: 10395 - protein, 176 aa, Thermus thermophilus
MPEEIATLAGGCFWCTEAAFKLLRGVLEVVPGYAGGHVPHPTYEEVCTGTTGHREAVQVRFDPGVLPYADLLRYFFAVHDPTSEDRQGPDVGPQYSPAIFYHSEEQKRVAEAVMRELAPLYPKPIATKLLPFTTFYPAEAYHRDYFARHPEAPYCRLVIAPKLEKARKAFKSLLRP

SEQ ID NO: 10396 - protein, 152 aa, Haematococcus pluvialis
VTPELLAANGVSFGEPVWFKAGAQIFQDGGLNYLGNPSLIHAQNIVATLAVQVILMGLVEGYRMNGGPAGEGLDPLYPGEAFDPLGLADDPDTFAELKVKEIKNGRLAMFSCFGFFVQAIVTGKGPIQNLTDHLANPAENNAFAFATKFTPQ

SEQ ID NO: 10397 - protein, 146 aa, Phaseolus vulgaris
MGAFTEKQEALVNSSWEAFKGNIPQYSVVFYTSILEKAPAAKNLFSFLANGVDPTNPKLTAHAESLFGLVRDSAAQLRANGAVVADAALGSIHSQKALNDSQFLVVKEALLKTLKEAVGDKWTDELSTALELAYDEFAAGIKKAYA

SEQ ID NO: 10398 - protein, 445 aa, Mesorhizobium loti
MNNSADVAIAEPGTFGRSSLVHVDCRVHELLLRQRRQERTMLKLIASENFASSAVLEATGSIFANKYAEGYPGARYYAGNEIVDELETLAIERLKALFGSEHANVQPYSGSPANQAVYRALLSPRDKVMGLPLPEGGHLTHGWSVNFSGTDYQRVPYGLHEKTQQIDYDRLRETARRERPKLIWVGGTAYPRVFDYAAMAEIAAEANSYLVADIAHISGLVVAGVHPTPVRHCDVVTSTSHKSIRGPRGGFILSRDEDRYQPLYHPKTKHNLAKRIDRAVFPLLQGGPHMNTVAALAVALQEAANPSFRVYGQQIVNNAKALAEALLDRGYDLVTGGTDNHMLILDLRGRPLSGKAYAERLARAGIITNFNMVPGDPRDPAVTSGIRLGSPAVTSMGMREGEMVQIAAFIDLVCRQPDDEEVHANVRRDVADFCAAFDVPGISDR

SEQ ID NO: 10399 - protein, 600 aa, Triticum aestivum
QMKRQEEASWHVRMLTQEIRKSLDRHTILYTTMVELSKTLHLQNCAVWMPNEARTHMILTHHLREREITESHSGSIPISDPDVVEIKATRGAKVLGEGSALGTASRCNPEAGAAVAVIRMPMLRVSNFKGGTPEMMETSYAILVLVLPEDGSLGWGEQELEIVEVIADQVAVALSHAAVLEESQLMREKLAQQHRDLLQAKHEAVMATEARNSFQSAMYDGMRRPMHSVLGLVSMMQQESMNPEQRLVMDAIVKTTSVASTLMNDVMQTSTMDREHLSLVRRPFSLHSLIKEAVSVVRCLCGSKGVDFEFQVENSLPERVVGDEKRVFHIVLHMVGTLINQCRAGCLSLYVNSYNEMDERHNNQDWMLLRRANFSAGYVCVKFEIRIKKSRNSLLDASASQISQEPNASSSEMGLSFNMCKKIVQMMNGNIWSVSDPEGLRETVMLALQFQMQHVTPVSGASSDLYRLSPIPNFNGLHVLLVDGDDTNRAVTHKLLEKLGCRVFSVSSGIQCMTSFAGGESSFQLVLLDLTMHTMDGFEVALAIRKFRSNSWPPLIVALAASSDDNVRDRCQRSGINGLLQKPVTLAALGDEVYRVLQHN

SEQ ID NO: 10400 - protein, 296 aa, Arabidopsis thaliana
MAEHLASIFGTEKDRVNCPFYFKIGACRHGDRCSRLHNRPTISPTLLLSNMYQRPDMITPGVDAQGQPLDPRKIQEHFEDFFEDLFEELGKFGEIESLNICDNLADHMIGNVYVQFKEEDQAAAALQALQGRFYSGRPIIADFSPVTDFREATCRQYEENNCNRGGYCNFMHVKLVSRELRRKLFGRYRRSYRRGSRSRSRSRSISPRNKRDNDRRDPSHREFSHRDRDREFYRHGSGKRSSERSERQERDGSRGRRQASPKRGGSPGGGREGSEERRARIEQWNREREEKEEGGA

SEQ ID NO: 10401 - protein, 127 aa, Zea mays
  misc_feature (4)..(4): Xaa can be any naturally occurring amino acid
  misc_feature (35)..(35): Xaa can be any naturally occurring amino acid
  misc_feature (38)..(38): Xaa can be any naturally occurring amino acid
  misc_feature (42)..(42): Xaa can be any naturally occurring amino acid
  misc_feature (44)..(44): Xaa can be any naturally occurring amino acid
  misc_feature (46)..(47): Xaa can be any naturally occurring amino acid
  misc_feature (49)..(50): Xaa can be any naturally occurring amino acid
  misc_feature (56)..(56): Xaa can be any naturally occurring amino acid
  misc_feature (60)..(60): Xaa can be any naturally occurring amino acid
  misc_feature (64)..(64): Xaa can be any naturally occurring amino acid
  misc_feature (66)..(68): Xaa can be any naturally occurring amino acid
EEAXNAHYNSVAIIDADGTDLGLYRKSHIPDGPGXQEXFYFXPXDXXFXXFKTKYXTIGXVGIXWXXXFPRGCRQIATPLLLLPPPSQSTPFAPSMPFLFLLIHPPRSPFALIIFLMLYLSIFSPLC

SEQ ID NO: 10402 - protein, 426 aa, Hordeum vulgare
MAAADTSRVFLILIIALVMVIVVLLGICWRFLGPGIMRRLLRPRRCPSEVPEYFSGNMSGNLRTITYFDYVTLKKATKDFHQKNQLGRGGFGPVYLGKLDDGRKVAVKQLSVGKSGQGESEFFMEVNMITSIQHKNLVRLVGCCSEGTERLLVYEYMKNKSLDKILFAAADAPAPASAPPFLNWRTRHQIIIGIGRGLQYLHEESNLRIVHRDIKASNILLDDKFQPKISDFGLARFFPEDQTYLSTAFAGTLGYTAPEYAIRGELTVKADTYSFGVLVLEIISSRKNTDLNLPNEMQYLPEHAWRLYEQSKILELVDGRVQGGEGFEEKEVMLVCQIALLCVQPYPNSRPAMSEVVRMLTMKTDQSIPAPAKPAFLDRKNLNGDRDAASSDTATMEMMRSPAGYWMMTPSPMLEVDRPYDMSFGK

SEQ ID NO: 10403 - protein, 151 aa, Brassica napus
MFSSGNVTSRVFERQIRSSPPGASVNRARKFYENLVPSHTLYDVECPDHCFRKFTEDGLFLISFSRNHQELVVYRPSWLTYTSVSDDTLPPLPRRASRFDSFFTQLYSVNLASANELICKDFFLYFPSRRFGLFATSTAQIHDSAPFPPPV

SEQ ID NO: 10404 - protein, 335 aa, Glycine max
MGRQPCCDKVGLKKGPWTAEEDKKLISFILTNGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPATHKPLPNANEQNQNQTRQDQQLHHQPVELEEPNQQPLQVDFDPKVDPNKEPEKPETSLESSTITEEAKEEDQIITPLFDTMELMNGFCTDEVPIIEPHEILMPCAPSSSSTTSSSSSSNSTNFLEDLQLPDFEWSCNYNDNNTITNNNNNEDKDDDNNNNSSMALWDDDIIGNRYWLINEDDDSDENQVFDASLTQFSKMFMESESWGYGF

SEQ ID NO: 10405 - protein, 702 aa, Oceanicola granulosus
MHNMDAPAAITNRPILAGSDVPLGATWDGSGTNFALFSAHATKVELCLFDNRGRREIERIELPEFTHQVWHGYLPDVRPGQLYGYRVHGPYAPEAGHRFNPNKLLLDPYALQHKGDLRWHDSLFGYKLNHDKADLSFDRRDSAFVMPKCVVVDTAHTWGGDIRPDVPWGRTVVYEAHVGGMTMGHDGIEQPLRGTFEGLADPRVIDHLVSLGVTSLELLPVQAFYDEGYLTEKNLVNWWGYSTLGFFAPAPRYLTPDGSLHEFKLMVRRLHEAGIEVIMDVVYNHTAEGSERGPTLSFRGIDNASYYTLADDPRYYFDTTGCGNSLNLRNSRVLQMVMDSLRYWVEECHVDGFRFDLATTLGRDRDHYSEHAIFLEAVRQDPILAGVKLIAEPWDTGPNGYQVGNFPPGWAEWNDSYRDTTRAYWKGDSGTLPKLASKLLGSADTFNHAGRRPWASVNFITAHDGFTLMDLVSYNDKHNEANGEDNRDGHSHNLSWNCGVEGETDDPGITALRDRQRRNLMATLLFSQGTPMLLMGDERGRSQGGNNNAYCQPGEMNWFGWEASERDEAFERFVRGLVRIRKTKGLFLAERYLHSGADARHNRFAKWLRPDGQRMEEGDWDNGISKAVGLLMHEHDTFLYMVLNASETDLDVYLPGGDKRRWSKLVDTLEGVADPKGRDRIDGGTVPLPARSMLLLETTGRG

SEQ ID NO: 10406 - protein, 501 aa, Ustilago maydis
MKITLAASPVILALSLVTTVVSTEAAKEASLSHHKSNPVAANDYIHVDKLRLRDSSNRTYYLTGMNYWACMNLAADSDAGGVHKRFIAELDQMASAGINHLRIMAGSEGAPTKQPFRMNPPLQPSPGVYNEKIFVGLDRCLAEMAKRGMRATMTLNDQWQWSGGFAQYVSWANGEEKYAYPPSWNFTAPPQREGAPGRGWGNYTTTGSFDEYAAYGNRIYTDPNAERMFKAHIRKVLNRRNTVNGRLYKEDATIMTWQLANEPQPANQKNLLGPYKLEYAPNPIDPLLAWIDRVSTYIRLHAPRQLISTGFEGKQGEWYWKAVHQPKNVDYGTIHVWVQNWGIYDMLDSSRANLDQAKAFATEIMGNASRWAGEIGKPVFLEEFGMARDNWQNNVTAGEYEYASKATTRNKDEYLAHIIGLAVKSFKSKKGGFIGTAPWAYGGVYRPETQKVNEFGMWWAGDPPHEAPGWYDVYETDYAMQIVKQQKESIGKFIAGVRSKS

SEQ ID NO: 10407 - protein, 120 aa, Triticum aestivum
DSVLDLARCTIVSELSNKDFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPGYCYSE

SEQ ID NO: 10408 - protein, 1101 aa, Oceanicola granulosus
MTIADRKLLAAEPGATEADWYKDAVIYQVHVKAYQDSNNDGIGDFAGLMRRLDHVQELGATAIWLLPFYPSPLRDDGYDIAEFKAVNPQYGTMDDFQGFVDEAHRRGLKVITELVINHTSDQHEWFQRARRAPKGSPERDFYVWSDDPSRWMDKTRVIFNDTHDSNWSWDPVAEQFYWHRFFDHQPDLNFDNPKVLEEVLDVMHFWLDKGVDGLRLDAIPYLVERDGTNNENLPETHDVLKAIRADLDKHYENRMLLAEANQWPEDTRPYFGEGDECHMGFHFPLMPRMYMAVAQEDRYPITDIIRQTPAIPEDCQWAIFLRNHDELTLEMVTDRERDYLWNFYAEDRRARINMGIRRRLAPLLQNDRRKIELLNSLLMSMPGTPIVYYGDEIGMGDNYYLGDRDGVRTPMQWSADRNAGFSRANPQQLYLPTIQDPVHGYEAINVEAQQSSPTSLLNWVKRMIAVRQRHPVFGRGEIELLYPRNRKVLAYLRRHEGETVLCVANLSRQAQAAEIDLSEFSGRVPVELTAQSPFPPVGELPYLLTLPAYGFYWFLLADEEAAPEWHTPYTQMLPDFLTLTTRDGTIGSALRDASAAQFERQTLREYLPLQRWFAAKEERIGKVTMHKLAEMGQGRHMLSVVDVASSGGEARYFLPVSAVWGEDALTIGPRLPATLAKLRQANRVGAVLDGAVDEEMARTLLGAMVESTTMPASEGSIEFRGSPGLAELAADPGEPRLLSAEQSNASIAFSDKVILKLYRRLRGGVQPDIEVARFLTEETDFEASPALLGTLDWIAPDGTPTTLAAASEFVRNQGDAWRYVTEALERDMEREEMTEAASQEGDEEEAHVMGGPLDLGAVLGRRTGELHLALASGAPGSAFAEEPMGEDDLASLVDDVRGELADVFDRLAAHRDGLDETGRALADEVLDARGRFDARLEALRGLTPSGGRCRIHGDYHLGQVLVVETDVMIIDFEGEPTRSLAERQAKSSPLRDVAGMLRSFDYALWSTVRRRLELGADPERTLAGIEGWRAVTQGAFLDAYRETLGDASLRPDAEFEEALLDLFLIQKAAYEVAYEMSMRPDWIDIPLRGLLSLLGENGESS

SEQ ID NO: 10409 - protein, 1628 aa, Myxococcus xanthus
MKVSCPSCQTNYNIDDKRIPPGGAKLKCARCQTTFPIKLDAVSAPAAPAPAEPAIPLPGAASAAPQAAAIPLPGAASAQAAAIPLPGAASAQPAAIPLPGAASAQPAAIPLPGAVSAQPAAIPLPGAPASTGAIPLPGAAPTHSAAIPLPGAPASTGAIPLPGAAPAHAAAIPLPGAAPARAIPLPGAPEAFSAAPHAAAIPLPGAAAPQPAAIPLPGGAPEADPFAFDMGEPAQAAAIPLPGSAPEADPFAFDMGEPAQAAAIPLPEADPFAFDMSEPEQAASVPLPGSAPEADPFGFDMSEPEQAAAIPLPEADPFAFDMSSPAEAAAAMPQADGPSGMDAFGDDFGEPVRDTREVTRVVSIPLPSDAYREPPSAPASGYGVNEPAGTARDFDFETVEAPVEDAAQGYGVNAPAGTARDFDFADDALPVPVEAPPAEDAFAFDIESSSGAAQGLPPQADPFALPPPEAYAQSAAPVDDPFALPPPDMASQTDAFAPDAYAMPSAPEASPYAMPPPAAGAPSFDFAELPVPANADPFALPPPGADFSDLPAPAAPQALEFADLPAPAAPDLSFDFNEPPAPGADPFAVDFSAPPAPALAAAPFAADFGSAPAPGADPFAIDFSEPPAPAPAVAVNPAVDFGDVDFGAPSSPGIPDSLEFDPTARPDDDLEADLSDPLPPPPNAGPADGLEMLSFIDDAAGKDGGAQAGAKVRRFHVRRRSGKVFGPFDEGVIVKMLEDGQLLGNEDVSLDSETWSAIGTVPTFAAAIQRLMEGPAKLVTPTAAPAAAVVDAPRVDGASPQANMKRLEQLYEGRMAAVSVVDRSGNTEKWKKRVPLMIAAGVAVVVAGIGAGTEFGTRYGAFGRRALFPARLSDGSAEAKQVADAKQALLTDTFASYKQARELSAKVLAQKEYPEVRSLWCQSVYYLQRRYAAGNPNEMSRCRQDMADIEFLGEKDVDVIKASAAIALTSRQADSVIPTLSGAYGREDTQGDVELAFLLAEAYSQKRDEKRALDTLNKVLAKNPKSAKAHHAVGNLHQAADRADEAAAAYAAALEADPKHVASAVELAAVELLVRKDVAKGTEAVERALAEDVQSALGPAELARARGLKGVAMFQKHQPKEAEAELKAALEMDAKSTFLRGQLARVLRAQRNFEGALPIYKALATEEPNNLEFADGHITALVMTGKMQDALEAVKKANGVFPNEARIAYLYGRIEDALDNLSDTEGHYKRAIAADDTLVEARLYLGRFYLAQRRNAEARPQLEEAAKKAPENAGVRAGLGELALAENNTLLAQQEFERSVKLDPILADAHLGLSRVALLTDDLETAKAEANRALELDPHLLKDGRLQRGLVLWRLGQLEEAVAELEKAKAEDPRSTTIPITLGAVLLERGDLPGAESNLGLALSNEPSNHEALYYLALVKARRLEFTQALDNMRKAVERAPNRPDYHYAYGVILRDAKNLPDAMSAWRKTVELDGSHADAHEALGHALLEGGQFDEAIASFEASLKADPRRTRVLGSIGDAYFAAARWNDAIKRYQSALKADPKLTYVYYKVARAFTEQAQHAKAIDWYRKATSLDSENPMAYYYLGFAYKERNKRREAVQAFKDYLSRKPDATDRKDIEDEIYDLQN

SEQ ID NO: 10410 - protein, 576 aa, Oryza sativa
MRGNLREQKAYHMEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRIGPFTVPPASLATFNVVAVLIWVPVYDAVLVPLARRATGNDRGLSHVQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVSVLNLLQFLHCSIRDRGQ

SEQ ID NO: 10411 - protein, 566 aa, Oryza sativa
MEAGAADEETPLIQQLPPEEQCSQYTCDGTVNSDKKPALKQSTGHWRACFFILGAQFAETLCFFMVSKNLVTYLTSALHESNIDAAQSVSIWIGTSFFTPLIGAFLADTYWGRYWTTVISLFIIIIGMLIVTVSSSPLFLNSSYYNWNICRATVYTGLYLTAVGSGCMKPCIPAFGADQFDSADPVERLAKGSFFNWYYFSMNVGSLLSTTLLVWVVANIGWSVGFAIPMLLSGFGIALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKMLLRMFPVWVSMVVFFVVTAQITSMLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNNTLSS

SEQ ID NO: 10412 - protein, 656 aa, Unknown
  Vibrio sp. Ex25
MTRLLSRPYPLGATVNKEGCNFSIHAPGNKDIKLALFADDGSYALHDLPNEYADIRHTFIPDIKPGQKYGYLVSHKEEPLLISDPYAKSIDKALHYHPPYSPAKSFDMPKCIVIEDNFDWQDTDHPRIPREEMVLFETHVKGLTQLHPEVEDKLKGRYLGLASPKMLAFYEQQNINTLQLLPVAACMHEPHLLEMEKVNYWGYNPYLFMVPDPRYAEKDAVTELKTTIRELHKNGIEVILDVVYNHTAEGGEGPTIFNLKALDSRFYIKHGNHFANYTGCGNTVDLTYQPALNLVMDTLRYWVSEFKVDGFRFDLAATLGRQGDDYNPEAAFFKAVAQDPILRETKLIAEPWDIGPNGYQVGNFPFGWNECNDKLRDISRSFWRGDQGYLKEFATRLMGSRDIYSAANWPYKLTVNYITYHDGFTLQDLVSYKHKHNEANGEENRDGHGDNRSENYGVEGETENLMIIATREKQKRNLIASLLFAFGIPHILTADVLSHTQGGNNNAYCQDNETSWLHWGETERKQHFKTWMSQMVANRNQYMVPFIRAFSGENRNNNRIFWRRTDGRLMEHDDWNRLSSVALHLGIGKEGQELVYLINQTNATARFKLPNERKQEWVTICDTNVRNLNPGHAEGEVLLSPTSMVILHYHPKSDQS

SEQ ID NO: 10413 - protein, 906 aa, Oryza sativa
MEAADEERAPLLHPQPQPSRGDADSEYTGDGSVDVNNQPALKRSTGNWRACFMILGVEFSENLAYYGISKNLVTYLTKVLHESKVNAARNSSAWSGACYLTPLFGAFLADTYWGKYRTVLTFLPIYILGLLTLMASTSLPSSMTSSDAGHQLHSVAVYLGLYLVAFGNGGVKPCTSAFGADQFDGGDAAELRRKGSFFNWYTFMINSGSLLASTVLVWLQDNVGWGISFVIVVVVMAFFLAVFFAGSRVYRYRPVRGSPLTGVCQVVVAAVRKWHLELPDDSSLLYEAQVADHRIKHTDQFRFLDKAAIVVTPSSLNGEKGNVAAAAAPGDADSEYTGDGSVDVNNQPALKRSTGNWRACFMILGVEFSENLAYYGISKNLVTYLTKILHESKVNAARNSSAWSGACYLTPLFGAFLADTYWGKYRTVLTFLPIYILGLLTLMASTSLPSSMTSSDAGHQLHSVAVYLGLYLVAFGNGGVKPCTSAFGADQFDGGDAAELRRKGSFFNWYTFMINSGSLLASTVLVWLQDNVGWGISFVIVVVVMAFFLAVFFAGSRVYRYRPVRGSPLTGVCQVVVAAVRKWHLELPDDSSLLYEAQVADHRIKHTDQFRFLDKAAIVVTPSSLNGEKGNVAAAAAPVSRWRQCTVTQVEEVKMLVRMCPIWACLVLFFSVSSQMSSTLVEQGTAMDNRVGPFTIPPASLATFHSIGVLLWIPVYDVALVPLARRATGKPKGITQLQRIGVGLAVAALIMAYSALVEERRLAAARAGAARTSILWQVPAQLMHGMAVVFTSIGKSEFFYDQAPRSMRSMCTALGQLAIAAGNYLSAFLLAVVASATTCGGDPGWIPDDLNKGHLDYFFWLMAALLLLDLLFFVFCAMRTREHCCFLIDPPKNVTLCMAFVGLYKN

SEQ ID NO: 10414 - protein, 139 aa, Petunia integrifolia
MNEFYEVELKVRDYELDQYGVVNNAIYASYCQHCRHELLEKIGVNADAVARNGEALALTEMTLKYLAPLRSGDRFIVKVRISDSSAARLFFEHFIFKLPDQEPILEARGTAVWLNKSYRPVRIPSEFRSKFVQFLRQEA

SEQ ID NO: 10415 - protein, 484 aa, Candida albicans
MVHLGPKPAQKRKGTFTDVSPQLLEALKPIQEQFTISADKLRAIVKHFISELDRGLSKAGGNIPMIPGWVMDFPTGKETGSYLAIDLGGTNLRVVLVKLGGNRDFDTTQSKFALPAHMRTATSDELWDFIAKCLKEFVDEIYPDGCSEPLPLGFTFSYPASQNRINEGILQRWTKGWSIDGIEGKDVVPMLQKAIKKVGVPIDVVALINDTTGTLVASMYTDPEAKMGLIFGTGVNGAYFDVVKDIPKLEGKCPSDIPPESPMAINCEYGSFDNEKYILPRTKYDVQIDEESPRPGQQTFEKMISGYYLGEVLRLILLEFAEEKKLIFKGQNLDKLKVPYVMDASYPSKIEEDPFENLSDVADLFREKLGIETTEPERKIIRCLAELIGERSARFSVCGIAAICQKRGYKTAHCAADGSVYNKYPGFKERTAQALRDIYEWPADVKDPIIIVPAEDGSGVGAAVIAALTEKRLKEGKSVGLLGA

SEQ ID NO: 10416 - protein, 401 aa, Xanthomonas campestris
MTALFPLLADLRGRAVLVVGGGRAAESATASLLQAGAVPLVGAPELTPALRGWAQSGQVRWLVGSFDPQWLALPDQPVWLTIAASDVPAVNAALRSVAGAQRLLTHEAAPAAAALPPIASEPPPPASRLTLTPGSVALVGAGPGDPGLLTRNAVRALRQAEVILYDRLVSPQILRLAQRAARCIEVGKSAQGHSTRQEQIHALMLEHARAGRRVVRLKGGDPFVFGRGGEELEFLHAHGIGFQVVPGITAAVACAAYAGIPLTHRDHAQSLRLITAHCKDSLDTLDWHALGQERQTLAFYMGVAGLDSIQQRLLQAGRAADTPFALVENGSRPEQRVVTGTLSQLAATARLHAVRSPALLILGDVAALSQSLHWFGAAPLTGQPAHSPIATPHAPTLAHAA

SEQ ID NO: 10417 - protein, 952 aa, Burkholderia thailandensis
MSNARSEFLIQQSKLTIKLQVRRTALMRAVMHAEGLWNRRIEPSPELLSRFDAHQGYAVLHTPQGAPAALALGIPAPGRSASTFAPYLALLETQLLMGDGQSPLPDDRVEGYSFSPDGTYLSLLWSREDQAPEAFIESHSASGVIGDAMRGIRYLRDASTIIPLRADRRTVWLPPHPDPLTGKPMIRVVQPAIDAAGKLFAIYVRSLPLDMFYSNLNDTPAGGTLTIVDRKGRVIIGSWNPPGRDGDVTDSALSIRSLGDGFDGLVERHENGMFVTSDQLPGTDWVLVHAYSWKTIAAALALRFSLMTGFAAGIIVMLWVLAIQFDRKGLIPNYRRAQRLLESEVLNRAILRTAPVGLGLLSAHDGSVLLQNNAMLELSARTSGEPLPNRLWDAYRQTTGRSNDEDGALLLHDLAIEREDSNPIYLQANVVAARYRGANVLLCTLLDISMRKESELKLKEARIASDQANKAKSTFLATMSHEIRTPLNAIIGNLELLRRSQLSNQQSERLQVVESCSNALLHIINDILDLSKVESGQMTLENIPFDIQALLQEIVDAYAPLAESKGLQLLSNLGEGVARYYSGDPARIRQILSNLIGNAIKFTERGHISVDVHQAKAAQGDSAIEIWVNDTGIGIRPDRIATLFDVYTQADTSIHRRFGGSGLGLPLCKRLATIMGGSIEVDSLPDFGTTVTVVLPLREARHATAMSSGPAVRRRDAPAHARPSLHVLVAEDHPANRALLRDQLEALDHRVDVVENGRDALRAFGEHQYDVVLTDLGMPELDGFGFAMFANKMRASIPIVAMTAHATAEDYRRSKKVGIAEIVLKPLSLTTLEKVLQRHAARTLAAEVVVADAGEAHAESRIRTLPPAVAAALRTATLQSIDKIAHALASRRFETIRQELHSIKGGFALTGNRFLIARCSAAEELAEREDLDTLRAAWRNLESSLLEALERL

SEQ ID NO: 10418 - protein, 319 aa, Xanthomonas campestris
MALYDNILDTIGRTPVVKLNRLAPDHVSLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLRVARPEVRITATEPAGAALLQGQDWKPHKIQGWTPDFVPEVLNREVAHEILSVEDTDAISVARRLAAEEGIFTGISGGGTVSTALRVAETAVPGAVILAMLPDTGERYFSTPLFADINEGSDDDWLAGLP

SEQ ID NO: 10419 - protein, 169 aa, Staphylococcus aureus
MNINTAYFAGGCFWCMTKPFDTFDGIEKVTSGYMGGHIENPTYEQVKSGTSGHLETVEIQYDVALFSYNKLLEIFFSVIDPLDTGGQYQDRGPQYQTAIFYTNDHQKELAETYIEQLKNTINADKAIATKILPASQFYKAEDYHQDFYKKNPERYAEEQKIRQEYKNKQ

SEQ ID NO: 10420 - protein, 659 aa, Oryza sativa
MAHRAGCLSMLLTAAVVLLALAPRGAAYPWQVCGTTGNFTANSTYQANLDAVAAALPRNISSSPDLFATAMVGAVPEQVSALALCRGDANATECSGCLATAFQDVQNMCAYDKDAAIYYDPCILYYSNVPFLSSVDNAASTSRVNLQNVTSDPGRFNGMVAALVNATADYAAHNSTRRYASGEAVLDRESEFPKVYSWAQCTPDLTPAQCGDCLAAIIAKLPRLFTNRIGGRVLGVRCSYRYEVNPFLNGLVMVHLTAPPIPTASPPAAAAAAAGEGKDYNVPRLVLAILLPTIAALVLINILVWLCFWRRMERLRSGATQPYSSNSAESENISSVESMLIDISTLRAATGCFAERNKLGEGGFGAVYKGTLPDGDEIAVKRLSKSSAQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVWEQWTARAVSEAVDPVMGGGFSWSDVMRCIHIGLLCVQENPADRPVMSSVVMMLGSDTVSLRAPSKPAFCASSGGTSSGTSTAASVQGK

SEQ ID NO: 10421 - protein, 112 aa, Bordetella pertussis
MKLVIAIIKPFKLDEVRMALSDIGVQGLTVTEVKGFGRQKGHTELYRGAEYAVDFLPKLRVEAAVPDHLVDQVIEAIEQSARTGKIGDGKIFTAPLEEVIRIRTGESGEAAL

SEQ ID NO: 10422 - protein, 79 aa, Glycine max
  misc_feature (68)..(68): Xaa can be any naturally occurring amino acid
NSYAGQDSRDKVHDLKNYAGLFSMPDRKAQEIKTSPGIMWLMNAKARSPVPLKILSIEDGTGSEACSXLPNRNKKEDAI

SEQ ID NO: 10423 - protein, 338 aa, Prochlorococcus marinus
MASSQAAPGTVLITGTTSGVGLYATKALLELGWRVVTANRSPLRSEAAAVKLGLPFGSPRQLQHIYMDLGDLDSVRNGVENLLNTLEKPLDALVCNAAVYMPRLAKPKRSAQGYELSMATNHFGHFLLIQLLLEHLSGSKRPVWQGRSWGFEAPRLVMLGTVTANYKELGGKIPIPAPADLGDLSGFEQGFRDPISMASGKRFKPGKAYKDSKLCNMVTIQELHRRYKDSPILFSSLYPGCVANTKLFRSTPKIFQWLFPWFQKLITGGFVSEDLAGKRVAQVVSDPEFGVSGVHWSWGNRQRKNRQQFSQQLSDRITDPKTSQNVWDLSMRLVGLSS

SEQ ID NO: 10424 - protein, 413 aa, Spiroplasma citri
MKVNSQIKKLIDLELKRQQDHVELIASENYVSEAILAITGSILTNKYAEGYPFHRYYGGCEYVDQVEQLAIDKVKELFQAEHANVQSHSGSQANAAAYYALLQPRDTILAMDLAAGGHLTHGYNVNFSGRLYDFHSYQVDPTTEMLDYDAIEKIAIEAKPKLIVAGASAYSREIDFKKFRAIADKVGALLMVDMAHIAGLIAAGLHQSPIPYADVVTSTTHKTLRGPRGGLILSKQKWAKKINSAVFPGNQGGPLEHVIAAKAQCFLEALQPDFKAYEAEIINNAKALAATLKANNLRLVADGTDNHLLMVDVKSSLGISGQMAEEILQKIGIICNKNMIPFDKESSMVTSGIRLGTAAMTTRGFGNKEFKHIGEIIYNVLKEPTENNIVKYQKEVKTLLNDFPIYSTWKLQE

SEQ ID NO: 10425 - protein, 487 aa, Escherichia coli
MKPSTEWWRYLAPLAVIAIIALLPVPAGLENHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASHATLSWGDWFLGMLPLSILLVLLVPWLAYVLYPPVLKSGDQVPRWAETELQAMGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVALIVVFYLLRYFFASATAYTSALAPMMIAAALAMPEIPLPVFCLMVGAAIGLGSILTPYATGPSPIYYGSGYLPTADYWRLGAIFGLIFLVLLVITGLLWMPVVLL

SEQ ID NO: 10426 - protein, 305 aa, Rubrobacter xylanophilus
MEIGIYGLGRMGANMVRRLLRSGEHRVVAGNRSPGPVDEAAKEGAEGAYSMQELVDKLEPPRVIWSMVPAGEPTEKTLMGFAELAQEGDILIDGGNSYFRDSVRRASALRERGLRFLDAGTSGGIWGLEVGYCLMVGGDRSAFEHVEPALKTLAPPDGYAYLGEAGAGHFAKMVHNGVEYAMLQAYAEGFEILKKSPYGYDLRALSSLWNHGSVVRSWLLELAERAFEKDAELQSIRGYVEDSGEGRWTVLEAIEEDVPANAIAGALFARFASRQEDSFAMKVIAALRREFGGHAVKEAGPGGGG

SEQ ID NO: 10427 - protein, 656 aa, Unknown
  Bradyrhizobium sp. BTAi1
MCGIAGLFRPGGADDSALAGIVGRMTAALAHRGPDASGSWVSGRQGIALGQRRLAILDLSEAGAQPMHSACGRYTITFNGEIYNHLDLRAELEDAAAAPNWRGHSDTETLLAAIRQWGLVPALQRLIGMFAFALWDAETRQLILARDRFGEKPLFYGWSGADLVFGSELKALAAHPGWAPSLDRAALTDFMRYSYVPAPATIWRDVRKLPPASFVAFVADAGPGTSPTAQSYWSLRDTVVAAQGDRISGESEAIARLEQLLSTAVKRQCLSDVPLGAFLSGGVDSSTIVALMQAQASQPVRTFSIGFAEGGYNEAEDARKVAQHLGTDHTELYVDARTAMEVVPKLPRIYDEPFADSSQIPTHLVAQLARRHVTVALSGDAGDELFGGYNRHVWGSALQARLGRVPMPLRRAIGAALGAIAPEPADTLLNMLQPVLPARLRVRHAGDQVAKLARIVAADGFDGLYRTLCSIDQDPRATVVAGEERASWAASEMKQLRGQISLLDRMTLADSLSYLSDDILQKVDRAAMAVALETRVPFLDRDVVEFSTRVPASMKVRDGRGKWLVRQVLYRHVPADMIDRPKTGFSIPLDAWLRGPLKSWAGDLLSPARLKRQGLFAPTRVTRMFEEHLSRRHNHAYWLWNVLMAEAWYDEWGRAG

SEQ ID NO: 10428 - protein, 467 aa, Haemophilus somnus
MTKIASVANILKGKITVGETVTVRGWIRTRRDSKAGLSFLAIYDGSCFDPIQAIVNNDIENYETEILRLTTGCSVVVTGKIVESPAEGQAVELQADKIEVSGWVDDPETYPMSAKRHSIEYLREVAHLRPRTNIIGAVARVRHCLAQAIHRFFHEQGFYWVATPLITASDTEGAGEMFRVSTLDLENLPRTDKGAVDFSQDFFGKESFLTVSGQLNGESYACALSKIYTFGPTFRAENSNTTRHLAEFWMVEPEIAFATLADNAKLAEDMLKYVFRAVLNEREDDLKFFEKHVDKNVITRLKDFINSDFAQIDYTDAIDILLKSGKAFEFPVSWGIDLSSEHERYLAEEYFKSPVVVKNYPKDIKAFYMRLNDDGKTVAAMDVLAPGIGEIIGGSQREERLEVLDKRIAEMGLKAEDYWWYRDLRRYGTVPHAGFGLGFERLIVYVTGVQNIRDVIPFPRTPRNANF

SEQ ID NO: 10429 - protein, 250 aa, Unknown
  Acidovorax sp. JS42
MSVTMREMLEAGVHFGHQTRFWNPKMAPFIFGHRNKIHIINLEKSLPMFQEAQKFAKQLAANRGTILMVGTKRQARELVAEQAQRAGVPYVDQRWLGGMLTNFKTVKTSIKRLKDMKAQQEAGLESMSKKEQLMFSRELEKLEKDIGGIQDMAALPDAIFVIDVGYHKIAVSEAKKLGIPLIGVVDSNHSPEGIDYVIPGNDDSAKAVALYARGIADAILEGRANAVTEVAKAVAAEGSDEFVEVDENAA

SEQ ID NO: 10430 - protein, 804 aa, Clostridium perfringens
MRKIIHINDQWFYANDYKGEYLKNEFDFSNFERVDLPHTNIELPYNYFDEKSYQFVSTYVKTLKFDNSVKGKKVFLDFEGVMIAAEVYLNGIHVGGHKGGYTNFSIDITDALKINEDNILKVVVDSTERPDIPPHGYVVDYLTYGGIYREVSLRVVEPIFINNLYARAYDCLKEEKRLELYIEINNFEKYRDDLEIVVDFGDDTFEETLSTKLPIEEGTSIKNIEIDQLNMVKLWDIENPKLYEIKVKLLKGSEVIDEYKDNFGFREAEFRSDGFYLNGRRVKLVGLNRHQAYPYVGYAMPQRVQEKDAEILKYELGLNIVRTSHYPQSVHFLRKCDEIGLLVFEEIPGWQHIGDEAWQAESIKNVEEMIKKDYNRPSIVLWGVRINESQDSHDFYVKTNAMAKSLDPIRQTGGVRYLENSDFLEDVYTMNDFIHSGGEKVLRTQSEVTGQVDKVPYLVTEYNGHMYPTKSFDQECKKVEHAYRHLRVINESFGLDEISGAIGWCAFDYNTHSSFGSGDKICYHGVSDMFRNPKYAAYSYASQKKVEDGVVLEPITLGAKGERDGGAILPFTVLTNCDYIKIFKDGIYIDTYYPNKEKFPNLPHPPIEVSHILSMDSEIPLTEEAKKEIKDFVLNKLKDSNLTNLAEEDFKYIEEFSERVNIPVFKIMSLVYKLAGGWGDKENSLIIKGFIDNKEVASKEIGELRSMNKLEVTPDNLELSLDKTSYDATRIVVKLLDNLGEVLFLNNDFIEVEIDGPLSIMGPSKFGISGGAVAFWVRTQGKTGLCKIKVKSMYFEEEISIEVK

SEQ ID NO: 10431 - protein, 327 aa, Wolbachia endosymbiont
MTISILGAGAWGTAIANSLSGKQNVILWTHNKTTFESISRTRESDKLLGCQIPENVSVKLAIKETVNASAMIFAVPTQSLRKVCQQLHDCNLKKDVAIILACKGIEKSTLKLPSEIVNEVLPNNPVAIFSGPSFAIEVAKKLPYSMVLACQDDTLGSKLISELQQENIKLHFSSDVVGVQICAALKNVFAIACGIVLGKKLGFNAHAALVTKSMNEVKTLYLAKTDSVSIDIDTLLGPACLGDLIMTCTSLNSRNLSFGFKIGSSNNSFDAQQTLSEGKSVIEGFSTAQSAFNLAEKLKIKMPICEAVYRLLYESASIEDTISVFVG

SEQ ID NO: 10432 - protein, 441 aa, Unknown
  Azoarcus sp. EbN1
MVHVNISPFKFWRDIERPMNGLHLIADLYRCGTTAAALTEREALETLCVTQCREAGLTPLGSYFYQFRDESGAAAGVTGTVVLAESHLAIHTWPESGGVTLDVYVCNFSRDNGDRARMVYRAVIDALRPAEIVGHEVVRGRLPEKGVAGPMPLPAVEGVIFEQLNDNAGYFTRGGKLIEKGRSRYQEYEVWETPQFGRLFRLDGCFMTSERDEFHYHENLIQVPCIAHPAPARALILGGGDGGSAEELLKQPAMAKIVIAELDEKVIEIAREHLQAVHRGALDDPRIELRIGDGFRYVMEEAPAAAERFDLIVLDLTDPVGPAEALYSEDFFRGCRALLAPGGAISLHIGSPAFQPERLRTLVARLRDVFAIVRPYFLYVPLYGTLWGFATASDTLDPAALSAAEVDRRLAERRIGALQHYNGAVHCAQFALPNHLRTLLG

SEQ ID NO: 10433 - protein, 292 aa, Thermobifida fusca
MATVVTIRQLLESGVHFGHQTRRWNPKMKRFIFTERNGIYIIDLQKSLSYIDRAYEFVKETVAHGGTILFVGTKKQAQEAIYEQARRVGMPYVNQRWLGGMLTNFSTVHKRLQRLKELEEIDFDDVASSGLTKKELLGLRREKEKLERTLGGIRDMNRVPSAVWIVDTKKEHIAISEARKLNIPVVAILDTNCDPDEVDYPIPGNDDAIRSVSLLTRVVADAVAEGLMIRSGGAPGSEKGAGEPLAEWERELLEGKTEAAGEEATPAAEAPAKEEKAQAPEEKKEAGSGEEA

SEQ ID NO: 10434 - protein, 928 aa, Oryza sativa
MLSVRCGGGGGGAAAVEEHGAVRHHRPLTPRQQQQLRTVVESLRLDPLEVDEGARLEIARQSYRAGDYKAALEHCNAVYRANPRLLENLLLLGAVYYQLREFDMCIAKNEEAVAIQPNCPECFNSIANAWREKGDVDNAIQFYVHAVQLRPTFADAWTNLANAYTRKGNLSQAAECCHQALALNPHLADAYCNLGDVLKAQGLYREAYSHYLDALNIKPTFANAWNNIAGLLMQWGDFNKAALYYKEAIKCNPAFYDAHLNLGNLYKVTGMRQDAIVCFQNAARAKPENAVAYVFSGNLGNAYHEQGQLDLAILSYRQAIHCNSSYVEAYNNLGNALKDAGRNEEAISCYQTCLALQPSHPQALTNLGNVYMERVSFWSTCRNMMDIAASLYMATLTVTTGLSAPYNNLAMIYKQQGNCNHAITCFNEVLRIDPMAADCLVNRGNTFKEAGRITEAIQDYFHAVTIRPTMAEAHANLAAAYKDTGLLEASIISYKQALQLRQDFPEATCNLLHTLQMSSLPSVQPFHAIAYPIDSTLALEISRTYAAHYSLVASRFGLPTFTHSYPVPISNDGRTSRLRIGYVSSDFGNHPLSHLMGSIFGMHNQDTIEVFCYALSQDDGTEWRQRIRSEAEHFIDVSSMSSDMIAKVINEDKIQILINLNGYTKGARNEIFALQPAPIQVSYMGFPGTTGADYIDYLVTDEFVSPLKFSHIYSEKLVHLPHCYFVNDYKQKNRDVLGPVCPHKRADYGLPEDKFIFACFNQLYKMDPDIFNTCPLCNGHTTGTDILWAGLPMITLPLEKMATRVAGSLCLATGIGEEMVVNRVSFFTSVNKNGRLLVWSVIVISGPEDWWQFRSWMIYADFMRKLERYAWAHLTAGIAVTELLMMSRGSAASALKLGSLVVVLFSEIVGLDSFKLQYPPCPVFVIHG

SEQ ID NO: 10435 - protein, 235 aa, Marchantia polymorpha
MKQKSWNIHLEEMMEAGVHFGHQARKWNPKMAPYIFTERKGIHIINLTQTARFLSEACDLVANASSKGKQFLIVGTKYQAADLIESSALKARCHYVNQKWLGGMLTNWSTIETRLQKFKDLENKKKTGTINRLPKKEAANLKRQLDHLQKYLGGIKYMTSLPDIVIIIDQQKEFTAIQECITLGIPTICLVDTDCDPDMTDIPIPANDDARASIRWILNKLTLAICEGRYNSIKN

SEQ ID NO: 10436 - protein, 251 aa, Zea mays
MEPSSQPQPMMGVGSQPYPAAAPYVPVPGSLAVPPGSQPAAAFPNPTQLSAQHQMVYQQAQQFHQQLQQQQEQQLREFWTTQMDEIKQANDFKIHTLPLARIKKIMKADEDVRMISAEAPVVFAKACEVFILELTLRSWMHTEENKRRTLQKNDIAAAITRTDIYDFLVDIIPRDEMKEEGLGHNPIVGLPPAMGAPADHGSHPYYYVPAQQVQGAGMMYGGQQGHPVTYMWQTPQGQAAEPPEEEQQQSA

SEQ ID NO: 10437 - protein, 367 aa, Synechococcus elongatus
MSETLVVKIGTSSLTNPHHPGLALSTIAGLVEVICQLRRQGYNVVLVSSGAVGVGCTRLGLRDRPSRIAQRQAIAAVGQGRLMRTYDDLFTTLGQPIAQVLLTRGDLAQRQRYINAYQTFQELFELGVVPIVNENDTVAVEELKFGDNDTLSALVASLVEAQWLFLLTDVDRLYTADPRQDPNAKPITIVHDLSELESIQAGGQGSRWGTGGMATKLTAAKIATQASVRTVITQGRSPENLLKILAGEAIGTWFEPQPETVNARKRWIAHGLVPTGKLLLDAGAVQAIQAGGKSLLAAGIQAIEGDFEAQDAVQLCDLNGTEIARGLVNYDSHELQQIRGCQSDQIVQILGYEGAETIVHRDNLVLS

SEQ ID NO: 10438 - protein, 233 aa, Clostridium tetani
MSVISMKQLLEAGVHFGHQTRRWNPKMAPYIFTERNGIYIIDLQKTVKKVEQAYNFIREVAAEGKDVIFVGTKKQAQEAIQEEAVRCDMHFVNNRWLGGMLTNFSTIKGRIRTLEELEQMEQDGTFEVLPKKEVIKLKLEEEKLEKNLGGIKNLNANNVGAMFVVDPRKEKNAISEAKILGIPVVAIVDTNCDPDEVDYVIPGNDDAIRAVKLITAKMADAVIEGRQGEQLAE

SEQ ID NO: 10439 - protein, 375 aa, Spinacia oleracea
MASTKVVEHLKENVLWKQAIMDRNANISDPPFEETYKNLLLKHNITPLTTTTTTTTTTATIEVRDLPLIDLSRLVATAAKERENCKRDIANASREWGFFQVVNHGIPHRMLEEMNKEQVKVFREPFNKKKGDNCMNLRLSPGSYRWGSPTPNCLSQLSWSEAFHIPMNDICSNAPRNIANGNPNISNLCSTVKQFATTVSELANKLANILVEKLGHDELTFIEEKCSPNTCYLRMNRYPPCPKYSHVLGLMPHTDSDFLTILYQDQVGGLQLVKDGRWISVKPNPEALIVNIGDLFQAWSNGVYKSVVHRVVANPRFERFSTAYFLCPSGDAVIQSYREPSMYRKFSFGEYRQQVQQDVREFGHKIGLSRFLICN

SEQ ID NO: 10440 - protein, 654 aa, Salmonella enterica
MTQLAIGEATPHGATYDGHGVNFTLFSAHAERVELCVFDSRGNERRYDLPGRRGDVWHGYLAGARPGLRYGYRVHGPWQPAQGHRFNPAKLLLDPYARQVEGELKDHPLLHGGHDEPDYRDNAAVAPKSVVISDHYDWEDDAAPRTPWGKTVIYEAHVKGLTYLHPELPQEIRGTYKALGHPVMVAYFKQLGITALELLPVAQFASEPRLQRMGLTNYWGYNPMAMFALHPAWASSPETALDEFRDAVKALHRAGIEVILDIVLNHSAELDLDGPTFSLRGIDNRSYYWIRDDGDYHNWTGCGNTLNLSHPGVVEYACECLRYWMETCHVDGFRFDLASVMGRTPTFRQDAPLFAAIKACPVLSTVKLIAEPWDIGEGGYQVGNFPPPFAEWNDHFRDAARRFWLPRNLTTGEFACRFAASSDVFKRNGRAPGASVNLLTAHDGFTLRDCVCFNQKHNEANGEENRDGTNSNYSDNHGKEGLGGPLDLMERRRDSIHALLATLLLSQGTPMLLAGDEHGHSQHGNNNAYCQDNALTWLDWQQANRGLTTFTAALIRLRQQIPALTGNSWWEEGDGNVRWLNKNAQPLSADEWQNGPKLMQILLSDRFLIAINATLEVTDIVLPEGEWRAVPPFAGEDNPVITAVWQGLCVFQRG

SEQ ID NO: 10441 - protein, 471 aa, Legionella pneumophila
MTIALVWFRQDLRLTDNPAFIEACSHHEIVIPLYIYDDKCSVLGQAQAWWLHHSLIALGKSLNQQGLSLVLRKGDPQEIILELVAQYGVESVYWNRCYEPQVIARDKKIKLALGEREIKVQSFNGNLLHEPWTIKNKNGDFFKVFTPYWKQCRQILNIPSPFMLTKRPRGIEITSDDLGKWKLLPAINWAARFSEYWTPGEEGAQKKLDEFIVHHLSGYKRERDFPAKNATSRLSPHLHFGEISPWVILRALELAKLEQTCDLASVEHFLSELGWREFSVYLLYHFPKLDCENFRKEFDAFPWQNDEQLLTCWQKGMTGYPIIDAGMRELWATGYMHNRVRMIVASFLTKDLLIDWRSGAQWFLDTLVDADLANNSASWQWVAGCGADAAPYFRIFNPVLQSQKFDPDGIYIRQWIPELAQLNSQSIHQPWTDADANSIFLGKKYPKPIIDHQEARTKALSYYQQIKKGMD

SEQ ID NO: 10442 - protein, 431 aa, Salmonella enterica
MVSLEKNDRVMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMKGENWYRGTADAVTQNLDIIRCYKAEYVVILAGDHIYKQDYSRMLIDHVEKGARCTVACMPVPIKEATAFGVMAVDENDKIIDFVEKPANPPAMPGDASKSLASMGIYVFDADYLYELLAADDKDDASSHDFGKDIIPKITREGMAYAHPFPLSCVQSDPQAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCVIDRACIIPEGMVIGENAEEDARRFYRSEEGIVLVTREMLRKLQVKQER

SEQ ID NO: 10443 - protein, 954 aa, Oryza sativa
MAVGEECAAAVASQVRHRWLAAAFFSSVDVAIVAGLPRVPTNYRDAPTCGMWGPHVSRCFIATFFNKPLGVLLGFVTDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 10444 - protein, 525 aa, Psychrobacter arcticus
MIDQSLLDAVKSYSANMTRPISFVLGSGEHSKRAELVDFLTKIAGTTDKINFDAQANDDTLPSPISFKVINHIDGALMDTGIVFSGIPGGHEFTSLILAILQAGGHTLKLDEGIQKLIKRFNKPLQFQTYVSLSCHSCPEVVQALNQFALLNDDISNEMIDGALFQEQVEANNIQGVPAVFLNGKPFANGLIDTAKLIEKLQEQFPDLLAEADDDAEQLEQQDVTIIGAGPAGVAAAIYTARKGLKVTMVADRIGGQVKDTQDIENLISVPLTTGSELSANFEKHLREYNITLKEHVSVKEISETADENYSIHLNTGETFETRSIILATGAQWRKLGVAGEEENIGKGVAFCAHCDGPFFKGKDIAVVGGGNSGIEAALDLAGIVKHVTVLEFADDLKADQVLINKAKEKSNIDIITSAATQEIKATDGKVSSLVYQDRNSNDNKELDVAGVFVQIGLIPNTEFVKGFIDLNRFGEIEIDERCRTDRKGIFACGDVTTVPFKQINIAMGEGSKAALSAFEYLVMQ

SEQ ID NO: 10445 - protein, 275 aa, Clostridium thermocellum
MELWFTEYQTPTLGITCKTKKTLHSEKTEYQELAVIETEQFGRMLLLDGIIQTTVADEFVYHEMIAHVPLFTHKNPKKALVVGGGDGGSIREIVKHPSIEKAVLCEIDRRVIEVSKEYLPEISCALDNEKVEVVVGDGIKYVKEHKNEFDVIIIDSTDPIGPAEGLFAIDFYRAVYDCLKEDGIFVAQTESPFIDKELITRIIRDVKSLFPITRLYTCAIPTYPTGYWCFTMGSKKYDPLETDIDSIPDIDTKYYCPQIHRAAFILPKFAKELIK

SEQ ID NO: 10446 - protein, 493 aa, Unknown
  Synechococcus sp. WH 7805
MVHGLQLVWFKRDLRLVDHQPLARALARGPVLPLYIVEPELWSQPDCSARQWAFCRESLQDLQEAFAEVGQPLIIRSGDAVDVLERARRQLGISALWSHEETGNAWTFARDRRVAAWARERGIPWHELPQFGVVRRLQTRRGWARRWEERMGEAITPAPTGLTPLSGIAPGDLPTNDALALQADPCPYRQRGGRRLGLQELNDFLAHRVQGYCRSISSPNLAFKGCSRLSAYITWGCLSMREVLQRSREFQGRGVSSFSSRLHWHCHFIQKLEDQPPIEWEDFHPFMRGIRSLDDARFAAWAEGQTGVPFVDACMRALRAHGWINFRMRAMLMSFASYNLWLPWRDTGLHLARQFVDYEPGIHWSQCQMQSGSTSINTIRIYNPIKQGHDHDPDGAFIRRWCPELEDVPAVHLHEPWSLLGAPRSMPIVDCAISAREAKERIFEIRRSAGFDRHADAIQQRHGSRRSGLPSTRRRRSSRLTTDPGIEQLALDL

SEQ ID NO: 10447 - protein, 659 aa, Ustilago maydis
MVGVSTASISAMGSKEHQLVGEARIRAPQPLQLPLLTLGLLGAQTVWSIDMAFAPPYLLDLGLSKSAMAAVFVAGPLSGLIVQPLIGSLADNSTSKYGRRRPFLATATIICAISILFLGFASEVAACFAVPGGNTHQNLAIFIGVVSVYLVDFSVNAVTALDRALMVDIAETEHQAEANAWAARLTGVGSVLSFLIGNLDLPKLAPGFLGTTQIQIISVLVSVILIATHAVVVLCVEEQVLAQTRSYGSRKAKGFGLTAIMHDLYIQARGLPPPIIEIFKVQFFAQIGWFPILFYSTVWVGEIYKADVRLNGGKQSDHELFEQATRAGSRAFFWHAVLSLLTSIVLPLAVPNPVHESSARPVWFANSSMLRKLGKVRERCPKLSFWWPFANFVFFISMMGTYFAGLTKSVFLATWVVTSVGFCFAIANWIPIALLGILIHTQHVQTNPDSAHLVVGGRTLPSNAAANADREGDEVAMALLGDRTHDDEWRRGSMARMSLYDASLDQRSQPQSRVCDDTDSDDEDQLPRALSFGASSLYEEAHARDANAEADDVERGRDSDKGANSTLSHAGTVLGLHNVAIVVPQFLVTAASALIFAIMEPSPKQKDQEGDVGVGNSTESGKSSDALGFIFRLGGCCALVAGILAVRLVRRHGHELRGY

SEQ ID NO: 10448 - protein, 106 aa, Medicago truncatula
MTKRYWNITFEEMMEAGVHFGHDTRKWNPRMTPFTNLTRTARFSSKACDLVFDAASLGKQFLIVGTKKKTADSVTQTAIRARCHYVNKKMARRYVNELVYYRNETS

SEQ ID NO: 10449 - protein, 707 aa, Unknown
  Polaromonas sp. JS666
MSIFNKVTKSFQWGQHKVTMETGEVARQASGAVVVDMDGTVVLATVVAKTDAKPGQDFFPLTVDYLEKTYAAGRIPGSFFKREGRPSEFETLTSRLIDRPIRPLFPEGFFNEVQVVIHVLSLNPEVEGDIPALIASSAALSISGIPFNGPIGAARVAYVDGQYVLNPGKTQLKDSKMDLVVAGTEAAVLMVESEAQQLSEEIMLGAVVFGHEQANIAINAIHELVRDAGKPVWDWQAPAKDEPLIAKVNELAGAKLQAAYQIRSKQARTQACRVAYADVMAALKADGVAFDGVTVEGMLFDIEAKIVRSQILAGEPRIDGRDTRTVRAIEIRNSVLPRTHGSALFTRGETQALVVTTLGTERDAQRIDALSGDYEDRFMLHYNMPPFATGETGRVGSPKRREIGHGRLAKRALIAVLPTKEEFPYTMRVVSEITESNGSSSMASVCGGCLSLMDAGVPMKAHVAGIAMGLIKEENRFAVLTDILGDEDHLGDMDFKVAGTTFGITALQMDIKIQGITKEIMQVALAQAKEARMHILGKMQEAMGEAKAEVSDFAPRLYVMKINPEKIRDVIGKGGAVIRALTEETGTQINIEEDGTITIASNDSAKADEAKRRIAEITAEVEIGKVYEGAITKILDFGALVNLLPGKDGLLHISQIAHERVEKVTDYLSEGQIVKVKVLETDEKGRVKLSMKALLDRPAQNQDQDRG

SEQ ID NO: 10450 - protein, 384 aa, Rickettsiella grylli
MRIQFLHKFFQLEASGGIALGLATLFALIFANSPWQTGYQTFLNFNIQLGTYVHFSFLHFVNDGLMTIFFFLVSLEIKRELIQGELNNRAKALLPTCAALGGMIVPALFYLAFNHAHPQWISGWAIPMATDIAFSLSVLSLLGKRIPVALKIFLMALAIIDDLGAIIIIAFFYTQQIGWFYLFLAILTFLGLILLNYYKTQPFLPYFLLGILLWILILQSGIHATIAGVLFGFTIPLKNDHKNDHSLLRDLIHQLHPWIAYAILPLFAFANAGLSFATLNKSAFFHPLPLGIIVGLFFGKPIGIFGSSWIAVKTKFAKLPHHVNWRHIYGIALMCGIGFTMSLFIADLAFDDSQLTSLVRFGVFIGSLLSGISGYYILYFKPER

SEQ ID NO: 10451 - protein, 220 aa, Arabidopsis thaliana
MGRRPARCYRQIKGKPYPKSRYCRGVPDPKIRIYDVGMKRKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDAHGHHAQEALRRAKFKFPGRQKIIVSRKWGFTKFNRADFTKLRQEKRVVPDGVNAKFLSCHGPLANRQPGSAFLPAHY

SEQ ID NO: 10452 - protein, 428 aa, Unknown
  Synechococcus sp. WH 5701
MDSTGTPLNQSLAAGDPAIAALIGRELERQQTHLELIASENFASRAVMEAQGSVLTNKYAEGLPHKRYYGGCEHVDAIEELAIARARQLFGAAWANVQPHSGAQANFAVFLALLQPGDTILGMDLSHGGHLTHGSPVNVSGKWFKAVHYGVDPHTNQLDYDAIRALAEQHRPRLIICGYSAYPRTIDFEAFRSIADSVDAFLLADMAHIAGLVAAGAHPSPIPHCHVVTTTTHKTLRGPRGGLILCNDAEFGKRFDKAVFPGSQGGPLEHVVAAKAVAFGEALQPSFRTYSQQVIRNAQALAARIQERGIAVVSGGTDNHLVLLDLRSIGLTGKVADLLVSEVNITANKNTVPFDPESPFVTSGLRLGTAALTTRGFDADDFAEVADVIADRLLHSDDSVIELRCRERVRALCERHPLYGPSRIPLPA

SEQ ID NO: 10453 - protein, 615 aa, Oryza sativa
MASISGAAAAAPSSSGASCGLRLRRDHLPRSSHFRLARPSSITDVSRLCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 10454 - protein, 570 aa, Aspergillus oryzae
MATDIATRDLRKPIDVAEYLFRRLREVGVRAVHGVPGDYNLVALDYLPKCDLHWVGNCNELNAGYAADGYARINGMSALVTTFGVGELSALNAIAGAYSEFVPIVHIVGQPHTKSQKDGMLLHHTLGNGDFNVFTRMSADISCTLGCLNSTHEVATLIDNAIRECWIRSRPVYISLPTDMVTKKIEGERLDTPLDLSLPPNDPEKEDYVVDVVLKYLHAAKKPVILVDACAIRHRVLDEVHEFVEKSGLPTFVAPMGKGAVDETHKNYGGVYAGTGSNPGVREQVESSDLILSIGAIKSDFNTTGFSYRIGQLNTIDFHSTYVRVRYSEYPDINMKGVLQKIVQRMGNLNVGPVSPPSNLLPDNEKASTEQAITHAWLWPTVGQWLKEKDVVITETGTANFGIWDTRFPAGVTAISQVLWGSIGYSVGACQGAALAAKEQGRRTVLFVGDGSFQLTLQEVSTMIRNNLNPIIFVICNEGYTIERYIHGWEAVYNDIQPWDFLNIPVAFGAKDKYKGYKVTTRDELRELFANEEFASAPCLQLVELHMPRDDCPASLKLTAESAAERNKSL

SEQ ID NO: 10455 - protein, 586 aa, Colwellia psychrerythraea
MSDVIRFFGGQYIYGVGGDFAANLIAALSVNEHGEGIQINPSSNEMHAGFSACAQAEVDGMGFCLTTYMVGSLPCTSAAALAVTEGLPVVFISGAPAESEVNQVAIHHTIHPNASWKAEYDNALEAFSALGMRVERLQGQRVEGHPNLAGQRFYQIVSEAYKNKQPVFIEVPRDQVFAKTQPIKLPSTLDDICCGSNILAGTELIVDNILDKLAQAKAPMLYLGDRLKHNEKLKHLIISFADKFNIPYATTWFAKGLFDEYAPLCLGAYNGIFTQTTGREYIEQQVDYVIDIATSIFPQDSNIAFGTGTHKIERFDNKTLLKGGSLLEKDLIAIFERLMEQNISPFEFTAPSQRGLTALSLQLESNELARGDDDIDFNNLAQTLNDLQAQDASTYVYLPEVGNSYFASYSLKVRQSILGRSWLTNPWYGAMGTALPYARVVAQRIKSQQIAERAVVIIGDGGFHFQLNELIHFLKDKSDVTIVYMRNNVFHLGKSGDGAIYHCNDSEFDVHSLVKAYQGDSKTCTSVGEFKAYFKACSQQTGISLIEVPAKPIEARQSNELKLLNLYIKSQNGQAEAVKAWQALTQ

SEQ ID NO: 10456 - protein, 112 aa, Cytophaga hutchinsonii
MKKIEAVIRTSKFLELKEALNKMGIQFFTYADVKGVGHQATEKAVYRGVQYDLGYIARTKLDIIVSEKVEEVIKCIVDTCKTGELGDGKIFVSNIEECVRIRTGERGVPALQ

SEQ ID NO: 10457 - protein, 112 aa, Rhizobium etli
MKIVMAIIKPFKLDEVREALTAIGIQGLTVTEVKGYGRQKGHTEIYRGTVYAVSFLPKLKIEIAVASELVDRAVEAIGASAKTGQIGDGKIFVYSIDHAVRIRTGETDSEAL

SEQ ID NO: 10458 - protein, 195 aa, Thiomicrospira crunogena
MRQATIQRNTLETKIELSVNLDGTGKADLNTGVPFLEHMLDQIARHGLIDLTIKADGDTHIDDHHTVEDIGISLGMALKEAVGDKKGIKRYGHSYVPLDEALSRVVIDLSGRPGLVFKADFTRASIGGFDTELVAEFFQGFTNHAQATLHIDCLRGKNAHHQAETIFKAFGRALRMALEADERMADQLPSTKGAL

SEQ ID NO: 10459 - protein, 610 aa, Campylobacter coli
MKKNFLRLAIVVLVLLIVGVLWLNNDINQKKEDEANKNAIAANADFSLLSDDNPNFERWGKVFPEQLKMYLTVEEEEPKATEFGGNLSYSKLIRFPQLTILWAGYPFSLDFNEERGHFWVQVDQMKTARNNKDFLNAHGLKAFKGQPAACMNCHSGWTPWLINNIAKGDFVAFNSTNYWTMIKNVPAVDGIVENSPEHAGPHGGKRMGVTCADCHNPNDMSLRLTRPAAINALVARGYEKDPVQGVKATREEMRTLVCSQCHVEYYFKPTGEKVKVMGETIADDSSKKWWDGTQKNYDEYEFWRDGNQPKEIEANGIMLTFPWNEWKKDQPFRIEMLDDYYDKVRNVFGADFTHKLTGAQIIKIQHPESELYSGGVHAANGVSCADCHMPYVREGAKKISQHNITSPLRDINSACKTCHKQSEDYLRAQVRDIQNSVAHDQRTAEYAIVSLIMDTKKLRDELGNMEKFQTDGKADASKISEELKEVLELHRKSQMRADFVNAENSTGFHNPREASRMLLQAVDMAKTGQIKLIEIANANGINDFKTSNLGFEDMQKFNPGELYYKVDVNGHKAGERYYGDEIEVNGNPPKELLEHDKNLAPYNYQVIDKK

SEQ ID NO: 10460 - protein, 106 aa, Brassica napus
MAEHLASIFGTEKDRVNCPFYFKIGACRHGDRCSRLHNRPTISPTLLLSNMYQRPDMITPGVDANGQPLDPRKIQEHFEDFFEDLFEELGKFGEIESLNICDNLAD

SEQ ID NO: 10461 - protein, 144 aa, Glycine max
MVAFTEKQDALVSSSFEAFKANIPQYSVVFYTSILEKAPAAKDLFSFLANGVDPTNPKLTGHAEKLFALVRDSAGQLKTNGTVVADAALVSIHAQKAVTDPQFVVVKEALLKTIKEAVGGNWSDELSSAWEVAYDELAAAIKKA

SEQ ID NO: 10462 - protein, 647 aa, Porphyromonas gingivalis
MRYGFMKVAAAVPFVKVADCEYNIERIDRMVHEADAKGVEIMTFPELSITGYSCGDLFFQPFLQERANEALCRLVEQTANTTVMVIVGMPLRVEEKLFNSAVVFQQGKILGAIPKTYLPNYREFQEARWFSPAHTLQYSTISIGQHSVPIGRNLIFKCGTVGVGIEICEDMWTPFTPGTRLCLYGAEVIFNLSSSNENAGKHSYLRSLISGLSSQGICAYVYASSGYGESSTDIVFTGKAFIAEAGEIVEEMERFRYEERMIISDIDVSRIQTERLINSSFKAAVTFHTHDEKFNQLPFKLRSRQESLPMTRRVDRNPFMPEDKDRKERSREMINIQVCGLMQRLLHMGAEHAVIGISGGLDSALALIVCAQAFDRLDLPRKNIIAVTMPGFGTSDRTYRNAFALMEAIGVTIKEIDIKEACLRHFEAIGHNPEVQDTTFENTQARERTQILMNLANIYNAPVIGTGDLSELALGWVTYNGDHMSMYAVNAGIAKTTVQILVDHIAHSGWLDEAASAVLLDIVRTPISPELKPVGQDGNISQKTEDLVGPYELHDFFIYHFLHNEYKPSKIYYLAGVAFKGIYTKAEIKKWMMVFFRRFFAQQYKRNCMPDGPKVSCISLSPRGAWRMASDASSALWLDEIAKFETD

SEQ ID NO: 10463 - protein, 165 aa, Leptospira interrogans
MRFDMNDTLYDLTATLNNGKEQKLENYKGKVLLIVNTASECAFTPQYAGLQNLYSKYKTEGLEILGFPCDQFKHQEPGSDETIKNFCQKNYGVEFPIFKKIEVNGDNAHPVFRFLRNKASGFFGNSIKWNFTKFLVDKQGNVIKRYSPITTPENIEKEIQNLLKR

SEQ ID NO: 10464 - protein, 1012 aa, Ralstonia eutropha
MILTRKRAAQGASTRLADGLAQASTTSTTSGSGRLATRLAAGLAGAMPTMDRRSFLKRSGIGVGVGLAASQLTLLRKADAADDKTVAAAEGKGGIVVKRTVCGHCSVGCAVDAVVQNGVWVRQEPVFDSPINMGAHCAKGAALREHGHGEYRLKYPMKLINGKYQRISWDQALDEITAKMKEMRQQTGPDSLFFVGSSKHSNEQSYLLRKWVSFFGTNNTDHQARICHSTTVAGVANTWGYGAMTNSYNDMQNAKAALYIGSNAAEAHPVSMLHLLHAKENGCKVIVVDPRFTRTAAKADHYVRIRSGTDIAFLFGVLYHIFQNGWEDPKYLQDRVYGMDKVRAEVLAKWTPDKVEEVCGVPEAQVKMVAETMAKNRPSTLVWCMGQTQHTIGNAIVRASCIVQLALGNIGVSGGGANIFRGHDNVQGATDVGPNPDSLPGYYGLATGAWKHYAAVWGVDYEWIKKQFASQTMMEKSGTTVSRWIDIVTEKNELIDQDNNVRSVFFWGHAPNSQTRGLEMKKAMDKLDLLVVIDPYPSATAAMANMPPAEGDKVNPNRAVYLLPACTQFETSGSCTASNRSLQWREKVIEPLFESMPDHTIMQAFADKLGFGKELSKNYKMIEVKRAGRTWMEPEIESILREINRSNWTIGYTGQSPERLKAHMRNMQMFDVKTLRCSGGKDAATGYDLTGDYFGLPWPCYGNPELKHPGSANLYDTSKHVMDGGGNFRANFGVERDGVNLLAEDGSCSKGAEITTGYPEFDHVLLKKLGWWDDLTDDEKKAAEGKNWKTDLSGGIQRVVLKVHGCHPFGNAKARAVVWNFPDPIPQHREPLYSTRPDMVAKYPTHDDKMAFWRLPTLYKTVQQRNIENKVYEKFPIILTSGRLVEYEGGGEETRSNPWLAELQQENFVEINPRAASDRGIRNGDFCWVKTPTGARIKVRALVTERVGPDTAFIPFHFSGWWQGKDLKDYYPDGAMPIVRGEAVNTATTYGYDSVTMMQETKTTICQIERFA

SEQ ID NO: 10465 - protein, 1025 aa, Unknown
  Acidovorax sp. JS42
MKRMLINATQPEERRLAIVDGQKLLDYEIEIEGREQRKGNIYKAVVTRVEPSLEACFVDYGEDRHGFLPFKEISKQYFAEGVSPSQARIQDVIKEGQELIVQVEKEERGNKGAALTTFISLAGRYVVLMPNNPRGGGVSRRIEGEDRAELKEAMDQLEYPKGMSIIARTAGIGRSAPELQWDLNYLLKLWTAIDGAAKAGKGAFLIYQESSLVIRAIRDYFNSDIGDILIDTDDIYEQAHQFMAHVMPEHAGKVKRYRDDAPLFSRFQIEHQIESAYARTVTLPSGGAIVIDHTEALVSVDVNSARAIKGGDIEETATRTNLEAADEVARQMRLRDLGGLIVIDFIDMEESKNRREVENRLRDALRQDRARVQFGTISKFGLMEMSRQRLKPSLSEGAHIRCPLCDGTGHVRDTEGFSLQMLRMIQEESMKDSTAAVHCQVPVEVASFLLNEKRTEIAKIELKQRVSVVLIPNKSLETPHYKLERLKHDDPRLENLDASYKLADVEEDQTKVTRRSQEPTNKQTPVIKGVLPDAPAPVAEPRPEGAARGATRPQGQGQQRPATAPTPAPQRPAAAPAPEQGFFAWIKSLFGFGAAPAPAPVAAPAQTPAEPGARGEGRRGERGGRRGERTGERSGERGGERNGNREGGEGRGRRGEGRGGERSAEGRENREPREPRNGRDGERRGDRAEGESRREPREGRGGRERGERNAQPPVQSAADLANTPVTTDADVAVTEERTARTGERGERRERGERGERRERGGERRERGPRTIDANAPAAGADFADTAPLAALPDLDLSGAEVGTSGAEAPAGEERRERRSRDRYGRDRRERGERGPRNAEASATGADAEAPAAPLMDLDLPAPAAAAEEDSAPARRSYFASAPASAPAATPQAAPEATAAVTPPPAAVPVPAPAPAPVAAAPVPAPAPAATAVAPATGGMPRVQAFTLPVDTLQQVAQASGLQWVNSDAQKIAAAQAAIAAEPKPVHVPRERAPVVVLDEGPLVLVETRRDLGAMQLPFDQDNAAA

SEQ ID NO: 10466 - protein, 416 aa, Thauera aromatica
MNAPAEHATIARQHLIDPEVCIRCNTCEEMCPINAITHDARNYVVKFDVCKGCLACISPCPTGAIDSWRNVDGTRSYTIEEQLSWDALPDTTEFDNFEATLGALSGEETPPEVQQITDVATAGQGGPELAPWSASHPYVNLYTPTRPLTATVSGNYQATADDASSDIHHIVLDFGATPFPVLEGQSIGIIPPGTDANGKPHLLRMYSVASPREGERPHHNNLSLTVKRVTEDHDGHPARGIASNYVCDLKKGDKVQVTGPYGSTFLMPNHPGSSLLMICTGTGSAPMRAMTERRRRRMEQKEGGELMLFFGARAPGELPYFGPLKKLPEDFIDINFAFSRVPDEPKRYVQDRIRERADKVFRMLTDDNAFIYICGLKGMEAGVLEAFRDICRAHGTDWEALRPELLAKGRFHVETY

SEQ ID NO: 10467 - protein, 199 aa, Haemophilus parasuis
EAGDIIIDGGNSNYPDTNRRVKALAEKGIRFIGSGVSGGEEGARHGPSIMPGGNSEAWQYVKPIFQAISAKTDKGEPCCDWVGKEGAGHFVKMVHNGIEYGDMQLICEAYQFLKDGLGLSYNEMQAIFAEWKKTELDSYLIDITTDILGYKDTDGTPLVEKILDTAGQKGTGKWTGINALDFGIPLTLITESVFARCVS

SEQ ID NO: 10468 - protein, 268 aa, Thermobifida fusca
MVGVAVAQFAPGMDKQANLRRAVELVRAAVDQGARLVVLPEYAMFTAPATDHRFVAAAEPLDGRYVSGLRDLARDCGVYLVAGVNEAVDDPERFANTTVAVGPDGALLVCYRKLHLYDAFGFTESAVVRPGEITDPAVFTVDGLTFGVQTCYDLRFPEVTRRLADAGAHAVVLGAEWVPGPEKKEHWKLLVRARAVENTLYVAAAGQTAPMGSGHSMVADPMGVVVASLADDEGVAVAAVDPARVAEVRALNPVLELRRFTVAPKYPV

SEQ ID NO: 10469 - protein, 414 aa, Azoarcus evansii
MNAPAEHANLARQHLIDPEICIRCNTCEEICPVDAITHDSRNYVVKFETCNGCLACISPCPTGAIDSWRNVDKATPHSLADQYSWDYLPDTTELDQFEATVMGAAELPAEVQQITEVATAGQGGPAMAPWSASHPYVNLYTPANPITATVTGNYRLTAEDASSDIHHIVLDFGTTPFPVLEGQSIGIIPPGVDEKGKPHLLRMYSVASPRDGERPHYNNLSLTVKRVVEDHEGNPTRGVASNYVCDLKKGDKVQVTGPYGSTYLMPNHPGSSIMMICTGTGSAPMRAMTERRRRRMDRKEGGELVLFFGARAPEELPYFGPLQKLPKEFIDINFAFSRVPGEPKRYVQDAIRERADKVFQMLQDDNCYIYICGLKGMEAGVLEAFRDICRAKGADWDALRPQLLSKARFHVETY

SEQ ID NO: 10470 - protein, 595 aa, Medicago truncatula
MDNHSLVLDDTSVAIAEQPLVIGQEFPDVETCRRTLKDIAIAMHFDLRIVKSDRSRFIAKCSKEGCPWRVHVAKCPGVPTFTIRTLQADHTCEGVRNLHHQQASVGWVARSVESRIRDNPQVKPREILQDIRDQHGVAVSYMQAWRGKERSMAALHGTFEEGYRLLPAYCEQIRKTNPGSIASVGATGQENCFQRLFISYRASIYGFINACRPLLELDRAHLKGKYLGSILCAAAVDADDALFPLAIAVVDTESDENWMWFMSELRKLLGVNTDNMPRLTILSERQRGMVEAVETHFPSASHGFCLRYVSENFRDTFKNTKLVNIFWNAVYALTAAEFESKITEMIEVSQDVISWFQHFPPFLWAVAYFDGVRYGHFTLGVTELLYNWALECHELPVVQMMEYIRQQMTSWFNDRREVGMEWTSILVPSAEKRISEAIADAHCYQVLRANEVEFEIVSTERTNIVDIRSRECSCRRWQLYGLPCAHAAAALISCGHNAHMFAEPCFTVQSYRMAYSQMINPIPDKSQWREHGEGAEGGGGARVDIVIHPPKIRRPPGRPKKKVLRVENFKRPKRVVQCGRCHMLGHSQKKCTMPI

SEQ ID NO: 10471 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGISGQRFVIQGFGNVGSWAAQLINEAGGKVIAISDVTGAVKNVNGLDIAQLVKHSAENRGIKGFNGGDAIDPNSLLTEECDVLIPAALGGVINKDNANDIKAKYIIEAANHPSDPEADEILSKKGVIILPDILANSGGVTVSYFEWVQNIQGFMWDEEKVNAELRTYMTRAFGDVKEMCRSHNCDLRMGAFTLGVNRVARATVLRGWEA

SEQ ID NO: 10472 - protein, 199 aa, Haemophilus parasuis
EEGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 10473 - protein, 605 aa, Oryza sativa
MELALVGDPSNGVAKPSCDSVGSLPAVSSKAVIHPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEHAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKELLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 10474 - protein, 411 aa, Arabidopsis thaliana
MNALAATNRNFKLAARLLGLDSKLEKSLLIPFREIKVECTIPKDDGTLASFVGFRVQHDNARGPMKGGIRYHPEVDPDEVNALAQLMTWKTAVAKIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFGTEALLNEHGKTISGQRFVIQGFGNVGSWAAKLISEKGGKIVAVSDITGAIKNKDGIDIPALLKHTKEHRGVKGFDGADPIDPNSILVEDCDILVPAALGGVINRENANEIKAKFIIEAANHPTDPDADEILSKKGVVILPDIYANSGGVTVSYFEWVQNIQGFMWEEEKVNDELKTYMTRSFKDLKEMCKTHSCDLRMGAFTLGVNRVAQATILRGWGA

SEQ ID NO: 10475 - protein, 181 aa, Zea mays
  misc_feature (40)..(40): Xaa can be any naturally occurring amino acid
MASSMLSNAAVATTVVNRNAGAQASMVGLKSVAAFPLTKXKSTNDLSSLPTNGGRVQCMKVWPTQNMKRYETLSYLPPLTTDQLARQVDYLLNNKWVPCLEFETEHGFVYREHHNSPGYYDGRYWTMWKLPMFGCTDPAQVLNELEECKKEYPNAFIRIIGFDSNRQVQCVSFIAYKPEGY

SEQ ID NO: 10476 - protein, 398 aa, Ustilago maydis
MASLRTGLRVAQPLRASARNFATRPSIRSSVRHYSSPAPGSPPPPQPSSSSSTSKVLLTSVAIAAAAGGAFLAFGRDDKVSILGVGANGANKFQGSKGSVGPATTSAHSKADYQAVYNAIAEQLEANPDYDDGSYGPVLVRLAWHASGTYDKNSNTGGSNGATMRFAPESEHGANAGLGAARDFMEKIHQKFPWITYSDLWTLGGVAAIQELGGPKIPWRPGRKDATADKCTPDGRLPDGDKGPDHLRYIFYKMGFNDQEIVALSGAHALGRCHTDRSGFDGPWTFAPTSFTNEYFNLLMNEKWNIRKWNGPPQFEDKSTKSLMMLMTDMALVQDPSFKKHVQRYAKSEDEFFNDFRSAYAKLLELGVPAENFKAFETKLDGGKPFEFATSAEQENAN

SEQ ID NO: 10477 - protein, 524 aa, Solanum lycopersicum
MDTCCAAMKSTVHLGRVSTGGFNNGEKEIFGEKIRGSLNNNLRINQLSKSLKLEKKIKFGEAYSVITIENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIIAEKATIRDGTVI

SEQ ID NO: 10478 - protein, 810 aa, Unknown
  Polaromonas sp. JS666
MKKSKLVMVGNGMAGVRTIEELLKIAPELYDITVFGAEPHPNYNRILLSPVLAGEQTLDEIVLNSWDWYKDNHITLHAGKKVVEVDRVRRVVRAEDGTEEEYDRLLMCTGSNPFILPVPGKDLQGVIAYRDIADTNAMIEAAQKYKKAVVIGGGLLGLEAANGLMLRGMEVTVVHVMPWLMERQLDDVAGKLLQKSLEDRGLKFLIGAQTQELTGGADGRVKSIKFKDGSELDTDLVVMAVGIRPNTELAEKMRLHCNRGIVVNDTMQTVTDARIYSVGECAAHRGIAYGLVAPLFEQAKVAANHLAQFGIGRYTGSLTSTKLKVTGIDLFSAGEFMGGEGTEEIVMSDPFGGVYKKLVIKGDKLIGACLYGDTVDGSYYFKLLRDGRSVSDIRDKLMFGESNIGDTGHEGHSKAAAMPDDAEVCGCNGVTKGTICKAIKEKGLFTLDEVRKHTKASASCGSCTGLVEQLLMFTAGGDYSATPKKKAVCGCTDHSHQEVRDTIKSLHLLTIADVYKTMEWRTPNGCASCRPAINYYLISTWPKEAKDDPQSRYINERSHANIQRDGTYSVIPRMWGGHTTPNDLRRIADVADKYQIPTVKVTGGQRIDLLGVKKEDLQSVWQDLGMPSGLAYAKATRTVKTCVGSEWCRFGTQDSTQMGKDLEHALWAMYAPHKVKLAVSGCPRNCAESGIKDVGVIGVDSGWEIYVGGNGGIKTEVAEFLVKVKTSSEVMEYAGAFLQLYREEGWYLERTVHYLHRVGLDYVKKKILDDAEGRKALWERLQFSLDGAPDPWLETSKAAVDTRQFEKLPA

SEQ ID NO: 10479 - protein, 185 aa, Brassica napus
  misc_feature (45)..(45): Xaa can be any naturally occurring amino acid
  misc_feature (48)..(48): Xaa can be any naturally occurring amino acid
  misc_feature (68)..(68): Xaa can be any naturally occurring amino acid
  misc_feature (110)..(110): Xaa can be any naturally occurring amino acid
ILRPDGCTWKPWGRLEAWSESGYSSDALGYRFELFQDGIATAVSXRRXYSLKTAAGFVIDVTGGNTTXASTPTTSPQGSWDLGSGSSAGSRPASRPGSGSGSDFGYLLPXHPAQSRGFVMSASVEGVGKRSKPEVEVGVTHVTCTEDAAAHVALAAAVVLSLDACRLFSQKLRKELRQQSQLGVV

SEQ ID NO: 10480 - protein, 416 aa, Leptospira interrogans
MKEIEYVQDLCSRAKKASKVLKQLSSSKKNKILLSLADLLEKRKAEILLANELDLKDGKEKKLSSALMDRLLLNEKRIFSMASAVREIAALPDPIGEVTRGITLPNGLELVTRRVPLGVVMVIYESRPNVTIDVGALSFKSGNACILRGGSEAFYSNEILIKLFHEILIKEEIDIGSVVFVDKTDRSFMIPFFQQTSLIDIVVPRGGEGLIRFVSENSKIPVVKHDKGVCNLYIDQDADPEKVIPIVINSKVQRPGVCNSTENLILHNGYPFRKELLEALAKEGVELLLDPSSLALYPKGKPVKQQDYLEEFLDLRLSVKTVSSLEEALAFIEKTSSGHTEAIVTEDLNTARIFTNSLDSAALFINCSTRFHDGGEFGLGAEVGISTGKLHVRGPMGLVHLTTTTTYVTGNGQIRG

SEQ ID NO: 10481 - protein, 1003 aa, Unknown
  Polaromonas sp. JS666
MMRETRSTCPYCGVGCGVIIESQGDQITGVRGDPDHPANFGRLCTKGSTLHLTATAPVTRQTRLLYPMRREHRHEAAQRVSWDNALDFASESFAQIIRDHGPDAVGFYISGQLLTEDYYVFNKLAKGLIGTNNVDTNSRLCMSSAVAGYKQTLGADAPPACYDDVNHAQCIFIVGSNTAYAHPILFRRIEDAKAKNPQLKIIFCDPRRTDTAEIADLYLPLQPGTDVSLFNGMLHIMLWEGWVKADYIAAHTSGFEALKATVRDYTPDLVAETCGIKKEDLFTAAKLFATSPATLSLYCQGLNQSSSGTAKNAALINLHLATAQIGKPGAGPFSLTGQPNAMGGREVGGLANLLSAHRDLANADHRAEVAALWGVPSVPEAPGKTAVEMFQAAADGEIKALWIACTNPAQSMPDQATVRRALERAEFVVVQEAFATTSSCDYADLLLPATTWGEKTGTVTNSERRISRVRPAVPAPGETRHDWSIAVAFAQRLEKLLGAQSPHPNPLPKGEGVIQETQETSNSPSSLPLPLGEGRGEGARTGSLFPYSLSDEAAGVETIWNEHRESTRGRDLDITGMSYAMLEESPQQWPLREGETTGKVRLYEDGIFPTADGKARFVNTVYKPVAEPRESRYPFSLTTGRLRDHWHGMSRTGTLGRLFGHVAEPAIQMNAQDMARRLLNEGDLVHVTSKRGSIVVPVQSSSEIGMSQAFVAMHWGEEYLSGRSSTGAPLAGVNALTTSAYCPTSKQPELKHAAVKILKAELPWSLLAMAWLPEDDALGAREQLKPLMAAFPFSSCVPFSNNTPLAQSSRERTGLLFRAAADEAPSAETLASIERILGLAGSDALRYADKKKGQHRTVRLVRKGDQAELAGFVLAGDTSAQAWIKTLLQDELPAQTYGRLLLLPGAKPPVTVQSRGKLVCTCLNVTDTAIADHLTAVSHGGGGAGYLGTDEERLASLQGALKCGTNCGSCVPELKRLVRSARSTQPPGSGLEGRTVIPIRQLA

SEQ ID NO: 10482 - protein, 109 aa, Unknown
  Synechococcus sp. WH 8102
MSEVATYTVRAEFEGTTHSFSCRADQTVLNAAEAAGVTLPSSCCSGVCTTCAAVISDGQVEQPDAMGVKGELQQQGYALLCVAFPRADLTLKAGQEDALYEAQFGQYQK

SEQ ID NO: 10483 - protein, 90 aa, Brassica napus
  misc_feature (86)..(86): Xaa can be any naturally occurring amino acid
MAVVDVHRFAESITCHAWSPDLSMVALCPNNNEVHIYKSSQEQDQWERLHVLEKHDQIVSGIDWSSKSNRIVTVSHDRNSYVWSLXGGEW

SEQ ID NO: 10484 - protein, 285 aa, Xanthomonas campestris
MSTNDNWYIEHFQPTGSAIGYRISGKLDEVQSPFQKIEIYQTTDWGKLMIIDGAVMLTSRDNFFYHEMISHPALFTHAAPKRVVIIGGGDCGTLREVLKHPGVESATQCDIDEQVTRMSEKYFPELCDSNDDARAELLFDDGVAYMANCPAGSVDIVIVDSTDPVGPAEGLFNKSFYESCFKALKDDGILVQQSESPLALLDLIKEMRTEMGKAGFQSFKTLPFPQPCYPTGWWSVTMASKQANADFAFRQADAQAKGFDTLYYTAHLHTGVLVAPPFVAKALGE

SEQ ID NO: 10485 - protein, 112 aa, Xanthomonas campestris
MKMIMAIVKPFKLDDVREALAGCGVAGITVTEVKGFGRQKGHTELYRGAEYVVDFLPKVKLEVAVTDDQAEQVVEAIVKAAGTGKIGDGKVFVYDLGSVVRIRTGELDGDAL

SEQ ID NO: 10486 - protein, 882 aa, Oryza sativa
MTPAPAAASYRALVALLLVAVAVADDGSTLLEIKKSFRNVDNVLYDWAGGDYCSWRGVLCDNVTFAVAALDLKSNGLSGQIPDEIGDCSSLKTLILKNNQLIGVIPSTLSQLPNLKILDLAQNKLSGEIPRLIYWNEVLQYLGLRGNNLEGSISPDICQLTGLWYLDLSYNKLSGSIPFNIGFLQVATLSLQGNMFTGPIPSVIGLMQALAVLDLSYNQLSGPIPSILGNLTYTEKLYMQGNKLTGPIPPELGNMSTLHYLELNDNQLSGFIPPEFGKLTGLFDLNLANNNFEGPIPDNISSCVNLNSFNAYGNRLNGTIPPSLHKLESMTYLNLSSNFLSGSIPIELSRINNLDTFNLSNNGLVGFIPAEIGNLRSIMEIDMSNNHLGGLIPQELGMLQNLMLLNLKNNNITGDVSSLMNCFSLNILNVSYNNLAGVVPTDNNFSRFSPDSFLGNPGLCGYWLGSSCRSSGHQQKPLISKAAILGIAVGGLVILLMILVAVCRPHSPPVFKDVSVSKPVSNVPPKLVILHMNLSLLVYEDIMTMTENLSEKYIIGYGASSTVYKCVSKNRKPVAVKKLYAHYPQSFKEFETELETVGSIKHRNLVSLQGYSLSPVGNLLFYDYMENGSLWDVLHEGPTKKKKLDWETRLRIALGAAQGLAYLHHDCSPRIIHRDVKSKNILLDKDYEAHLTDFGIAKSLCVSKTHTSTYVMGTIGYIDPEYARTSRLNEKSDVYSYGIVLLELLTGKKPVDNECNLHHLILSKTANNAVMETVDPDIADTCKDLGEVKKVFQLALLCTKRQPSDRPTMHEVVRVLDCLVRPDPPPKSAQQLAMPQRPAVPSYINEYVSLRGTSVLSCANSSCTSDAELFLKFGEVISQNTE

SEQ ID NO: 10487 - protein, 152 aa, Erwinia carotovora
MEFTTRTIPAQKHIALVAHDHCKQSLLDWVGTNKQQLTEHTLYATGTTGNLIQSNTGLPVKSMLSGPMGGDQQVGALISEGKIDLMIFFWDPLNAVPHDPDVKALLRLATVWNIPVATNRATADFLINSALFKEPVQIAIPDYQRYLQDRLK

SEQ ID NO: 10488 - protein, 715 aa, Thermosynechococcus elongatus
MKGLEKIIPLDGRDIKVVLQKFAPQAAGSILISSGETAVLVTANRAAAREGIDFLPLVVDYEERLYAAGRIPGGFLRREGRPPEKAILIGRLIDRPLRPLFPQWLRDDLQVVATTVSLDENAPPDVLAVTGASIAVLLAQIPFNGPMAAVRVGLVGDEFVINPTYKEIERGGLDLVVAGSPDGVVMVEAGANELPEADMIEAIDFAYEVIRDLIQAQRDLLKELGIDIVRAEPPAIDPTLENFIYDRAAEPVKAILKRFEKDKNVRDAALDEVQGAIAQEIAALPEDDPVAVAAAENPKALPTLFKAVTKKLMRQQIIEEGVRVDGRRLDEVRPIWCEVGVLPERVHGSALFNRGLTQVMSVTTLGSPADAQALDDLHPEDSKRYLHHYNFPPYSVGEVKPLRSPGRREIGHGALAERALEPVLPPKEEFPYVIRVVSEVLSSDGSTSMGSVCGSTLSLMDAGVPIRKPVSGAAMGLIKEGNEVRILTDIQGIEDFLGDMDFKVAGTDSGITALQMDMKITGLPVAVIQQAIEQARPARLHILEKMLAVLDKPRPQLPPSAPRLLTLQIPPDMIGLVIGPGGKTVRGISEQYNVKVDISEEGLVTITAPNETNAKQARAAIEGLTRKLNAGDVYLGRVTRIIPIGAFVELLPGKEGMIHISQLAEYRVGKVEDEVKIGDEIVVKIREVDSKGRINLTRLGIHPDEAEAARSNSVV

SEQ ID NO: 10489 - protein, 443 aa, Gibberella zeae
MSMIATASPSPHPSSFGMPRPWETNRCPDYSLRPRTENDKVALPSIRQAFPELQLQTQPPHDLNTKPLVTGPPLGTAPLAAASPQYVHSPNSSKRRRLSMEREMESERVRQVPRLCYSPDRESPRQISPNLAIQAGTRENWTAPTRTSPYLTNGATHHSVPMEVGERLEARPALPSLPPPRSLEREAVLVSRGPAPAPVPTPVPTPAPAPASIPASVSASAPAPAPTEGYRSSHQPMSHSRTPIPESGVSPYRESSYGYPYHHPTRYQSLSAGSAHSFDRTPFTPGAYNAPYQDFVRFGEMGPASLSGDNKQRKRRGNLPKETTDKLRAWFVAHLQHPYPTEDEKQDLMRQTGLQMNQISNWFINARRRQLPTMINNARAETDAMSSARGGDMKVLATTERGDFDHGKREPVGPLSDGEGATYEEELEALSQRRPGTMGRGSV

SEQ ID NO: 10490 - protein, 546 aa, Glycine max
MGFEISTVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKHSFATLSFVAEIFIFLYVGMDALDIEKWKFVSDSPGTSVATSSVLLGLILLGRAAFVFPLSFLSNLAKKSPNEKISFRQQVIIWWAGLMRGAVSIALAYNQFTMSGHTSLRSNAIMITSTITVVLFSTVVFGLLTKPLIRLLLPHTPHHKESSITIITDPSTPSLKSVTIPLLGSAQESEVDIDGHDIHRPSSIRALLTTPTHTVHRLWRKFDDAFMRPVFGGRGFVPVEPGSPTERNGHQWR

SEQ ID NO: 10491 - protein, 358 aa, Pseudomonas putida
MSQFHSLTIKQVRNETRDAVSIAFDVPEHLQDQFRFTQGQYLVMRTQLDNEEVRRSYSICSAVQDGELRVAVKRVPGGRFSAFANEVLKAGQQLEVMPPSGSFFVPLDPTRQGNYLGVAAGSGITPILSIIATTLASEPNSRFTLLYGNRSSSGALFRDKLEDLKNTYLDRLNLIFVFSREQQDVDLYNGRIDADKCGQLFSRWLDVPGLDAAFICGPQAMTETVRDSLQANGLEKQRIHFELFAAAGNEARREAREAARQVDAALSHITVISDGRALTFDLPRNTQNVLDAGNAIGAELPYSCKAGVCSTCKCRVIEGEVEMDSNHALEDYEVAAGYVLSCQTYPVSDKVVLDFDQL

SEQ ID NO: 10492 - protein, 554 aa, Selenomonas ruminantium
MNGAQAVVACLREQGVDTVFGYPGGMILPLYDALYDSKEIKQVLVTHEQNAAHAADGYARASGKVGVCIATSGPGATNLVTGLATAFMDSIPVVAITGQVDTTLLGRDAFQETDILDVTMPITKHNYKIKDARHLLSTIREAFTLAKKGRPGPVLVDVPRDLFFQEVAWEEVPACTKKVGKPDADFLICAAEAAREIVKAQRPVVIVGGGVVSAGATAEVTAFVEKYNLPVAHTLMGLGAIPREHPQSLGFAGMHGEKAANHAIAAADLIIAIGSRFGDRQTGNVKKYTQDTKFIHIDIDPAEIDKNIGNSLGLAGDMKVILGLLMKQEAVGNIDEWWQQIQSWKETYDYDYHVNRLTVPWALHQVAQNTKGKPYAFATDVGQHQMWAALHLRIEEPRTWLTSGGLGTMGFGLAAAMGAQMYYGDSRRVIHVAGDGGIKMTGNEFYTIARLNLPVISLIVNNTSLGMIRQLQKVMYKERYIACEFDYQMDYAAYAGSFGIKAETVSTQEEFAEALNRALADQDHPRVIVLNVWRSFVEPMIKGGARIDEFVEFK

SEQ ID NO: 10493 - protein, 913 aa, Ralstonia solanacearum
MTMTTIPIHPLTEAVRTTCPYCGVGCGVLATPRADGSVGIAGDPAHPANAGRLCVKGSALGETVGLDGRLLHPAMRERTPDPDAPPAPLRRVAWDAALDAVAQGFRRIVDEHGPDAVALYVSGQLLTEDYYLANKLMKGFIGSANIDTNSRLCMSSAVAGHKRAFGEDLVPVCYDDLEAADLIVLVGSNTAWCHPILFQRIVRVKEARPEVKVVVVDPRHTATCELADLHLPIRPGTDVRLFNGLLSFLARRGAVDRDFVDLHTSGLDDALRIADADADDVAEVARACKLKLDDLLTFYGWFADTPRTITAFSQGVNQSSAGTDKVNSIINCHLLTGRIGHAGMGPFSITGQPNAMGGREVGGLANMLAAHLELHEPRHRELVQTFWNAPRMADKVGLKAVDLFSAIEAGRVKAVWIMGTNPVVSLPDADQVRRALAKCELVVASDIVEATDTTLLADIVLPALGWGEKNGTVTNSERRISRQRAFLPAPGEARADWDIIADVARRMGYDGFDFKGPHDVFDEHARLSAFANGPQGVRRAFHLGGLTGLDADAYDGMAPVQWPVTLGGAGEARLFSDGRFAHADGRARFVPTAARAPVHAPDSDYPLILNTGRVRDQWHTMTRTGRAPKLADHVPEPFVDLHPHDALLAGVREGALARVGSRWGSVVARVRMSGGIARGSVFVPIHWNGQFASDARVGAVVNPVVDPVSGEPEFKHTPVMVEPFDVAWHGFVLSRRALDAGEATWWTRIQGRQFVRYELAGRQQIGSAHAWARRLLGVDDPHADWLEYEDTTARVYRAVYVVDDRIEACIFLSPRPDLPSRNWLAGLFAHDRLEDIDRAGVLLGQPIEAGADAGPTVCSCFGVGRNTICDAIRAKGLQSTGEITACLKAGGNCGSCVPELKRLLVEARVQQAA

SEQ ID NO: 10494 - protein, 305 aa, Rubrobacter xylanophilus
MITRIKPGTGITELVGNTPLVELSKISAETPGVRIYGKAEWYNPGGSVKDRPALWMIRDGERSGALTPEKTILDATSGNTGIAYAWIGAALGYRVKLCMPSNASEERKKILRAYGVDIVLTDPGEGSDGAIREARRLYAEDPERYFYPDQYSNPANPRAHYESTGPEIWEQTGGEITHFVAGLGTSGTFVGTARRLKEFNPEIRAISFEPDSPFHGIEGMKHMESAIVPAIYDPGVADENRRASTEEAYAMVKRVAREEGILIGISAGAAVATALRVAREIESGTIVTILCDGADKYLSESFWEE

SEQ ID NO: 10495 - protein, 409 aa, Ralstonia solanacearum
MSRAARPKLVVIGNGMAGMRTVEELLKLAPDLYDITVFGEEPHGNYNRILLSPVLAGEKRVDDIMLNTREWYEEHGITLHAGDPVVAIDRPRRTVRSRGGVEVRYDRLLMATGSRPFILPVPGHMLPGVIAFRDIQDVETMLDAARNHRHAVVIGGGLLGLEAANGLMRQGMEATVVHISDTLMERQLDKPAAALLKVALEAKGLRFLLGAQTTELIGTDRVTAVRFKDGTEIPADLVVMTAGVRPNIELARSAGLHCERAIVVDDTLQTYDPRIYAVGECVQHRSATFGLVAPIWDQARVCAAHLAGAGHRRYVQQATATKLKVTGVDLYSAGDFIGGDGTEDIVLRDPRRGVYKRLVLKDDRIVGAVLYGDVADGPWYFELIQRQAPIAAMRQRLLFGRALCEAEAA

SEQ ID NO: 10496 - protein, 430 aa, Anaplasma marginale
MVGYIGNVDIGVFDAEVANSMSAELERQNTLLQMIASENFVSRAVLQAQGSVLTNKYAEGYAGSRYYCGCALVDVVENLAVERLCRLFGCKFANVQPHSGSQANQQVFMALLKPGDTILGMSLDCGGHLTHGAAPNVSGRWFNAVSYGVNRDTGLIDMDEVEALALSAKPSLIIAGASSYPRRIDFAAFRAIADKVGAYLLADIAHYSGLIAGGCYPSPFGHAHVVTSTTHKTLRGPRGAVIMTDDEEIHKKIRLSVFPGMQGGPLMHVIAAKAVAFKEALHPDFKLYAQQVLENSRVLAGVLSSEGLDVVTGGTDSHIVLLDLRSKGVTGREVSSSLERAGIVCNKNAVPFDTEKPWVTSGIRLGSAAETSRGLGVPEFESIGRLVAKVVNACSLGQEKMSAAEAEVRREVNGLVRSLPMSAFPVCEVC

SEQ ID NO: 10497 - protein, 505 aa, Selenomonas ruminantium
MTYMAGMVYLVGAGPGDYRLISMKAVDCLKMADVVVYDRLADDRILRWAPEDAEFIYVGKASSNHTMKQEDINQLLVDKAKEGKCVVRLKGGDPFVFGRGGEEGLLLRENNLPFEIVPGITSAISVPAYAGIPVTHRAVATSFAVVTGHEDPTKGKSNMRWEHLATGVDTLVFLMGVANLPHITGKLIENGRSADTPAAVIRWGTKPEQRTLITTVGKAAEDVAKNGIKPPAIFIVGEVVKLRDSLQWFDNLSQRPLFGKRILVTRARSQASKLTAKLEKLGAEVLEAPAISMADPADNYAALDKAIDHVADYHWLIFTSANGVGRFFARLFKAGKDARALGYAKIAAIGLATAEKLKQYGLVADVIPQEYRAEGVLEALKGKLPPHAKILIPRAEEAREVLPDTLREMGAEVEVAPAYRTICGQVDGEALAAELKEGNIDLVTFTSSSTVKNLVNIIGSAEVLKGVKTACIGPVTADTAKSLGIEPDIIAKEYTIDGLVEAICK

SEQ ID NO: 10498 - protein, 852 aa, Ralstonia solanacearum
MTMKIVVIGHGMVGHKFLESLLHAPGHDLHVTVLCEEPRPAYDRVHLSEFFSGKTAEDLSLVAPGFFDRDDVVLRLNARAVSIDRAAKQVTASTGEVLAYDKLIMATGSSPFVPPIPGKDRTDCFVYRTIEDLEAMLECGRRARTGVVVGGGLLGLECAKALRDMDLQTHVVEFAGRLMAMQVDDGGGRMLRRKIEDLGVTVHTQKNTVEIVDGEDGTHRMRFADGTHLDADMIVFSAGIRPRDELARQCGLAVGERGGIVIDSECRTSDPDVYAIGECALWGGKVYGLVAPGYEMARITARQILAAEEEAAAFNGADMSTKLKLMGVDVASLGDAQGSTPGSRSVQFVDERKQIYKKLVLSSDGKFLLGGVLVGDASEYGTLLQMMLNRIELPEAPEFLILPQADGNARPALGVDALPDAAQICSCNDVSKGALCQAVCAGATTVGALKDATRAGTSCGGCVPLMTQVMKAEMKKQGLAVNNHICEHFPYSRQELYHLVRVGRIQSFEALLAAHGHGMGCDICKPAAANILASCWNDFVLKKEHAGLQDSNDYFLANIQKDGTYSVVPRMPGGEVTPEGLIAVGQVAKKYGLYTKITGGQRVDLFGARLEQLPLIWEELIAAGFESGHAYGKSLRTVKSCVGSTWCRYGVGDSVGLAIRLENRYKGLRSPHKLKFGVSGCTRECAEAQGKDVGVIATEKGWNLYVCGNGGMKPRHAELLAADLDEATLVKLVDRFLMFYVRTADRLQRTSTWRDNLEGGLDYLKDVIVGDKLGFAAELEAEMQHVVDTYQDEWKTAVTNPEVRKRFRHFVNSETADANVVFVEERGQIRPATPEERRGTRPVRIPVVAEAA

SEQ ID NO: 10499 - protein, 705 aa, Clostridium tetani
MSHVLETDIAGRTLKVEYGKVGMLSNCAILVSYGDTVVLINANASKEPRDGIDFFPLSVEYEERLYSVGKIPGGFIKREGRPTENAILHARAIDRPLRPLFPKGYRNDVQIVCTVLSVESDNQPDILAMNGASLALCLSSIPFTTPVANVSVGLINGDFILNPTQSQREESILNLTVSATKERVMMIEAGAEEVDEDTMYNAIRFGFEQCQKIVEFQEEAMRRFGKEKVEPVLYLVDKDIEKEVREFAFPMVKEAMYISDKDLRNEKIDEVKEKVKEEFEEKYPENDSDISEALYKMQKEVVRNMILREKRRPDERAFDEIRKISCEVGLLPRTHGTGLFTRGLTQVMTAATIGPLADVQILDSIEDEEFKRYMHHYNFPSYSVGETRPLRGPGRREIGHGALAEKALEPLIPSEEDFPYTIRLVSEVLSSNGSTSQASVCGSTLALLDAGVPIKRPAAGIAMGLVTNDDLTEEKILTDIQGIEDFFGDMDFKVAGTEKGITALQVDTKISGLSDNCIKETLIKAKDARMYILGKIKECIPEHRAELSPYAPRVYTMTIAPEKIRDVIGAGGKTINKIIGETGVQIDIKEDGKIYVMSSDSVGANRALKMINDLTKDVEAGEIYLGKVTRTTNFGAFVEILPGKEGLVHISKLDFTRVNKVEDVVSVGDEILVKVTDIDDQGRINLSRRDAIKKEEDEKTKENNH

SEQ ID NO: 10500 - protein, 441 aa, Ralstonia solanacearum
MTGKATRIDLFSLRTPQMRAFHLTWLAFFVCFYAWFACAPLMPVLKGEFHLTPGQIANINIAAVAVTILVRLIVGPLCDRFGPRKTYTGLLVLGAVPVLGVALAQSYEAFLFFRLAIGAIGASFVITQYHTSVMFAPNVVGTANAAAAGWGNAGGGVAQGTMPLLLTAIVMLGVTQGMGWRLAMVVPGVAMLIVAVLYWRYTQDCPEGNFDDLRAAGKTIEGGKKGGWGSFVTAAGNYRVWLLFVTYGACFGVEIFIHNIAAIYYVDHFGLSLSAAGMAAASFGLLALFARALGGIVSDRVARSRGLDARTLLLCVLMVGEGLGLLGFAHAGTASLAVLAMLGFGLFTHMACGATYALVPFIDRRALGGVAGIIGAGGNVGAVAAGFLMKGLGDAQQTLSVLGVMVMLSAICAVAVRFSAEHKAREQALYDNTLAAGAANV

SEQ ID NO: 10501 - protein, 105 aa, Oryza sativa
MEGVGARQRRNPLIPRPNGSKRHLQHQHQPNAAEKKTAATSNYFSIEAFLVLVFLTMSLLILPLVLPPLPPPPSLLLLLPVCLLILLVVLAFMPTDVRSMASSYL

SEQ ID NO: 10502 - protein, 694 aa, Clostridium thermocellum
MEIIVAKSAGFCFGVSNAVKTVNNLLENQKEPIYTYGPIIHNAQVVDLFTSKGVKKIDDIDEAEPNGHIVIRAHGVTPDIYKKISDKGLILEDATCPYVKKIHNLVKEKSEEGYKIIIVGDRNHPEVIGINGWCNNQAYIVDSVDDVEKFPTSDEKVCVVAQTTITNEKWLEVNTALKKKFKNILKFDTICSATSRRQNEAEEIAKNVDMMIIIGGKNSSNTQKLYDICKKHCNLTYKIETSGDLPPVDIKKIKKVGISAGASTPDWVIEEVIKKMSELNKQGMVDILENDGEIDFANAFENSFVRIHAGDTVKGKIIGFNSNEVFVDLGYKADGIIPLEEYTDDPNFNIEKEVKIGEEVEVLVEMVNDGEGNVRLSKRKVDAIKSWDDIVKAYENKTPVNAYVVEVVKGGVIASYKGVRIFVPASQVSDRYVKDLNEFLKRSITVRILELNEKRRKVVGSARVIIEEEKEALANRTWNSMEVGKVFKGTVKSLTDFGAFVDIGGVDGLIHISELSWTRVKHPSEVLKVGDEVEVTVLEFDKEKKKVSLGYRKMEDNPWYKIEEKYKVGDVVKVTVLRFAPFGAFVELEKGVDGLVHISQISSKRLAKVEDALEIGMKVDAKIIEVDGENKKISLSIKEVMPIDPPSSKSESKAKDGSEAKETSANTEEEAEPTEHREDMNVTVEDLVSKTTQS

SEQ ID NO: 10503 - protein, 472 aa, Unknown
  Vibrio sp. Ex25
MENIENMTYAPVSDVLRGQLAVDSEVTVRGWIRSRRDSKAGISFLAIYDGSCFDPIQAVVPNNLNNYEDEVLKLTTGCSVEVTGKIVESPAKGQDFELAATGVKVVGWVEDAETYPMAKTRHSIEYLREVAHLRPRTNVIGAVARVRNCLSQAIHRFYHEQGYFWVSAPLITASDAEGAGEMFRVSTLDMENLPRTDAGKVDYNEDFFGKETFLTVSGQLNAEAYACALSKVYTFGPTFRAENSNTSRHLAEFWMVEPEVAFAELDDVAKLAEDMLKYVFKAVLEERRDDLEFFAQRIDKEAVSRLENFVSSDFAQVDYTDAIQILLDSGREFEFPVEWGIDMSSEHERFLAEEHFKAPVIVKNYPKDIKAFYMRMNDDGKTVAAMDVLAPGIGEIIGGSQREERLDVLDTRMREMGIDPEHMSWYRDLRRYGTVPHAGFGLGFERLVSYVTGMGNVRDVIPFPRTPRSANF

SEQ ID NO: 10504 - protein, 454 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 10505 - protein, 482 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMVVSGGEEGARNGPSLMPGGSFEAYKYVKDIVLKVAAQVPDSGPCVTYIGKGGSGNFVKMVHNGIEYGDMQLISEAYDVLKFVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 10506 - protein, 274 aa, Unknown
  Polaromonas sp. JS666
MKNSKVRPTPDGEHVLVAGGRCLLVGAGPGDPELLTLKALKAIQNATVLLVDDLVSDEIVAFARPDARIVHVGKRGGCKSTPQAFIEKLMIMAAREGENVVRLKGGDPFIFGRGGEEVEHLKAAGVEVEVINGITAGLAAVTSLGVPLTHRQHAHGVVFVTGHAKPGDAGTDWAALAATAAQARLTLVIYMGVTGSQHIQDQLLQGLPADTPVAIIQNASLPGQRHAITTLATMRTTIAREHLQSPSVIVVGDVLRGVALLAEHPEEQKLREFG

SEQ ID NO: 10507 - protein, 197 aa, Oryza sativa
MVGGGAGADAGIDRVLWTEAEIAARVSEVAAELAADLRALREPAVVVGVATGAFLFLADLVRRVDAPLAVDLVRAESYGDGTESSGRPRITSDLKVDVAGKHVVVVEDIVDTGNTVSCLIAYLEKKGASSISVCTFLDKPARRTANFQLVGDGKFYRGFECPDSFVVGYGMDYAELYRNLPYVGVLKAEMYKKDTSN

SEQ ID NO: 10508 - protein, 88 aa, Unknown
  Synechococcus sp. CC9605
MPDGVKHFVCPDDEYVLEAAEQAGIDMSYSCRAGACSTCVGKIIEGTVDQSDQSFLDDEQMEDDYTLLCVAYATSNLIVKTDCEEELW

SEQ ID NO: 10509 - protein, 265 aa, Arabidopsis thaliana
MATTNSLHHHHHSSPSYTHHRNNLHCQSHFGPTSLSLKQPTSAATFSLICSASSTSSSTTAVSAVSTTNASATTAETATIFDVLENHLVNQNFRQADEETRRLLIQISGEAAVKRGYVFFSEVKTISPEDLQAIDNLWIKHSDGRFGYSVQRKIWLKVKKDFTRFFVKVEWMKLLDTEVVQYNYRAFPDEFKWELNDETPLGHLPLTNALRGTQLLKCVLSHPAFATADDNSGETEDELNRGVAVAKEQAEVGADKRVFKTNYSF

SEQ ID NO: 10510 - protein, 374 aa, Campylobacter coli
MELSYYEILEITQSADKDTIKKAYRKMALKYHPDRNQGDKEAEDKFKLVNEAYEVLSNEEKRAIYDRYGKDALKGGGFGSGGAGFGGFEDLGDIFSSFFGGGFSGASQRRKKSSDEKFQAELVVNLKLSFKEAVFGCKKNIDFTYKSSCKTCSGTGAKDGKLQTCPKCKGRGQVGISQGFITFAQTCPDCKGSGESASEKCKDCKGRGYEELKDSVEVNIPEGIDNGMNLRVAAKGNLSKSGNRGDLYVKVIVEEDDTFIRDDEDIYIEFPVFFTQAILGQSIKVPTIRGEATLNLPKGAKDGQRFVLEKEGVKDVHSSRIGNQIVQIAIKFPNSLNDEQKELLEKLSESFGIKDGMHHEQKGLFEKITHWFKS

SEQ ID NO: 10511 - protein, 297 aa, Unknown
  Synechococcus sp. CC9605
MYTARSNLSTIILDKNPAVGALAITHKIANYPGVEGDTSGEALLKTMRVQAFNYGAEYKQAQVYGINMTDSEKTVYTPEGTFVGKTLVLATGAMGRESTLPGENEFLGKGVSYCATCDGAFYKNQEVAVYGSNHEAIDEALVLTKFASTVHWITNNKPNGNSPAVEILLNSKNVKHWKRTRLTSIQGDDQGVNAVKVQLSGGREEQMIQVQGAFVYSTGSLPITDYLQEQVPVNPNGGVRVNSDMMTNLEGVWAIGDIRNTPFKQAVVACSDGCIAAMAIDKYLNKRKDVRVDWVHR

SEQ ID NO: 10512 - protein, 720 aa, Debaryomyces hansenii
MDTTNKDPEKKEDENGTRKTVEVENGLLTRILTIISYDLVLWFFSAVIHTFFREVKSRGTFNIPKKGAIVFVIAPHANQFIDPIVVMSSVKQYSRRRIAFLVAAKSYRRKFIGTGAKFTGAIPVERAQDLLRKGTGTIKLQDLEDGTIVEGEGTLFTKECMKKGLIGLPESLGNAVIESIESDTKLTLRKTFQINVSDPKEADKRRIQRLTEGTPFKVAPHVDNNCVFQHVFDHLNGGNVLGMFPEGGSHDRPDLLPLKPGVAIMALGAAAKSEDPDAVINVIPVGMNYFHPHKFRSRAVIEFGKPIKVDKKLGKKYEENPKDSVAKLIDVITLGLKEVTVTCGDYDTLMALQAARRLYTSSNRESIPLPLVVEMNRRLVKGYQKYSNDPDVIEMKTLVSNYNKKLMRMGLHDHQVESLTETNRIHTFVTFAARLFKVFLFLGLSMPGIFLFSPVFIVGRRIARKKAKEALAGSVVKIKANDVLGTWKILVALVLAPSLYIFYSIIGTFLIIKLNITKDKVPTVIIFLVCYGWSVLTTYASLRIGEIGVDYYKSLKPLFYSLLSHHKDIIQIEDLKRNRTLLAEKVTEFCNSYGPSMFEDFDRFYRQYNNIESSEYVNESESDIENVPVSNTVNRPSMSLLRSASFNINNLADVPIFSIPGFLDLQSDVGDDGSKGEHESDESSSFDTSDIEASDVGDLQKSKLRLRNAMKSKFNAENNP

SEQ ID NO: 10513 - protein, 552 aa, Deinococcus radiodurans
MTQAHPEWYKSAVFYELSVRTFQDGNGDGKGDFPGLTSRLDYLKNLGVDCLWLLPWFPSPLRDDGYDVADYRGIHPDLGTLDDFKVFLREAHARGLRVIGDLVTNHTSSDHPWFQAARRGPTLPDGSPNEYHDYYVWSDEGKEYADTRIIFTDTEVSNWTLDEQAGKYYWHRFFASQPDLNYDNPKVVEELHGAARFWLDLGLDGFRVDAVPYLIEREGTSCENLPETHEILKGFRAMVDREYPGRLLLAEANQWPEEVVEYFGTEAEPEFHMCFNFPVMPRLYMSLKREDTSSIREIMGRLPKIPSFGQWCTFLRNHDELTLEMVTDDERAFMYAAYAPDARMKINVGIRRRLAPLLDNDRRRIELLNTVLLALPGSPILYYGDEIGMGDDLGLPDRNGVRTPMQWNAGTSGGFSTAQPSDCFFPPIQDPVYGFGRVNVQSQLQDPSSLLKWTARQLELRRAHPAFAHGDLTFIETGNPAILAFTRQYDGETLLIVSNFAGNAQAGLLDLAPFVGRAPVTLSGASPLPVVTGNGQYPVVMGKYDYYWLRLN

SEQ ID NO: 10514 - protein, 257 aa, Prochlorococcus marinus
MKRERNNSLDPLEISEWRWSEFLDDAIKALELFDIEPYPIPEEFLTKEETIKFKNNQIKVKALTWACRTTKIRQARAACIEAGPAASVLNLVINPFHNFELPFFGADFVTLPSGHLLALDLQPVLKKDEIHNQKVWSKLIPIHDHWQSLLPSGGPIPQEAETFFSPGFLWTRLPLDDQGSKLISKVIRPAFQEYLTLYIDLISDAQEVSKERSLEILSGQKAYINYRAEKDPARGMLARFFGKDWTEQYIHKVLFDL

SEQ ID NO: 10515 - protein, 368 aa, Escherichia coli
MVNPHLWQPGEGYLYELYVTAKSRTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 10516 - protein, 237 aa, Escherichia coli
MLRPVETPTREIKKLDGLWAFSLDRENCGIEQRWWESALQESRAIAVPGSFNDQFADADIRNYVGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGAPAGLCKW

SEQ ID NO: 10517 - protein, 199 aa, Haemophilus parasuis
EAGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYNEMQAIFAEWKKTELDSYLIDITTDILGYKDTDGTPLVEKILDTAGQKGTGKWTGINALDFGIPLTLITESVFARCVS

SEQ ID NO: 10518 - protein, 199 aa, Haemophilus parasuis
EEGDIVIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKNTELDSYLIDITTDILGYKDTDGTPLVEKILDTAGQKGTGKWTGINALDFGIPLTLITESVFARCVS

SEQ ID NO: 10519 - protein, 199 aa, Haemophilus parasuis
EAGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKNTELDSYLIDITTDILGYKDTDGTPLVEKILDTAGQKGTGKWTGINALDFGIPLTLITESVFARCVS

SEQ ID NO: 10520 - protein, 426 aa, Arabidopsis thaliana
MENMFRLMDQDQDLTNNRCIWVNGPVIVGAGPSGLATAACLHEQNVPFVVLERADCIASLWQKRTYDRLKLHLPKQFCQLPKMPFPEDFPEYPTKRQFIDYLESYATRFEINPKFNECVQTARFDETSGLWRVKTVSKSESTQTEVEYICRWLVVATGENAERVMPEIDGLSEFSGEVIHACDYKSGEKFAGKKVLVVGCGNSGMEVSLDLANHFAKPSMVVRSSLHVMPREVMGKSTFELAMKMLRWFPLWLVDKILLVLSWMVLGNIEKYGLKRPEMGPMELKSVKGKTPVLDIGAIEKIRLGKINVVPGIKRFNGNKVELVNGEQLDVDSVVLATGYRSNVPYWLQENEFFAKNGFPKTVADNNGWKGRTGLYAVGFTRKGLSGASMDAVKIAQDIGSVWQLETKQPTKRSRGSLRRCISQQF

SEQ ID NO: 10521 - protein, 425 aa, Prunus persica
MAPEPEDIKDEKNPRPLDEDDIALLKTYGLGPYSTHIKKAEKEVKDLAKKVNDLCGIKESDTGLAAPSQWDLVSDKQMMQEEQPLQVARCTKIINPNSEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 10522 - protein, 131 aa, Photobacterium profundum
MSDVMKVLLNLRSLRALSREYTVEQLQEALEKLQTVVSERTEAEAEDLAKETERKEKLDHYRELLMADGIDPEELLSSLAKAPKAKRAARPAKYKFIDENGEEKTWTGQGRTPSALKKALDDGKSLEDFEL

SEQ ID NO: 10523 - protein, 205 aa, Oryza sativa
MEPKSTTPPPPPPPPVLGAPVPYPPAGAYPPPVGPYAHAPPLYAPPPPAAAAASAAATAASQQAAAAQLQNFWAEQYREIEHTTDFKNHNLPLARIKKIMKADEDVRMIAAEAPVVFARACEMFILELTHRGWAHAEENKRRTLQKSDIAAAIARTEVFDFLVDIVPRDEAKDAEAAAAVAAGIPHPAAGLPATDPMAYYYVQPQ

SEQ ID NO: 10524 - protein, 754 aa, Solanum lycopersicum
MMKKVVSWLLFLSIVASLWVVDGYIECPCDDSDAFFSMETMLFVQKAGDLGIAVAYFSIPIEIIYFVSCSSFPFKWVLFQFGAFIVLCGLTHFLTFLTHFGKYTFHLILALIVCKLLTALVSMLTAITLMNLIPLLLKAKAREFMLRRKNRELDREVEKIKQLEELGLHVRMLTNEIRKSIDRHTILYTTLVGLSKLLSLQNCVIWMPNENRTEMKLTHDTTRENVSSVYNVPIPISDREVKEIKGSDDVKILGADSRLAAASSRGSCEPESVAAIRIPMLTVSNFRGETREIVSQCYAILVLVQPCGHGRFWLNQEVEIVRAAADQVAVALSHAAVVEESEYIKDRLTEQNQALQKAREEALRASQARSSFQTVMSHRLRRPMHSILGLLSMLQEQKLRDEQQLLVHSIIKSSNVVSTLMDDVIVTSTKENVKFPLEMKHFQLHSLIREAACTAKSLCMYKGYNITIEVEKSFPNKVMGDERRFFQVLLHIIGNLLNGIHGGHLTFKVLSASENDVSWKTPRSNSSNDIVYIKFEICTKFNRSQSEITPAPPTYDTEEIEESLSFAVCRKLVHLMQGDIFIIRNLADFDQGMAVIVGFQRQPLIPLGMSEYVESSNPTYPHPVLRGVEVLLADYDDSNRAVTKKMLEKLGCIVTLVSSGYECLGAVGPVVSSLQIILLDLHLPDLDGFEVTMRLRKHRRQTWPLIIGLAAITDEDIRKCLKIGMNGIICKPLLLSGLADELQKVLLHANRGMP

SEQ ID NO: 10525 - protein, 565 aa, Saccharomyces cerevisiae
MKRTVISSSNAYASKRSRLDIEHDFEQYHSLNKKYYPRPITRTGANQFNNKSRAKPMEIVEKLQKKQKTSFENVSTVMHWFRNDLRLYDNVGLYKSVALFQQLRQKNAKAKLYAVYVINEDDWRAHMDSGWKLMFIMGALKNLQQSLAELHIPLLLWEFHTPKSTLSNSKEFVEFFKEKCMNVSSGTGTIITANIEYQTDELYRDIRLLENEDHRLQLKYYHDSCIVAPGLITTDRGTNYSVFTPWYKKWVLYVNNYKKSTSEICHLHIIEPLKYNETFELKPFQYSLPDEFLQYIPKSKWCLPDVSEEAALSRLKDFLGTKSSKYNNEKDMLYLGGTSGLSVYITTGRISTRLIVNQAFQSCNGQIMSKALKDNSSTQNFIKEVAWRDFYRHCMCNWPYTSMGMPYRLDTLDIKWENNPVAFEKWCTGNTGIPIVDAIMRKLLYTGYINNRSRMITASFLSKNLLIDWRWGERWFMKHLIDGDSSSNVGGWGFCSSTGIDAQPYFRVFNMDIQAKKYDPQMIFVKQWVPELISSENKRPENYPKPLVDLKHSRERALKVYKDAM

SEQ ID NO: 10526 - protein, 101 aa, Glycine max
MVTMVFDLGPAKCYRQIKNKSYSKSRFCHSVPDPKTRIYDVGMKKKGVDEFPFCVHLVSWEKENVSSEALEGAFHLRVRVHPFHVLRINKMLASWVPWTIG

SEQ ID NO: 10527 - protein, 1484 aa, Candida albicans
MSDIPPTNESNSDSTLINQNNNGNNDNKETGKDISSTHTHHRVTFAEQQPISTSSRKSSLLRKHSSNNTSSDSDKRPSIISRNSNPDIHRDSLPPLNRGPSYNGNYTRSHSSRNVNANNTINTGVTSDSNSNNNVDSNAPISSPATPAISSPPANSKYFNLTLPAGKSREKSPGRHSKEGHTRSRSFTKQQHGIGSTSSQSSSQYLAQEKAYLRKMRNQSVDDYYSKGIPGAHEVSKADDNDDEDDDDDEEHSSFDGGDNANLLAAIDDDKYQIDYSMALSLMKNSNVNLRKIANLNTDDTDDPAIIERLEWQSMLTSVLTGDVVRSEKTKIININNPDSTQESYLHATFKENLWFGIRAKIFNRTEDEQRKIVAYRRTLVDQLIDDVMKFEIDYENSTDNPIRDQVKTILDRYDQACSLWKTLEDMYSDKPACRSEEFQNRIDALTAWLTITDAISRETKSLRLWIGNDELDITKSPVEVSSSNAATSTSKIVKKIFDEDNKSLAERLMKEKDVQTIFRKRIFKPIAPWMIKSKDTYIRLGVIFENMKLPDYLHDLLQICIIPVRLIKEIVIVRLGYAMKLQNPTLMMIDQMLDDFKSYITVALEVKSGISEYKEPDEDRKWLISDLFDSELEDFDNVILRCVRYFLVLLNRKLLDSSRSPTTFRTFKEPEELEEAWNFLKPLGHYVDGGSVVVAEEITMLASRLIHRLMAYFNHQIREPTYNGVPQDLIRWYSSTSENFGQLRRKLARFMGEISRDFKNSVVFDIPSQSNCTKTLLEILRSSNHFLVYTGTVETQGTYFFASPELLGNEQEILKILTGSCVGLDPSTDNSHFTDLLHLIRSGSEEHLRYNDDDLDSYDDSNGAYAYVLALCPMKPIVWDGLVVNVDIDSVPITDMKNGELLLVSKLSYYDLHIVRNRFLEVASEVSLGNAGLKQVEYRCSLAKVNQELKKMNRVVFKMCSSVLESVQVIKTRIAELDPVGEYQALINSYFIYARDYGKNSVRTLDPQRKSTIIMKMIQLSIDWVSFICDDCIPTDRKTFRWCVLALEFSMEMIRGINIFLLTEEQFTKLKVKVARCMSLLISHFDIMGARSSEAEKNKLLKWTAQRHNIASSQNDDEYLNKVYHEEVMGQINKIEERRRNLQEEFQSIGRVLDVSDSEYQFLTLLASSFSSVSIRWQKGACIGRGTFGQVFSAVNLDTGGVMAVKEITFHDSQSVKTIVPSIKEEMTVLEMLNHPNVVQYFGVEVHRDKVYIFMEFCEGGSLAGLLTHGRIEDEMVIQVYALQMLEGLAYLHQSGVVHRDIKPENVLLDHNGVIKYVDFGAAKVIASNGRTIGGMTNSSLRKSVKRDGHNNLNSMTGTPMYMSPEAITGTSTDRSGVVDIWSLGCCVLEMATGRRPWANLDNEWAIMYHIAAGHKPQLPSPEQLSEPGRTFLARCLEHDPTKRPSAVELLADPWMVEIRHMAFGNSDVTTTPLSEVAGPVSE

SEQ ID NO: 10528 - protein, 549 aa, Yersinia pestis
MEIFFTILILILVVSLSGVVTRMLPFQVPLPLMQIVCGALLAWPNFGLHVNFDPELFLVLFIPPLLFADGWKTPTREFIHHGREILGLALALVLVTIVGIGYLIYWMVPGIPLVAAFALAAVLSPTDAVALSGIVGKGRIPKSIMGVLEGEALMNDASGLVALKFAIAVAMGTMIFTVSGATLEFLKVAIGGLLAGVAITWLYSKSLRIMSRWSGDDPATQIVLLLLLPFASYLVAEHLGVSGILAAVAAGMTISQSGIIRNAPLAMRLRADSVWSMLEFVFNGMVFILLGLQLPGILETSITQAELDPTIQTWNLFADVAIIYGALLLLRFGWLWSMKKISKRVLTKRPLQFSDYTTRELWVASFAGVRGAITLAGVLSIPLFLSDGSAFPSRYQLVFIATGVILLSVIIGVIALPPLLRGVVVADKSASREEIRLARAAMAEVAIVSLNKMEERLMTSSEENIDSELLKEVSSRVIGTLRRRTGSKDEVENTLLIENLERRFRLTALRAERGELYHLRATQKISNETLQKLLHDLDLLEALLIEKEG

SEQ ID NO: 10529 - protein, 146 aa, Unknown
  marine gamma proteobacterium HTCC2080
MQFLHTMIRASSLDSTLDFFCNKLGLIEVNRYDSEAGRFTLVFLAAPDDVERAHTDQAPLVEITYNWDSEIYDGGRNFGHLAYRVDDIYATCASLMSKGVTINRPPRDGRMAFIRSPDGISVELLQAGDALSAAEPWASMENTGSW

SEQ ID NO: 10530 - protein, 386 aa, Ustilago hordei
MQAEEDTYLRYKKLQQHLEFLNTMEEYVKDEQRNLKRELVRAQEEVKRIQSVPLVIGQFLEPIDQHTGIVGSTTGSNYVVRILSTIDRELLKASSSVALHRHSNALVDVLPPEADSSIAMLGQDEKPTETYQDIGGMDIQKQEIREAVELPLVQFDLYLQIGIDPPRGVLLYGPPGTGKTMLVKAVANATTASFIRVVGSEFVQKYLGEGPRMVRDVFRLARENAPAIIFIDEIDAIATKRFDAQTGADREVQRILLELLNQMDGFDQGSNVKVIMATNRADTLDPALLRPGRLDRKIEFPTPSRREKRLIFQTICGKMNLSPEVDLEDYVGRPDKLSSAEIASICQAAGLQAVRKNRYVIMPEDFEEAWKQIVKKPDDSKMDFYQ

SEQ ID NO: 10531 - protein, 184 aa, Triticum aestivum
MMQRRRDRINEKMRSLQELIPHCNKADKASILDEAIEYLKSLQMQVQIMWMTTGMAPMMFPGSHQFMPPMAVGMNSACMPAAQGLNQMARVPYMNHSLSNHIPMNPSPAMNPMYIANQMQNIQLREAASNHFLHLDGGQATAPQVAGPYAYTPQVAPKSQIPEVPDCTVAPISGPGQPPAPDGI

SEQ ID NO: 10532 - protein, 360 aa, Glycine max
  misc_feature (108)..(108): Xaa can be any naturally occurring amino acid
MMSWACRSEESESPNNLIPYLPNDVALNCLARIPRSHHPTLSLVSKPIRSLLYSPLLFTTRSLLQCTQPLLYLTLRSRDSSLQWFTLHRTNPNPLLAPLPPIPSPAVXAPPTPVLGPTIYVLGGSIQDVPSPHVWLLDCRFHRWLRGPPMRVAREFAAAGVLHGKIYVLGGCVADTWSRSANWAEVLDPASGRWERVASPTEVREKWMHASAVVGDRIYAMADRGGIAFEPRSCAWESVGGELDHGWRGRACVVEGILYCYDYLGKIKGFDVGRGVWEELKGLENALPRFLCGATMADLGGKLCVVWECQCNGKEMEIWCAEIGVKKNSDGELWGQLGWFGKVLSVPKGSSIVNCSSVSL

SEQ ID NO: 10533 - protein, 491 aa, Oryza sativa
MSSYVTTPHHHHHHGCCSGSRRLQAPAPPARPRLVVAAAARHVALPPRRAVASRAMSAEAPLGVAPAAAEEEMAAVVDEMAEEAAVWCAVHGLVVGDRAEPRSGTIPGVGLVHAPFALLPTRFPASFWKQARELAPIFNDLVDRVSLDGEFLQDSLSRTRQVDDFTSRLLDIHAKMMEVNKEEDIRLGLHRSDYMLDSGTNSLLQIELNTISSSFPGLSSLVSELHRTLLNRHGKVLGLDSKRIPQNWAATQFAEALSMAWTEFNNKRDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDLTISELGIFGAYLRNKDKVVLNNQCGYLMRTKVSSSNEGGVAAGFAVLDSILLTDEVILHTN

SEQ ID NO: 10534 - protein, 112 aa, Unknown
  Magnetococcus sp. MC-1
MKWIVAIIKPFKLDEVREALTSVGISGITVSEVRGFGRQKGHTELYRGAEYRVDFLPKLKVELAVDDSILEQAVEAIQKGAKTSKIGDGKIFVYDLESAVRIRTGESGPSAL

SEQ ID NO: 10535 - protein, 485 aa, Oryza sativa
MSSYVTTPHHHHHHGCCSGSRRLQAPAPPARPRLVVAAAARHVALPPRRAVASRAMSAEAPLGVAPAAAEEEMAAVVDEMAEEAAVWCAVHGLVVGDRAEPRSGTIPGVGLVHAPFALLPTRFPASFWKQARELAPIFNDLVDRVSLDGEFLQDSLSRTRQVDDFTSRLLDIHAKMMEVNKEEDIRLGLHRSDYMLDSGTNSLLQIELNTISSSFPGLSSLVSELHRTLLNRHGKVLGLDSKRIPQNWAATQFAEALSMAWTEFNNKRDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDLTISELGIFGAYLRNKDKVVLNNQCGYLMRTKVSSSNEGGVAAGFAVLDSILLTDE

SEQ ID NO: 10536 - protein, 571 aa, Debaryomyces hansenii
MTNLLASLKCSDDIHLIIGASNVASLRINSILEAGAKPILISNQPSEKFPKSIQDNIAKGNLKHIEKEYENGDLSSLGRSEVDNIVDRVFVTLPISQYEVKKEIYQSCRKLRIPVNVSDSPEFCTFSLLSTFTSGDFQMGVSTLGKGCKLAARIKRELSHTLPGNIGSICDKIGDLRTRIQEEDKLELEKLQGDIDWIGEHDDDAITTSKLNSLVEEFNMTKEQRKLQRTRWLSQIVEYFPLTTLADLSLEDLSVAYKEYNSIVKTEAEPKEPSHKKLKTGKKGSISLVGSGPGSISLLTLGALQEIHSADLILADKLVPQQVLDLIPKHRTKLFIARKFPGNAERAQKELLDMGLESLMKNEKVVRLKQGDPYIFGRGGEEFNFFAEHGFTPLVLPGITSALAAPVLTNIPATHRDVADQVLICTGTGRRGTLPNLPEFIKSRTTVFLMALHRVVDLIPKLIDDKNWDPNLPAAIIERASCPDQRIVRTTLSNVAQAVEACGSRPPGLLVTGYACEVITKPNTDEKWVIEEGCASASNPLLEPFLQLARSIGKDHLHVLQPQTISLEQTA

SEQ ID NO: 10537 - protein, 296 aa, Gloeobacter violaceus
MAHAATRTFEVPVNIYRPASPFRGKALQNINLTPDDPDNDVRHVVLDLSGGDLRYFEGQSIGIVPPGTDAQGKPHKLRLYSIASSRIGDNKDGKTVSLCVKRVVYKHPETGEIVRGVASNFICDLAPGDDVSITGPTGKTFLLPEDPSTNLVLIATGTGIAPFRAFLRRIYDEMDTPWQGKVWLFFGMQNSNSYLYQDELAGYTAKGDFEIVEAISREQKNAQGGRMYVQHRIAEHAAALWELISGGNTYTYICGLKGMEDGIDDAFTAAAAAKDTVWKDYRYNLKQSGFWHVETY

SEQ ID NO: 10538 - protein, 136 aa, Neurospora crassa
MARTKQTARKSTGGKAPRKQLASKAARKSAPSTGGVKKPHRYKPGTVALREIRRYQKSTELLIRKLPFQRLVREIAQDFKSDLRFQSSAIGLLQESVESYLVSLFEDTNLCAIHAKRVTIQSKDIQLARRLRGERN

SEQ ID NO: 10539 - protein, 314 aa, Leptospira interrogans
MHSLMKPTREPQINLFKKSNPYKAKVISNVLLTPETGTGKRPKKEGEALVHRIVLAIDHSAYPYVIGQSGGVIPPGEDPEKKAKGLADVGYTVRLYSIASPSYSFGMKEDNIEFIIKRDNIYDENGNIQFKGVCSNYMCDLKPGDEVTMTGPSGKKFLLPNTDFSGDIMFLATGTGIAPFIGMSEELLEHKLIKFTGNITLVYGAPYSDELVMMDYLKGLESKHKNFKLVTAISREEKNSFDGGRMYISHRVREQAEAVKKILNGGGRFYICGGPKGMEKGVIEEIQKISGNTGTYEEFKHHLEGAHQLFVETY

SEQ ID NO: 10540 - protein, 572 aa, Nitrosomonas europaea
MTIATSVAGSSENFAELFNESLSHKEMRVGEVITAEIIRVDYNFVVVNAGLKSESYIPIEEFKNDRGEIEAREGDFVSVAIEALENGFGETRLSRDKAKRLNAWYELEEAMEKGKIVTGMVNGKVKGGLTATINGIRAFLPGSLVDIRPVKDMTPYENKEMEFKVIKLDRKRNNVVVSRRAVLEETQGADRDELLASLQDGAVVQGIVKNITDYGAFVDLGGIDGLLHITDLAWRRVKHPTEVINVGDEVTAKVLKFDQEKNRVSLGLKQLTEDPWIGLSRRYPQGTRIFGKVTNMTDYGAFVEIEQGIEGLVHVSEMDWTNKNVYPSKIVQLGDEVEVMILEIDEDRRRISLGMKQCRPNPWEEFSLSHEKGDKVTGQIKSITDFGLFIGLPGNIDGLVHLSDLSWNQPGEKAISEFKKGDEVEAVVLSIDVEKERISLGIKQLEGDPFNIYVASHDKNSIVKGTVKSVDAKGAVIALTDEVEGYLRASEFSRDKIEDIRSRVNEGDEIEAMIINIDRKNRSISLSVKARIQDEEDKAVKSLASVSNPASAGTTNLGALLKAKIDSKSSEE

SEQ ID NO: 10541 - protein, 135 aa, Glycine max
MEVKLWNDKREREMYENFAELYAIIKATEKLEKAYIRDLISPSEYETECQKLIVHFKTLSATLKDLVPNIERFAETYKMDCSAAVYRLVTSGVPATVEHRAAAMASTSSSASVVAECVQNFITSMDSLKLNMVAV

SEQ ID NO: 10542 - protein, 421 aa, Clostridium tetani
MNVEELNPFKNVQKIMKKICEDLNLNESVYELIKEPSRIVEVNIPVKMDNGSIKVFKGYRSQHNNSIGATKGGVRFHQGVNLDEVKALSIWMTLKCAIANLPFGGGKGGIIVDPKTLSKGELERLSRGYVEKLYEVLGEDLDIPAPDVNTNGEIIAWMADEYNKLSRQNAWGTFTGKPVELNGSKGRTEATGLGVAIVAREALKKLNRNIENSSVAVQGFGNVGSHAALCIENLGGKIVSVSEWDREKGFYAIYDEKGLNIKELISYFNENGTLLDFPRTSKISEEEFWSLSVDVLVPAALENSINTNNANLINAKLVCEGANGPVTPAADEILEKKGIEVTPDILTNAGGVIVSYFEWVQNLDNYYWNEKDVKTREEEFLVEGFNNVWFMKDKFNCTMRNAAYMYAINKLAKSMKARGWY

SEQ ID NO: 10543 - protein, 432 aa, Triticum aestivum
MAERLASSASLLPSAASPSSSTRRAAVASGLRLRPSPSRFSQAARRARGGGGAAGVVPRLRVVRCMAASEAAQLKSAREDIKEILKTTYCHPILVRLGWHDSGTYDKNIEEWPQRGGADGSLRFDPELSHGANAGLTNALKLIQPIKDKYPGITYADLFQLASATAIEEAGGPKLPMKYGRVDIAAPEQCPPEGRLPDAGPRIPAEHLREVFYRMGLDDKEIVALSGAHTLGRSRPDRSGWGKPETKYTKDGPPGEPGGQSWTAEWLKFDNSYFKDIKEQRDQELLVLPTDAALFDDPSFKVYAEKYAEDQGAFFKDYAEAHAKLSNLGAKFDPPEGFSLDEDKGAVATEEKVVADPAPTSDTNGAGPQPEPFVAAKYSYKKRELSDTMKQKIRAEYEGLGGSPNKPMKSNYFLNIMIVIAGLAFLTSLTGN

SEQ ID NO: 10544 - protein, 532 aa, Glycine max
MGRDAPLTPSLFLQTLFPSLFLSLNPTFSLSKTLHHSPLPSDPSPVSLQFPPNTAGPHLLPFSRLLMSSAAGAPDRRASPPRVAAGAPTRPPLKRHLAFITKPPFAPPDEYHSFSSIGSRRAADEAVVVRSPYIMKRKSGMNDSEGESLAQKWSNSPGYTNVSNVTNNSPFKTPVSAKGGRTQKAKASKGRSCPPTPISNAGSPSPLTPASSCRYDSSLGLLTKKFINLVKHAEGGILDLNKAAETLEVQKRRIYDITNVLEGIGLIEKKLKNRIHWKGIESATSGDVDGDISLLKAEVEKLSLEEQGIDDQIREMQERLRNLSENENNQKCLFVTEEDIKDLPCFQNETLIAIKAPHGTTLEVPDPEEAVDYPQRRYRIILRSTMGPIDVYLISQFEEKFEEVNGAELPMIPLASSSGSNEQLMTEIVTAECSGKELEPQTQLSSHAFSDASQEFAGGMMKIVPSDVDNDADYWLLSDADISITDMWRTDSSVDWNGVDMLHPDFGVISRPQTPSSGFAEVPSTAANSIQK

SEQ ID NO: 10545 - protein, 158 aa, Treponema socranskii
MRRKLRIALVAHDNRKADIVDWALNNAEMLSQHRLFGTGTTGTLVRESFMKRGIASDITCMHSGPMGGDAEIAALVVRKEIDFAVFFIDDLNPQPHEADIQMLLRQCRIHNIPIACNRYSADLMITSSLWDDAGYVPKDPIYAPFDRKAFEESLKVKE

SEQ ID NO: 10546 - protein, 209 aa, Pseudomonas fluorescens
MTRHTETAILAGGCFWGMQDLLRRYPGVLHTRVGYTGGDVPNATYRNHGNHAEAIEIVFDPAVISYRQILEFFFQIHDPSTPNRQGNDLGPSYRSAIYYLNEQQRDIAEDTAADVDASHLWPGRVVTEIEPAGPFWEAEPEHQDYLERIPNGYTCHFIRRMEAPQARLKVEFVRRRGDRFRPFSALTTGGNQPGARGGLTNNTCQHPRH

SEQ ID NO: 10547 - protein, 139 aa, Glycine max
  misc_feature (130)..(130): Xaa can be any naturally occurring amino acid
MGKASRDKRDIYYRKAKEEGWRARSAFKLLQIDEEFNLFEGVKRVVDLCAAPGSWSQVLSRKLYLPAKLAPDAKDENLPLIVAIDLQPMAPIEGVIQVQGDITNARTAEVVIRHFDGCKADLVVCDGAPXCTGLHDMDE

SEQ ID NO: 10548 - protein, 146 aa, Vicia faba
MGFTQQQEALVNSSWESFKQNPSYSVLFYTIILEKAPAAKGMFSFLKDSAGVVDSPKLQAHAEQVFGMVRDSAIQLQATGEVVLKNGSLGAIHIQKGVVDPHFVVVKEALLKTIKEASGDKWSEELSIAWEVAYDGLATAIKKAMS

SEQ ID NO: 10549 - protein, 216 aa, Xanthomonas campestris
MLGIGAFKQRMPRPGEALPGREQALPLHNTHLVNGHPLRGEFTGLAQVQFGLGCFWGAERKFWNVPGVYTTAVGYAGGQTPNATYSEVCSGQTGHTEAVLVVFDEQAVSFAQLLRTFWESHDPTQGMQQGNDVGTQYRSAIYCTTQAQYDAALASRDAYQQQLTASGYGDITTEIRFPAPTFYYAEDDHQQYLAKHPNGYCGLGGTGVSCPIGLDA

SEQ ID NO: 10550 - protein, 206 aa, Legionella pneumophila
MNRTKSSKRWLQEHFDDVYVKKAQAEGYRSRAVYKLKEIDDKESLIKPGMTVVDLGASPGGWTQYASEKMKGSGRLVALDILPMDALPNVEFILGDFREDNVLQELINLIPQRTLDLLLSDMAPNMSGSSAIDIPRAMYLVELAFDFAEKMLKPGGNMLVKIFHGSGFDELVKQARASFEKVVIRKPSASRSRSKETYLLAKGYNL

SEQ ID NO: 10551 - protein, 291 aa, Nocardia farcinica
MAWNPTQIPDQTGRTFVITGANGGLGAETTKVLADKGATVVMACRNVAKAQQVADGIPGDVRVAELDLADLASVRAFAERAEEFDVLINNAGLMYIPFSRTADGFETQFGVNHLGHFALTGLLLDKIRDRVVTLASIAHRQTPKLWIDDLNYERRRYYRNLAYAQSKLANLMFARELQRRLAEAGSPKRSYAVHPGVSATELFARTETPLDRIAKPIIRLVGHPPAKAAHSTLFAATMPDADPGTYWGPNRLFQSQGPVEPSPSTRLSKNPELMRRLWAESERMTGVTYPV

SEQ ID NO: 10552 - protein, 361 aa, Photobacterium profundum
MSKEKILFIDRDGTLIVEPPVDFQVDRLDKLKLEPFVIPALLTLQDAGYKLVMVTNQDGLGTDSYPQADFDAPQNMMMEIFESQGVKFDDVLICPHFNEDNCSCRKPKLGLVKSYLQQGRVDFATSAVIGDRQTDLQLAENMAIKGIQYNPLPTDKSSLNWQQIVKDLTTNPRIAEVVRTTKETDIRVKVNLDETGGNSIETGLGFFDHMLDQIATHGGFQMQVNVKGDLHIDDHHSIEDTALALGQALKEALGDKRGIGRFGFSLPMDECLAQCALDLSGRPYLKFEAEFGRDQVGDLSTEMVSHFFRSLTDTLACTLHLSSTGHNDHHIVESLFKAFGRTLRQAIRVDGNELPSSKGVL

SEQ ID NO: 10553 - protein, 441 aa, Arabidopsis thaliana
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQGGLSMEASSSQPSDSSDQTASKFLSDLPSRGFLSSTVVSSNPGSLRVYICEHDTSPPEGQLIKTNQQNILIRSLLLKKQKGESSSKDSKGTAEDGPKKRAANRALDDRSSAKRAANASRQEGSSSRTGERDFQSLTVEKLRAMLKEKGLPTKGRKATSQSCTLNSILKNLSYGVASSSLFIVALVPLIDYGT

SEQ ID NO: 10554 - protein, 327 aa, Brassica napus
MASCIANDVTELIGNTPLVYLNSVAEGCVGRVAAKLEMMEPCSSVKDRIGFSMISDAEKKGLIKPGESVLIEPTSGNTGVGLAFTAAAKGYKLIITMPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVDLIDEVVQVSSDESIDMARLLALKEGLLVGISSGAAAAAAIKLAKRPENAGKLFVAVFPSFGERYLSTVLFDATRKEAESMTFQACIVSP

SEQ ID NO: 10555 - protein, 357 aa, Lycium ameghinoi
RYDQYKDAWDTSVAVEIKVGDIIETVRFFHCYKRGVDRVFVDHPMFLEKVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVP

SEQ ID NO: 10556 - protein, 398 aa, Aspergillus fumigatus
MIWANGANSDRLEFSTSKEVTVAPTFEDMHLKESLLRGIYAYGYESPSAVQSRAIVQICKGRDTIAQAQSGTGKTATFSIGILQVIDTVVRETQALVLSPTRELATQIQSVIMALGDYMNVQCHACIGGTNIGEDIRKLDYGQHVVSGTPGRVADMIRRRHLRTRHIKMLVLDEADELLNRGFREQIYDVYRYLPPATQVVVVSATLPYDVLDMTTKFMTDPVRVLVKRDELTLEGIKQYFIAVEKEEWKFDTLCDLYDTLTITQAVIFCNTRRKVDWLTDKMREANFTVSSMHGEMPQKERDSIMQDFRQGNSRVLISTDVWARGIDVQQVSLVINYDLPTNRENYIHRIGRSGRFGRKGVAINFVTSDDVRILRDIELYYSTQIDEMPMNVADLLS

SEQ ID NO: 10557 - protein, 400 aa, Psychrobacter arcticus
MAIHKIRAFFNLEASGGIVLALAAIAAMIIANTSLNTWYESFIHAPVAIQIGSFSIAKDAHHWINDGLMAVFFFLVGLELKREVLIGELSNVKQIILPAGAALGGMVMPAIVYLFFNYNEPEFWRGWAIPTATDIAFALGILSLLGNRVPNSLKVFLVSIAIFDDIGAIIIIALFYTNDLSLGSLAIAGLCLPFLYMLNRRNVTSITPYLLIGVIMWIAVLKSGIHATLAGVVLALFIPLFDRTDPEHSPLEELEHDLQNTVSYGILPLFAFANAGISLKGAGFGELFHSVPLGIAAGLFIGKQVGVMLMCWLIFKLGISTMPKGMNFKQIYGAALLCGVGFTMSLFIGGLAFAGETPLFDERLGIIMGSIVSGIAGYMMLKTTLKDEVNVTSVDLTRHS

SEQ ID NO: 10558 - protein, 410 aa, Unknown
  Ralstonia sp. JS705
MATHVAIIGNGVAGVTTAQALRAEGFEGRISLIGSEPHLPYDRPSLSKAVLDGSLERPPVLAEADWYGEANIDMLTGPQVTAINAETRTISLDDGTTLSADAIVIATGSRARTLALPGSQLGGVVTLRTYDDVQSLRDSWTPATRLLIAGGGLIGCEVATTARKLGLPVTILEAGDELLVRVLGRRIGAWLRGRLTELGVQVELGAGVAGFSGEGRLEQVLASDGRFFAADSALICIGAEPADQLARQAGLACDRGVIVDHCGATLAEGVFAVGDAASWPLRAGGRRSLETYMNAQRQAAAVAAAILGKAVSAPQLPVSWTEIAGHRMQMAGDIEGPGEFLLRGTLGSGAALLFRLQEGKLQAVVAVDAPRDFALATRLVEAHAAVEPARLADISNSMRDLVRAHSGDTA

SEQ ID NO: 10559 - protein, 377 aa, Buchnera sp.
MAKKDYYQILGIPKSAEEREIKKAYKKLAMKYHPDRNQGDKTAEGKFKEIKEAYEILINEEKRSAYDQYGHAAFENGQSNSTYSTFTNSADFSDIFGDVFGDIFGGNRTQRAKKGADLCYNMEITLEEAVKGIKKEIQIPTLQKCKTCYGSGTRTGTKPRSCSTCHGKGQIHIRKGFFTVQQSCSTCHGKGTIITDPCNLCHGQGRVETYKILSVKIPPGLDTNDRIRLNNEGEAGANGAQSGDLYVQITVKKHPIFEREGNNLYCEVPKNFTMAALGGEIEVPTLDGRVKLKIPYETQSGKLFRIRGRGVKSVQNRNQGDLLCRVVVETPVNLNEQQKNLLHELGNSFHGFRGEKNSPRSKRFFDGVKRFFDDLTR

SEQ ID NO: 10560 - protein, 405 aa, Unknown
  Vibrio sp. Ex25
MEDALAVILAGGMGSRLSPLTDDRTKPAVPFGGKYRIIDFTLTNCLHSGLRKILVLTQYKSHSLQKHLRDGWSIFNPELGEYITAVPPQMRKGGAWYEGTADAIYHNMWLLSRNDAKYVVVLSGDHIYRMDYAAMLEEHKEKGAKLTVACMDVPVEDASAFGVMGTAENGLVTSFIEKPECPPTLPGSKTRSLVSMGIYIFDMDVLKEALEDDSKLDSSSHDFGKDIIPKLIDTESVYAYQFCGSKGRVDKDCYWRDVGTIDSFYEANMDLLEPVPPMNLYQSNWAIRTYEPQFPPARTVSSATGNEGIFINSIIATGVINSGGSVQHSIISSNVRIQDSATVVDSIIFDDVEVGEGSQLVNCIVDKHVRIPPHTQIGINKLEDAKRFKISDKGIVVIPESYQFD

SEQ ID NO: 10561 - protein, 571 aa, Ostreococcus tauri
  misc_feature (427)..(433): Xaa can be any naturally occurring amino acid
MVRSGMRYGYRINGEGGWDTGQRFDATKVLMDPYAPLVEARRKVFGEWSKHKVSGDTNDPDMLSGYDFESAPFDWRGVESPQIDEKDMIVYEMTVRAFTADASSGLDADARGSYAGVAAKVEHLKSLGVNVVELLPVFEYDEMEFQRIPNPRDHMVNTWGYSTMSFFAPMTRFGKKGCSAREASREFKEMVRALHAAGIQVILDVVYNHTGEMNDELPNTCSMRGIDNKTYYMTDTNQYVQMLNFTGCGNTLNANNPYVSQFILDSLKHWVKEYHVDGFRFDLASALCRDEQGHPMNSPPLIRAIAKDPELAHVKLIAEPWDCGGLYQVGSFPNWDRWSEWNGAYRDVLRRFIKGDEGMKSDFARRISGSSDMYHHNNRKPYHSVNFITAHDGFTLRDLVSYNTKHNMANGEFNNDGANDNYSWNCXXXXXXXRLNNFQWNELDSQKEHYFRFASEMVKFRRLHPLLGRETFLTDADVTWHEDRWDDPQSKFLAFTLHDSAGYGCGDLYIAFNAHEFYVDAALPSPPNGKRWARIVDTNLPSPEDFIVKGKFGVESRYNVAPRGCVILMSK

SEQ ID NO: 10562 - protein, 165 aa, Lycium americanum
RGVDRVFVDHPMFLEKVWGKTASKIYGPKVGQDYADNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVTVS

SEQ ID NO: 10563 - protein, 398 aa, Aspergillus oryzae
MYTDKGANSDRMEFNTSKEVTVAPTFEDMHLKESLLRGIYAYGYESPSAVQSRAIVQICKGRDTIAQAQSGTGKTATFSISILQVIDTVVRESQALVLSPTRELATQIQSVIMALGDYMNVQCHACIGGTNIGEDIRKLDYGQHVVSGTPGRVADMIRRRHLRTRHIKMLVLDEADELLNRGFREQIYDVYRYLPPATQVVVVSATLPYDVLDMTTKFMTDPVRVLVKRDELTLEGIKQYFIAVEKEEWKFDTLCDLYDTLTITQAVIFCNTRRKVDWLTDKMREANFTVSSMHGEMPQKERDSIMQDFRQGNSRVLISTDVWARGIDVQQVSLVINYDLPTNRENYIHRIGRSGRFGRKGVAINFVTSDDVRILRDIELYYSTQIDEMPMNVADLLS

SEQ ID NO: 10564 - protein, 170 aa, Burkholderia pseudomallei
MKRAHAVSSGDPPGRSPMGLRDLFFDSTDSTDSRMTDVTDDAPSPPTAFELVGGEARVRELVDRFYDLMDLEPEFAGIRALHPPTLEGSRDKLFWFLCGWLGGPDHYIERFGHPRLRARHLPFPIASSERDQWLRCIAWAMQDVGLDEPLRERLMHSFHDTADWMRNRPG

SEQ ID NO: 10565 - protein, 462 aa, Oryza sativa
MNLCTEQPAVTRRQLLLLLLLLLLLLTSSPLCSRVSASAGARARSNGGGSSRRVVRHLPGFDGPLPFELETGYVEVDHIAGVRLFYYFIRSERRPAADDDPLLLWLTGGPGCSAFSGLVYEVGPLTFDLHHGRHGGLPRLLYKPESWTKRASVIFLDSPVGTGFSYAADADTDGAGFRTGDTIAVRHILVFLRKWLQEVHPVAKPGFGYRGCWPGDGYLLGNPVTDPNFDTPSKIPFTHGMGLISDELYECVKDIYQNHILEPYCTLASPHNPRIDKPFTSGGRQMLQLQEDQDLHLSEISSECRTARYTMSRIWANNDTVREALGIHQGTVPSWQRCNFDIPYTRDIKSSIRYHLDLTARGYRSLIYSGDHDMAIPFIGTQAWIKSLNFSVVDKWRPWFVDGQVGGYTRSYSNNLTFATVKGGGHTAPEYMPKQCLTMLASGFFSPRVAVETPARVCIASG

SEQ ID NO: 10566 - protein, 275 aa, Ostreococcus tauri
MRTLARPVVPIRTPVGRNVSRASSNRASNTTLKASSTNNDSELTAPKLTKRQLARWALTACTAPLWIDVGKDLGFFTGSDAEYPELIVPGAGEAVAEFAAGCFWSVEKTFRALPGVTSTQTGYIGGFVDRPRYFDVAGGRTGHVESVRVVYDKSNTSYEDLLRAYWRSVDATRDDGQFVDSGEQYRPVIWAMDAAQRDTAERSRDALMHANVYGKPIKVSITDASDKTFWPAEFYHQEYFISHKNKYDFYSSLSGRDEYIASVWGDERSAARRKI

SEQ ID NO: 10567 - protein, 554 aa, Colwellia psychrerythraea
MCSIFGILDIKTGADALRPTALECSRLLRHRGPDWSGIYHSDNAILVHERLSIVDTEHGAQPLYNGDKSNVLAVNGEIYNHKALASALNVDYEFQTASDCEVILPLYEEFGVEFVDKLQGMFAFIVYNEKDNSYLIARDHIGIIPLYTGYDSEGNFYVASEMKALMPICKTVEEFPPGHILDSRVGKLQQYYKRNWQEYAAIKDNTTSTTKIREALEESVKSHLMTDVPYGVLLSGGLDSSLISAITQKFAARRIEDNDLAEAWWPKVHSFACGLAGSPDLIAAQTVADSIGTIHHSVVFTEQEGIDALKEVIYHLETYDVTTIRASTPMYLMARKIKAMGIKMVLSGEGADEIFGGYLYFHKAPNAQEFHEELNRKLDRLHKFDCLRANKSMSAWGIEARVPFLDKNFMDVAMRINPEDKLCGNGKMEKAILRESFEGYLPKEILWRQKEQFSDGVGYSWIDGLKAHVESLVTEQQLENAHIRFPVNTPDNKEGYYYRTVFEDKYPLATAADCVIGGKSVACSTEEALAWDESFQNNADPSGRAVLSVHNESY

SEQ ID NO: 10568 - protein, 78 aa, Desulfotalea psychrophila
MAKEEAIEVEGTIIEPLPNAMFRVELDNGHKVLAHISGKMRMHFIKILPGDRVTVELSPYDLTRGRVTFRTKNTKKKK

SEQ ID NO: 10569 - protein, 216 aa, Brassica rapa
MNTFPASTEMVGSENESPVTTVAGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETIVEAIFTEENNDVFYMDEESMLEMPALLASMAEGMLLPPPSVHFGHNYDFDGDADVSLWSY

SEQ ID NO: 10570 - protein, 453 aa, Gibberella zeae
MADFKAYLDELEQDFVIDTAKLKHVTNHFVQELEKGLSIKGGSIPMNPTWVTNYPDGNEKGKSLVLDMGGTNLRVYSIQLTSEKGGFEVKQESHKLPEELKTATADELWDFIAGCLDSFLQSADFDLSTEIDLSFIFSFPTTQRTIDEGILQRWTKGFNISNTEGKDAAESLRQAIKKKNLPLKVRVVTNDTTATMMASAYLNSDTEIGCVFGTGCNGAYFEKVGAIPKLANDNLNGESFMAINCEWGAFDNEHAVLPLTSYDIAIDEDSPRKGQQAFEKMVAGLYLGELFRRIILEIHQRDPHTFLEGQSMERLNDTYCLDSSFLSAIEEDASDGLREAYETCVSSLGISPTLAELQFMKAVATLITTRAARLSATGVAAICQKRDLQQCHVGVEGSLFEKHPHFQLELSKAVGEILAPVAEPDTRKSNVEFMLSPGSGVGAAVIASTLKER

SEQ ID NO: 10571 - protein, 362 aa, Helianthus tuberosus
MESGGDGGGTSSCLMSFGDTNNNINNSSSNNNNSNNNIGSLCLPPNPPGAYNTTTNNNNLIFSDHHPSAMMLEDNNININDGVGLAFMNPSSSVKAKIMSHPHYPRLLSAYLNCQKIGAPPEVVERLEEACRASVVAAMSSRSGGAGTSDGSGGGMNMIIGQDPALDQFMEAYCEMLIKYEQELSKPFKEAMLFLSRMESQFKAITFSNSDSGCGEGGMDRNGSSEEELDVDMNNGMVDPQAEDRELKGQLLRKYSGYLGSLKQEFMKKRKKGKLPKEARQQLLDWWTRHYKWPYPSEAQKLALAESTGLDQKQINNWFINQRKRHWKPSEDMQFVVMDAAHPHYFIDNIFGNPYPMDVSLL

SEQ ID NO: 10572 - protein, 300 aa, Burkholderia pseudomallei
MAYKTIEDTIGNTPLVQLVRLPDDEIRARNNVILAKLEGNNPAGSVKDRPALSMIRKAEERGTIKPGDTLIEATSGNTGIALAMAAAIRGYKMVLIMPEDLSIERRQSMAAYGAEIVLTPVKGGMEFARDLADQMQREGKGVILDQFANPDNPLAHYEGTGPEIWRETEGRVTHFVSAMGTTGTIMGTSQYLKERNPTVEIVGAQPEEGSRIPGIRKWPEAYLPKIFDRSRIDRVENVSQAASEAMARKLAAVEGIFCGISSGGACEVALRVARQAENATIVFVVCDRGDRYLSTGVFPA

SEQ ID NO: 10573 - protein, 263 aa, Methanocaldococcus jannaschii
MNIKDIKLNADETKTTKAILKASFDMWLDIVEADVVIVGAGPSGLTCARYLAKEGFKVVVLERHLAFGGGTWGGGMGFPYIVVEEPADELLREVGIKLIDMGDGYYVADSVEVPAKLAVAAMDAGAKILTGIVVEDLILREDGVAGVVINSYAIERAGLHIDPLTIRSKVVVDATGHEASIVNILVKKNKLEADVPGEKSMWAEKGENALLRNTREVYPNLFVCGMAANASHGGYRMGAIFGGMYLSGKLCAELITEKLKNKE

SEQ ID NO: 10574 - protein, 417 aa, Salmonella typhimurium
MLKREMNIADYDAELWQAMEQEKVRQEEHIELIASENYTSPRVMQAQGSQLTNKYAEGYPGKRYYGGCEYVDVVEQLAIDRAKELFGADYANVQPHSGSQANFAVYTALLQPGDTVLGMNLAQGGHLTHGSPVNFSGKLYNIVPYGIDESGKIDYDEMAKSAKEHKPKMIIGGFSAYSGVVDWAKMREIADSIGAYLFVDMAHVAGLIAAGVYPNPVPHAHVVTTTTHKTLAGPRGGLILAKGGDEELYKKLNSAVFPSAQGGPLMHVIAGKAVGLKEAMEPEFKVYQQQVAKNAKAMVEVFLNRGYKVVSGGTENHLFLLDLVDKNLTGKEADAALGRANITVNKNSVPNDPKSPFVTSGIRIGSPAVTRRGFKEAEVKELAGWMCDVLDNINDEATIERVKAKVLDICARFPVYA

SEQ ID NO: 10575 - protein, 445 aa, Gibberella zeae
MSLTNASPEAVASAAKTASFTLATLPASERNNALEAIHAALTASKDDILAANAKDLELAKKAAAEGGLSQALVSRLDLGKKGKWEDMLKGILDVRDLNDPVGQIQMRTKLDDDLMMERVSCPIGVLLIIFEARPEVIANIASLAIKSGNAAILKGGKESTESFVAISKVISSALETTKVPNSAIQLVTTRDAIAELLAQDRYIDLVIPRGSNELVRYIKESTKIPVLGHADGLCHIYLTASADKEKAITAIVDSKTSYPAACNAVETLLVQESALNSVFPGVASALAAKGVSLRVDEASKAAITSLSLEGVQDATTQDYDTEHLSLTIGVKTVSSIDEAITHINTHGSHHTDAIMTSDSAEAERFMNEVDSAGVYWNAATRLADGMRYGFGTEVGISTNKIHSRGPVGLDGLTIYKYKIRGDYQATADYGDGEGKKPWKHEKLSL

SEQ ID NO: 10576 - protein, 340 aa, Fulvimarina pelagi
MSDNPYANSSTGSYASGSASGPSAAAEPKPTLQGFGDMAGAGARPAGDLIKDTTTQAFPNDVIKESRNQPVIVDFWAPWCGPCKQLTPLLERAVKAANGKVKLVKMNIDEHPSIAGQLGVQSIPAVFAFLDGQPVDGFMGALPESELKKFIDRIVQQAGPTKGGGDPIADAMAQADELLKAGDAGNAAQIYGAVLQHEEGHVGATGGLAECYMKTGDSERASQLVESLPPEADNDPRVAAVKAKLKLDKEIAGLGDPAELQARLDRDPDDHQARFDLALIAQARNDRPKAADLLLEIMRRDREFADDGARKKLLELFEAWGPTDPATKDARRKLSSLLFR

SEQ ID NO: 10577 - protein, 538 aa, Caragana korshinskii
MAFEIVSKLQNLSTSDHASVVSMNLFVALLCACIVVGHLLEENRWMNESITALLIGLCTGIIILLFSGGKSSHILVFSEDLFFIYLLPPIIFNAGFQVKKKQFFVNFITIVSFGAIGTLVSCVIITLGVMYAFKRMDIGPLELGDYLAIGAIFAATDSVCTLQVLNQDETPLLYSLVFGEGVVNDATSVVLFNAIQSFDLNRLNSLIALHFLGNFLYLFIASTLLGVLTGLFSAYVIKKLYIGRHSTDREVALMMLMAYLSYMLAELSYLSGILTVFFCGIVMSHYTWHNVTESSRITTKHAFATLSFVAEIFIFLYVGMDALDIEKWKFVSDSPGTSVAASSVLLGLVLLGRAAFVFPLSFLSNLTKKSPYEKISFRQQVIIWWAGLMRGAVSMALAYNQFTMSGHTQLRCNAIMITSTITVVLFSTVVFGLMTKPLIRLLLPHPKATNSMTTTESSTPKSAIVPLLGSAQDSEADLDGHEIHRPSSIRALLSTPTHTVHRLWRRFDDSFMRPVFGGRGFVPVEPGSPSERNGHQWR

SEQ ID NO: 10578 - protein, 145 aa, Vigna unguiculata
MVAFSDKQEALVNGAYEAFKANIPKYSVVFYTTILEKAPAAKNLFSFLANGVDATNPKLTGHAEKLFGLVRDSAAQLRASGGVVADAALGAVHSQKAVNDAQFVVVKEALVKTLKEAVGDKWSDELGTAVELAYDELAAAIKKAY

SEQ ID NO: 10579 - protein, 130 aa, Brassica napus
METQKKTREHSLHHIVDDIGAAFGMGAIGGSVVHFIKGTQNSPKGRRFVGGAQAVSMNAPRIGGSFAVFGGLFSAFDYTMVYIRKKEDPWNSIVAGAATGGFLSMRQGLAAASRSALMGGLLLALIKGVH

SEQ ID NO: 10580 - protein, 417 aa, Symbiobacterium thermophilum
MTGQEFFRDTQETIRAAVAKLGHSEGVYKILRNPRRTLEVHIAVTMPDGSVETFLGYRSQHAAVFGPYKGGVRFHPNVTKEEVEALAMLMTLKNAVLGLPYGGAKGGVICDPNALPPTAVEQIARGYVRGLRDMIGPDTDIPAPDVNTNSRVMGWMLDEYLKCTNAIDFSVFTGKSLNLGGIEGRTGATGLGIAYVTREACKVRGVDLKGARVAVQGFGNVGRGAAQALTALGARIVGVTDITGGVYKEDGLDVAALTEYARDRGGVAGFPGAEPLTNEQLFALPVDVLIPAALEGQITGKVAETIQAPIVVEGANGPTTPEGAQVLADRGIMQVPDILANGGGVTVSYFEWVQGQQGGLRWSERTVHRRLDRYMTSAFAAVLAYSERYNVSMREAAYLFAVDRLATGMIERGWVPR

SEQ ID NO: 10581 - protein, 145 aa, Vigna unguiculata
MVAFSDKQEGLVNGAYEAFKADIPKYSVVFYTTILEKAPAAKNLFSFLANGVDATNPKLTGHAEKLFGLVRDSAAQLRASGGVVADAALGAVHSQKAVNDAQFVVVKEALVKTLKEAVGDKWSDELGTAVELAYDELAAAIKKAY

SEQ ID NO: 10582 - protein, 810 aa, Deinococcus radiodurans
MPQLKGRAGAGASAFRWMFLSPEQPQARLPPMIGKTFTTMLGGRELSIETGKLAKLVSGSVTVRYGDTLLLVTAQASDTQSKLDFLPLTVEFEERHYAVGKIPGSFQRREGRPGEKAILSARITDRQIRPLFPKGYRHETQVIITVLSADGQNAPDVLGPIGAAAALSISDIPWAGPTACVRVGQIDGQYVVNPTTEQLTRSRMDLVVAGTREAVMMVECGAQTVSEDDLVGAIEFAHAEMQGVIALIEQMRAEVGHEKFNFLAEEGPANDYVPELTEKAKAAGLRDALLTHGKKDRSARLKALRNGLIEGYVPDPTAEGSAELTQALKDAFGKVEKRELRRLILEENLRADGRDSKTVRPIWIEARPLPTAHGSAVFTRGETQVLGVTTLGTERDEILIDDLTAESGDKFLLHYNFPPYSTGEVKRMGGQSRREIGHGNLAKRAIRAVLPSFEEFPYVIRVVGDVLESNGSSSMGTVCAGTLSLMDAGVPLKAPVAGVAMGLVMEGDNYRVLTDILGLEDALGDMDFKVCGTAEGVTALQMDIKVGGITPQIMREALAQAKEGRLHILGKMAEVLAAPRAELSPTAPHILSLKINPELIGKVIGPGGKQVRELEAMGAQVTIEEDGTVRIFSASGESAEAVKARIEAVTKEAKVGEEFEGTVVKIAPFGAFVNLFPGQDGMLHISQLSEQRVENVEDVLTVGDKLKVKIANIDDRGKIDLIRPELEGKVPLREPRAPRGGDRGPRRDSDRGGDRGPRREFSDRGPRPEGARSERPEGQRTERPATAPATQESSQSSDAPAAPVFPRRED

SEQ ID NO: 10583 - protein, 414 aa, Synechococcus elongatus
MAAPARAFVYQAYQAANQLARTKPLVRSQALQAIAQAIDSARDDILEANTLDLEACQDSEMPDLLRRWLKLTPERLDRTVEILERLSVRSDPIQQVMRASFQHEHSQAYSQLMPLGVIAFVYEALPELAAIATGLCLRVGNSILLKGGTEAVHTNQAIVSVMQEALESTELPTTSLILLPEDDPATSLAALVTQDQWIDLVIPYGRPELVQQVARLATSPVLRTSMGNCYLYWASGGELETVRWMILDSHASEPDAVNAIEKVLIDRDCNLSKLTVLMDSLRSKGFRLKGDEELVQEMPELELARHEDWSRPYLSRTVAFKLVPGIEAATDWINTHSSGHADSIVTDSYEDSRAFSRELNSAMVHVNASPRFSRSPRHSNEIALGMSNQKGYRRGRITLETLTTIKQVVLGLGQ

SEQ ID NO: 10584 - protein, 328 aa, Prochlorococcus marinus
MARIYEDNSFAIGNTPLVKLKSVTKNAKATVLAKIEGRNPAYSVKCRIGANMIWDAEKSGKLTKDKTIVEPTSGNTGIALAFTASARGYKLILTMPESMSIERRRVMAVLGAEIVLTEASKGMPGAIAKAKEIAESNPSQYFMPGQFDNPANPEIHFKTTGPEIWDDCDGEIDVLVAGVGTGGTITGVSRYIKQEKGKNITSVAVEPSHSPVITQTMNGEEVKSGPHKIQGIGAGFIPKNLDLSIVDKVEQVTNDESIEMALRLAKEEGLLVGISCGAAAAAAVRLAEQDKYAGKIIVVVLPDLAERYLSSIMFNEVPSGIIQEPVKA

SEQ ID NO: 10585 - protein, 977 aa, Oryza sativa
MAVGEECAAAVASQVRHRWLAAAFFSSVDVAIVAGLPRVPTNYRDAPTCGMWGPHVSRCFIATFFNKPLGVLLGFVTDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMFTVMSICTISTIIKIKDVFADTLIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 10586 - protein, 349 aa, Lycium andersonii
ISPRYDQYKDAWDTSVAVEIKVGDSIETVRFFHCYKRGVDRVFVDHPMFLEKVWGKTASKIYGPKVGQDYADNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHT

SEQ ID NO: 10587 - protein, 320 aa, Myxococcus xanthus
MAEEKINKVTIIGSGPAGYTAAIYAARANLQPVVFAGGPTLEHPQRVPGGQLMVTTDVENYPGFPEAITGPELMDRFQKQAERFGTTIHMENVVKVDFSQRPFLIQGESVSCRSETVIISTGATAKWLGVKGEDTYKNRGVSACATCDGAFFKKQDVLVVGGGDTAMEEATYLAKIVNHVTLIHRRDTLRASKVMQERARQNPKISFMWDSAVEEVLGDAKGMNGAVVRNLKTGDSQQVKATGLFVAIGHTPNTELFQGVLETHQGGYLKTVPGSTRTNIEGVFACGDVQDHYYRQAITAAGTGCMAAIDAERWLIEHGE

SEQ ID NO: 10588 - protein, 625 aa, Persea americana
MSMATPTTTCGAGDLLQNPKLLPISKNLSRPKNFIMLKHNTPLIQCCSHSPSSSSAAVLHLPPKQPTKSKPSIKKGEKSSTLTPSIEKNPGSHQVKTDQSGPNRVGPNWNIFQRTAAFALDAIEEKLIARVLERRHPLPKTADPEVQIAGNFAPVAEHPVQHGIPVAGRIPRCLDGVYVRNGANPLFEPIAGHHFFDGDGMIHAVRFRNGSASYSCRYTETRRLVQERQLSRPIFPKAIGELHGHSGIARLLLFYTRGLFGLVNADEGMGVANAGLVYFNRRLLAMSEDDLPYHVRITPSGDLKTVGRHDFDNQLRSSMIAHPKLDPESGELFSLSYDVARKPYLKYFHFAPDGWKSPDVEIPLDRPTMIHDFAITENFVVIPDQQVVFKLEEMIRGGSPVVYDKNKTSRFGILPKYAPDASEMIWVDAPDCFCFHLWNAWEEPESGEVVVVGSCMTPPDSIFNENEESLKSILTEIRLNTRTGESTRRTIIDPQKPLNLEAGMVNRNRLGRKTRFAYLAIAEPWPKVSGIAKVDLGTGEVNRFVYGERQFGGEPYFIPREPSTSGREDDGYVVSFMHDEKTSRSELLILNAMNMRLEASVMLPSRVPYGFHGTFISSRDLAKQA

SEQ ID NO: 10589 - protein, 244 aa, Solanum lycopersicum
MGSPQETCTSLDLIRQHLFDESLDQTCFSFETTQTSNLDDIASFFNATSKTEYDGFFEFEAKRHVIHSNSPKQSNLRERKPSLNVAIPAKPVVVVENVEIEKKHYRGVRQRPWGKFAAEIRDPNRKGTRVWLGTFDTAVDAAKAYDRAAFKLRGSKAILNFPLEVANFKQQNDETKTETKSSGSKRVRGETEELVIKKERKIEEERVLPTAAAPLTPSSWSTIWDEKGIFEVPPLSPLSQLVMI

SEQ ID NO: 10590 - protein, 250 aa, Pisum sativum
MGKSYPTVSPDYQKAIEKAKRKLRGFIAEKKCAPLILRLAWHSAGTFDSKTKTGGPFGTIKHQAELAHGANNGLDIAVRLLEPIKEQFPIVSYADFYQLAGVVAVEITGGPEVPFHPGREDKPEPPPEGRLPDATKGSDHLRDVFGKAMGLSDQDIVALSGGHTIGAAHKERSGFEGPWTSNPLIFDNSYFTELLTGEKDGLLQLPSDKALLTDSVFRPLVEKYAADEDVFFADYAEAHLKLSELGFAEA

SEQ ID NO: 10591 - protein, 730 aa, Clostridium thermocellum
MKKFLSLILVVSFLIMLLTPSTKISAATTFNYGEALQKAIMFYEFQRSGKLPSTIRNNWRADSCLDDGKDVGLDLTGGWFDAGDHVKFNLPMAYTAAMLAWAVYEEKDAFVKSGQLKYILDEIKWATDYFIKCHPEPDVYYYQVGDGDIDHMWWGPAEVVHLRTKRPSYKVDITSPGSTVSAETAAALAAASIVFKDTDPQYSNLCLKHAKELFNFADKTRSDAGYTAATNFYTSHSGFYDELTWAATWIYLATGDTSYLDKAESYVEFWSTEPQTDIMSYKWGHCWDDVRYGAQLLLARITNKPIYKESMERHLDYWTVGVDNSRIKYTPKGLAWLNNWGSLRYATTTAFLAAVYADWEGCSPQKAKIYNDFAKAQVDYALGSTGRSFVVGFGENWPQHPHHRTAHGSWYDSMNVPDYHRHVLYGALVGGPGESDNYRDDISDYQCNEVACDYNAGFVGALAKMYNRYDGRPVPEFKAIEVPEDEFMVEAYVSSSDKNYVEIKTRLNNRTAWPARVSEGLSFRYFIDLTEVIEAGYGPNDLIISGGQGSSGKVSGPHLWNKEKNIYYIEVDYTGDRLFPGGQDHYRRDSSLRIAVPGNSGCWNSENDPSFKGLSKTSEFKKAEYIPVYEYGVKVAGIEPEGTVVQPSPSPTPTPTPPHSDDVLYGDINNDKTVNSTDVTYLKRFLLKQINSLPNQKAADVNLDGNINSTDLVILKRYVLRGISKLPYAP

SEQ ID NO: 10592 - protein, 371 aa, Lycium berlandieri
PRYDQYKDAWDTSVAVEIKVGDSIETVRFFHCYKRGVDRVFVDHPMFLEKVWGKTASKIYGPKVGQDYADNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGAAKFNVPLAHTITAGADFMLVPSRFEPCGLIQLHA

SEQ ID NO: 10593 - protein, 54 aa, Psychrobacter arcticus
MKRYECIVCGWIYDEALGCPEEGIAPGTKWDDIPDDWTCPECGVGKLDFEMLEL

SEQ ID NO: 10594 - protein, 345 aa, Pyrococcus abyssi
MLLNIHQESYVEVVKMFSLGGLGKSRVDESKVWDVIIIGAGPAGYTAAIYAARFGLDTIIITKDLGGNMAITDLIENYPGFPEGISGSELAKRMYEHVKKYGVDVIFDEVVRIDPAECAYYEGPCQFEVKTANGKEYKGKTIIIAVGAEPRKLHVPGEKEFTGRGVSYCATCDGPLFVGKEVIVVGGGNTALQEALYLHSIGVKVTLVHRRDKFRADKILQDRLKQAGIPTILNTVVTEIRGTNKVESVVLKNVKTGETFEKKVDGVFIFIGYEPKTDFVKHLGITDEYGYIKVDMYMRTKVPGIFAAGDITNVFKQIAVAVGQGAIAANSAKEFIESWNGKSIE

SEQ ID NO: 10595 - protein, 479 aa, Unknown
  Acinetobacter sp. ADP1
MAAPKNVSESGHSEGLKSGLQSRHLTMISIAGVIGGALFVGSGSVIYSAGPAAILAYTLGGLLVLLIMRMLGEMAVMNPDSGSFSTYADRAIGRWAGFSIGWLYWCFWTLLMGWEAYVAGKILNSWFPFIPIWGYMLLVIVGLVWVNLQDVKNYGEFEFWFALIKVVAIVMFLVVGSLAIMHLWPWGDPSAAGFTNLTAQGFMPGGFSSVITALLGVMFAYMGAEIVTVAAAESKDPAKEIRKASNSIVWRIILFYVGSMFITVCLIPHNNPLLKDPTWGTYSVTLSTLGIPEARHIVNFVVLTSVCSCFNSALYTCSRMMFSLSKRGDAPKIFAKTNRNSSPWAGVIFSSIFSIVAVYLTATESMNVYDVLMLATGTVALYVYLAVAFSQLRMRKKIEAEGKAVDFKMWLFPWLTYAVIITIIGAIITMLIEGTYFKEVTYTTGLALVIVILGILTHKFNWGKDAREKMLEQSKKSMT

SEQ ID NO: 10596 - protein, 262 aa, Pyrococcus abyssi
MVKVAYVQMNPQILEPDKNYSKAEKLIKEASKQGAQLVVLPELFDTGYNFETREEVFEIAQKIPEGETTTFLMDVARDTGVYIVAGTAEKDGDVLYNSAVVVGPRGFIGKYRKIHLFYREKFFFEPGDLGFRVFDLGFMKVGVMICFDWFFPESARTLALKGADVIAHPANLVMPYAPRAMPIRALENKVYTVTADRVGEERGLKFIGKSLIASPKAEVLSMASETEEEVGVAEIDLYLVRNKRINDLNDIFKDRREEYYFR

SEQ ID NO: 10597 - protein, 311 aa, Staphylococcus aureus
MTEIDFDIAIIGAGPAGMTAAVYASRANLKTVMIERGIPGGQMANTEEVENFPGFEMITGPDLSTKMFEHAKKFGAVYQYGDIKSVEDKGEYKVINFGNKELTAKAVIIATGAEYKKIGVPGEQELGGRGVSYCAVCDGAFFKNKRLFVIGGGDSAVEEGTFLTKFADKVTIVHRRDELRAQRILQDRAFKNDKIDFIWSHTLKSINEKDGKVGSVTLTSTKDGSEETHEADGVFIYIGMKPLTAPFKDLGITNDVGYIVTKDDMTTSVPGIFAAGDVRDKGLRQIVTATGDGSIAAQSAAEYIEHLNDQA

SEQ ID NO: 10598 - protein, 599 aa, Bradyrhizobium japonicum
MMLDTTLNARIQAFLDKFEAALVAGDLDAAVAMFAPECYWRDLVAFTWNIKTMEGRDQIREMLNSCLAQAKPRNWKIADAESATEADGVIECWITFETEVARGYGLVRLQNGQIWTLLTTMVELKGHEEKAGFTRPLGARHGVNPGAKTWKELRDEETEQLGLKTQPYVLIIGGGQGGIALGARLRQLGVPTIIVEKNARPGDSWRNRYKSLCLHDPVWYDHLPYIDFPKNWPVFSPKDKIGDWLEMYTKVMELNYWTGTTAKHADWDDAKKEWTVVVERDGKEITLKPKQLVFATGMSAKPNMPQFKGMDTFKGEQHHSSRHPGPDRYKGKKVVVIGSNNSAHDICAALYEAGVDVTMVQRSTTHIVRSDSLMASIADLYSERAVRGGMTTAKADLIFASLPYKILHQLQKPVYDKIRQDDADFYAGLTRAGFRLDFGDDDSGLFMKYLRRGSGYYIDVGASQLIIDGKVKLVAGQVEEITPNGVRLYDGKELPADVIVYATGYSSMNGFVADLISRDMADKVGKVWGLGSNTTKDPGPWEGEQRNMWKPTQQEGLWFHGGNLHQSRHYSQFLSLQLKARYEGVPTPVYGLQPVHHKA

SEQ ID NO: 10599 - protein, 334 aa, Colwellia psychrerythraea
MSLAAKITVLGAGSYGTALAICLARNGHKTLLWGRDDNHVAAMEQDRENNKYLADCPFPENLALEADLEKAVQASDNLLVVVPSHAFADMLKQIKPMLTENAKIAWATKGLDPQTGDLLQNVARTVLGDRVSLAVLSGPTFAKEMASGLPTAISLSSEDDEFVAELSDLLHCEKRFRVYSNKDFIGVQLGGAVKNVIAIAAGIADGIGFGANARTALITRGLAEMTRLGLALNAEPATFMGMAGLGDLVLTCTDNQSRNRRFGLALGQGKEVEQAITDIGQVVEGYRNTKEVYMLAQRHDVEMPIVEQVYQVLYRGKDAKLAAADLLSRDKKFE

SEQ ID NO: 10600 - protein, 1165 aa, Gibberella zeae
MDLRNILDATDFYSNFTAALSTFSLDHLDSPTLNLQIIIQEGNSADGDRSGSLETNEEPILQSGHLLLSHKIPLRIGNGSCSIEPASPSLVSREPSPELRIPTNQRQVEIQRRTQSHKSHKRQGGLRLAAVNGDVPVEGDVDNANPRQMQVGQENFPKRVKVKHDGVFHPKESSLGKFVAGVWEQIHSGVILEPHVLTEQVQLTSRSSGNSPSGDLVSTAPSIRPDQTWESFNRSNIFCQRVTQASRTCRSIEVIVQARWVELFDSYVEYLASTNPNLSMTKCRMRAIAEACTDFGWTEKELRNKMGIWRGYKEIKDVLGWVALVFSGMGLYRLCKYRVDFDKDKFSRARTLGKRMEVAADTLHTNWRQLLAIVGESTEPRFAGHPHDWVVQQDGSDPVPLRSTYLAYDSNFTFEHLEESIIDTALWGADDPRWTPPSSAICLSGINVCDLCSEVQSNESAVNACKCFPNLFGVPRLPIAVQVFCTSNGRNNGLQALVAFERGTAIGEFVGLITKDIEEQDVMDSQAGGTRYQIWQGKQGNFTRFANHSCKPNAQFEKFVWLGTQHIVMNNTADIPLLFRFNMINRKIPLASYLFTRLKQAGTRRIYGVPGDFTLRALDHVPRSGIQFVGCCNELNAGYAADGYARAQRHRLQSGLGALITTYGVGELSAANAVAGSYAEHLPVVHIVGTPSQKARQVSTTSVGGRSPHLHIHHTLADSRIGVFREIAEKFTVAQLDLSGVDAEDVPTKVDEVLAKALYHSRPVYVELPSDAVETVVSSTLLERPIEERHTINDESSHLETREMADSLLQRLYAAKRPLILVDRGDGIETIRPDINEFVQKSGIPTLSLPSGASMVNNSLPNYFGVYSGSIGIVDLTSAVKSADLVLAFGCQFSDTQTLGWGVVPERNSMIMIGRNNIEDHQTGTGEILRMVTANLDKRSLAEQDTSSWGNFRHLPSQTVEPASPINQDEFYIHLNKYLKDDDNILLGNATPIIGGRDFVLPPSSQLIASGMWFSIGHMLPAAMGVSQAKADQGSSGRTILLDGDGSFQMTAQELSTIIHKRVNMVVFIINNSGYTYERYIHGMDEEYNDVAPWNYSLGPNLFGQAPDGYPIQSCRVHTWKELDSVLNSEGFSTGKGLTLVDIVIDKYDISERAKALFELVNKQL

SEQ ID NO: 10601 - protein, 570 aa, Burkholderia pseudomallei
MSDLQTSNPNTESFAALFEESLTRQDMRAGEVISAEVVRVDHNFVVVNAGLKSEAYIPIEEFLNDQGEVEVQAGDFVSVAIDALENGYGDTILSRDKAKRLASWLSLEKALDNNELVTGTITGKVKGGMTVMVNGIRAFLPGSLVDTRPVKDTTPYEGKTLEFRVIKLDRKRNNVVLSRRAVIEATQGEERAKLLETLKEGAIVNGVVKNITDYGAFVDLGGIDGLLHITDIAWRRVRHPSEVLSVGQEVTAKILKFDQEKNRVSLGIKQLGDDPWEGISRRYPSGTRLFGKVTNITDYGAFVEVESGIEGLVHVSEMDWTNKNVAPSKVVQLGDEVEVMVLEIDEDRRRISLGMKQCKPNPWDDFSRNFKKGDKITGAIKSITDFGVFIGLPGGIDGLVHLSDLSWSEAGEEAVRKYKKGDEVEAIVLGIDVEKERISLGIKQLEGDPFSNYVAMNDKGSIVDGVVKSVDAKGAVITLTPDVEGYLRASEISQDRVEDARNVLKEGEKVNAMVINIDRKSRGINLSIKAKDSAEQQEAMRGLQADSSAAATGTTNLGALLKAKLDGQNQ

SEQ ID NO: 10602 - protein, 99 aa, Unknown
  Synechococcus sp. WH 8102
MASYKVTLVSESEGLNKTIEVPDDQYILDAAEEQGIDLPYSCRAGACSTCAGKITAGTVDQSDQSFLDDDQIEAGFVLTCVAYPTSDCTIKTHAEEELY

SEQ ID NO: 10603 - protein, 419 aa, Nicotiana tabacum
MEVISTNTNGSTIFKNGAIPMNGHQSGTSKHLNGYQNGTSKHQNGHHNGTSEHRNGHQNGISEHQNGHQNGTSEHRNGHQNGISEHQNGHQNGTSEHQNGHQNGTSEQQNGTISHDNGNELLGNSNSIKLGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKSFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNSDIHKAAFILPSFARSMIES

SEQ ID NO: 10604 - protein, 328 aa, Unknown
  Synechocystis sp. PCC 6803
MVSQTSTATIGFTLEDFAALLDKYDYHFSPGDIVAGTVFSMESRGALIDIGAKTAAYIPIQEMSINRVDDPEEVLQPNETREFFILTDENEDGQLTLSIRRIEYMRAWERVRQLQAEDATVRSNVFATNRGGALVRIEGLRGFIPGSHISAREAKEDLVGEDLPLKFLEVDEERNRLVLSHRRALVERKMNGLEVAQVVVGSVRGIKPYGAFIDIGGVSGLLHISEISHDHIDTPHSVFNVNDEIKVMIIDLDAERGRISLSTKQLEPEPGAMLKDRDLVNEMADEMAEIFRQKRLAEAQGIPYEPPTSVDDTDDEEDESLAVSAVDE

SEQ ID NO: 10605 - protein, 561 aa, Neisseria meningitidis
MSMENFAQLLEESFTLQEMNPGEVITAEVVAIDQNFVTVNAGLKSESLIDVAEFKNAQGEIEVKVGDFVTVTIESVENGFGETKLSREKAKRAADWIALEEAMENGNILSGIINGKVKGGLTVMISSIRAFLPGSLVDVRPVKDTSHFEGKEIEFKVIKLDKKRNNVVVSRRAVLEATLGEERKALLENLQEGSVIKGIVKNITDYGAFVDLGGIDGLLHITDLAWRRVKHPSEVLEVGQEVEAKVLKFDQEKQRVSLGMKQLGEDPWSGLTRRYPQDTRLFGKVSNLTDYGAFVEIEQGIEGLVHVSEMDWTNKNVHPSKVVQLGDEVEVMILEIDEGRRRISLGMKQCQANPWEEFAANHNKGDKISGAVKSITDFGVFVGLPGGIDGLVHLSDLSWTESGEEAVRKYKKGEEVEAVVLAIDVEKERISLGIKQLEGDPFGNFISVNDKGSLVKGSVKSVDAKGAVIALSDEVEGYLPASEFAADRVEDLTTKLKEGDEVEAVIVTVDRKNRSIKLSVKAKDAKESREALNSVNAAANANAGTTSLGDLLKAKLSGEQE

SEQ ID NO: 10606 - protein, 401 aa, Arthrospira platensis
MYSPTGTGVAMRTGAAGRIFVFEVEGMRQGQNTDNFNYPIRRSGTVYLTVPYERMNQEMRRLSKMGAKIVNIYPAGETPPVRTQAAPENGQQSQSSGTQTPTMTQAKAKTDIPVNIYKPKNPYIGKCLSNEELVREGGTGTVRHLIFDISGGDLRYLEGQSIGIIPPGTDNNGKPHKLRLYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLAWLFFGIPYSPNILYQQELEELQQQFPENFRLTLAISREQQNPEGGKMYIQDRIKENADQLWELIQKPNTHTYICGLKGMEGGIDEGMSAAAGKFDVDWSDYQKQLKKKHRWHVETY

SEQ ID NO: 10607 - protein, 187 aa, Boschniakia rossica
FGHGTRKWNPKMAPYISAKRKGIHITNLTITARFLIEACNLVFDAASRGKKFLFVGTKNKAADSVAWAAIRARCHCVNKKWLGGMLTNWSITEMRLHKLRDLIIEKNMGRLSHFKKRDAALVKRQLSHLQTYLGGIKYMTELPNIVIIIDQQEEFLALQECITLGIPTICLIDTNGDPDLADIFVPV

SEQ ID NO: 10608 - protein, 433 aa, Neisseria meningitidis
MPSETARPLYADTCAAHTLVWFRQNLRIRDNAALCAAVAEGLPVIGIWIDDAETDNPRRAAFYRQSAAELAQGLAGRGIPLYTAASPAELVRLAVRLNIRAVIADESHTFADKLADNALWHELNKHGIALTFVNDRAVFGKTDLIPDGGTAHTDFDRYREVWLDRFSKQPPAGPDLFAAYRQPFPENLSAPPPAALSDGIFLPQNSGETAAWRQWRRFLEQADSYSVLKDFPSRKHTSLMGAYLSAGCISPRLLARESLERRLNAWADNIIRRDFFLQLALQHTDDDPSDGNPEHTLRLTLWQQGRTGIPIIDAAMRCLHKTGSLHPALRRLSADFFCHVLNLPRREGEIWFARQLTDFDAAINQGNWRLAASRHTCPDIAAAAHKTDPDGTFVRRHIPELAHLSADTVHTPWRFACSVDTHGYPAHPVAGIP

SEQ ID NO: 10609 - protein, 271 aa, Thermobifida fusca
MTPHDTRPDTAAPPTSAAAGTSVDVDLTGRTALVTGAASGIGRACATRLAAAGATVRLVDLNREALDELAQRGIGEPHHVDLTDLDAVDTVARGVDIVVNNAGVQTVCPVHEFPPERFSMMVKLMLEAPFRIVRAALPHMYARNWGRIINISSVHGLRASAYKSAYVAAKHGLEGFSKVVALEGAPHGVTSNCINPGYVRTPLVEQQIADQARAHGIPASDVVETVLLARSPIKRLIEPAEVAEMVAYLCCPEASFINGASLTIDGAWSAS

SEQ ID NO: 10610 - protein, 187 aa, Orobanche elatior
FGHDIRKWNPKMAPYISANRKGIHIINLIKTARFLSEACNLVFDAASMGKQFLIVGTKKQTANSVACAAIKARCHCVNKKWLGGTLTNWSTTERRLHQFRDLRIEQKMGRFKRLPKRDAAVSKRQLSRLQTYMGGIKYMTGLPDIVIIVDQHEEYTALRECITLGIPTICLIDTNCDPDLADLSIPA

SEQ ID NO: 10611 - protein, 542 aa, Medicago sativa
MGCLLSKDKDSEQEHNNGGYRYAESSGMHNHRNNHEQVNTSRTAPTSSYQPQIPTKPSSISAPSPKPLIKQDTNTILGKGLEDVKQFYTLGKELGRGQFGVTFLCTENSTGLLYACKSISKRKLVSKSDREDIKREIQIMQHLSGQPNIVEFKGAYEDRNSVHVVMELCAGGELFDRIIAKGHYSEKAAASICRQIVNVVNICHFMGVMHRDLKPENFLLASKDENALLKATDFGLSVFIEEGRVYRDIVGSAYYVAPEVLRPRCGKEIDIWSAGVILYILLSGVPPFWAETEKGIFDAILEGHIDFESEPWPKISDSAKDLVRKMLIQEPKKRITAAQVLEHPWIKGGNASDKPIDSAVLSRMKQFRAMNKLKKLALKVIAENMSEEEIRGLKAMFTNMDTDNSGTITYEELKAGLQRLGSKLSEAEVKQLMEAADVDGNGTIDCIEFITATMHRHKLERDDHLYKAFQYFDKDSSGFITRDELETAMKEYGMGDDATIKEIISEVDTIISEVDTDHDGRINYEEFCAMMRSGNQQQVKLF

SEQ ID NO: 10612 - protein, 513 aa, Zea mays
MARYFRSSNLASRIFDRQLISPLPGATHLQVNTIRQFYENLVPSYTIYDIDCPDYSFRKFTDDGKYFVAFSRNHQDLIVYRPIWLTYSCNEECDPHELPPKAKKFDSFFKQLYSIPLASGNEYICKDFFLYMECHRFGLFATSTAQSNESTATEGAIHGVPLIEKITFHLVRLEDGVILDEKAFCNDFINLAHSIGAYMYEDLLCIVSLRYQTIHILQIRDSGNLVEVRNIGAFCREDDELFLHSHIQTGYGGSFLPGIKQRLLSYIFCKTWNEVPDQTLRVQHLKKKFYFHFQDYVDLIIWKVQFLDRHHLFVKFGSVDGGVSRSTDQNLAFFAVYNMETTDIVSLHQNSSEDIYALFEQFYDHFHANPQASSHGKFISSHSNDIHALDQLRVIKNKASSSSQFVKKMMTSLPYTCQSQSPSPYFDLSLFRYDEKLISAIDRHRHCTEHPIKFMSVRQNVVKFKIKPGSDSGASDSRAKRISSFLFHPFFPLALSIQQTYMQPTVVNIHFRR

SEQ ID NO: 10613 - protein, 418 aa, Streptococcus pneumoniae
MIFDKDDFKAYDADLWNAIAKEEERQQNNIELIASENVVSKAVMAAQGSILTNKYAEGYPGRRYYGGTDVVDVVETLAIERAKEIFGAKFANVQPHSGSQANCAAYMSLIEPGDTVMGMDLASGGHLTHGAPVSFSGQTYNFVSYSVDPKTELLDFDAILKQAQEVKPKLIVAGASAYSQIIDFSKFREIADAVGAKLMVDMAHIAGLVAAGLHPSPVPYAHITTTTTHKTLRGPRGGLILTNDEELAKKINSAIFPGIQGGPLEHVVAAKAVSFKEVLDPAFKEYAANVIKNSKAMADVFLQDPDFRIISGGTENHLFLVDVTKVVENGKVAQNLLDEVNITLNKNSIPYESLSPFKTSGIRIGAAAITARGFGEEESRKVAELIIKTLKNSENEAVLEEVRSAVKELTDAFPLYED

SEQ ID NO: 10614 - protein, 363 aa, Ralstonia solanacearum
MTPQFHPLRVAEVRGETADTISLRFDVPDDLREAYRFTQGQFLTLRVPAGAAGQGELRRSYSICCAVQDYDAHGELRVAVKRVDAGVFSNHLHDRIRVGQTLDVLPPDGRFYVPLAAESARHYVAFAAGSGITPVLSLIKTTLAAEPHSRFTLVYGNRTVDSIIFAEALEDLKDRYLDRFALYHVLSRQPQEIALFNGRLDGDKARAFLDTLIPPDDIDAAFICGPSTMIDAVEAALLARGVPRERVHAERFGVPVGDASARPRKPAAVAGDVALTVVLDGKSHHVPMAGDGKVLDSALAAGLDLPYACKGGVCCTCRAKVLEGRVEMEKNFTLEDWEIRQGFVLTCQARPLTQRVVVSYDER

SEQ ID NO: 10615 - protein, 187 aa, Orobanche nowackiana
FGHHSKKWNPKMSPYISAERRHRHIINLTKTARFLYEACYLVFNAASKGKQFLIVGTKEITADLVEEAAITARCHFVNKKWTGGLLTNWPITEARLKKFKDLIIEQKAGRLDCLPKKDAAVVKRQLSRFQKSLGGIKSMNGLPDIVIILDQNEEYKALQECITLKIPTISLIDTNSDPYLADISIPA

SEQ ID NO: 10616 - protein, 199 aa, Haemophilus parasuis
EEGDIIIDGGNSNYPDTNRRVKALTEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 10617 - protein, 338 aa, Medicago truncatula
MGIMEDPNFLHHFNNHLSSIDTNNLTASAFGDALQKHILSNNPNFNNKTCMETSPTGNERPAKQLRNNSWNYNNSPPTSDTQYDNCCSNNLLSFADLNYTNQLGLLKPKSEMVCPKIDNTSTLANMLITQGNLFGNQNHVFKAVQEAKDIENRPNKLSQAHDHIVTERKRREKLSQRFIALSALVPNLKKMDKASVLGEAIRYLKQMEEKVSVLEEEQKRKKTVESVVIVKKSQLSMNEAEDRADTNNSTYDETLPEIEARFCERSVLIRLHCLKSQGVIEKIMSEIEKLHLKVINSSSLTFGNFTLDITIIAQMDVGFCMTVKDLVRKIRSAYSSFM

SEQ ID NO: 10618 - protein, 604 aa, Medicago truncatula
MITLTDFYHVMTAMVPLYVAMILAYGSVKWWKIFSPDQCSGINRFVALFAVPLLSFHFIASNNPYKMNLRFLAADTLQKLIILCLLAIWSNFSKRGCLEWTITLFSLSTLPNTLVMGIPLLKGMYGEFSGSLMVQIVVLQCIIWYTLMLFMFEFRGARLLIFEQFPDTAGSIVSIHVDSDVMSLDGRTPLETDAEIKEDGKLHITVRKSNASRSDIYSRRSQGLSSNTPRPSNLTNAEIYSLQSSRNPTPRGSSFNHTDFYSMMGGGNGRNSNFGANDVVNNYGLSANSRGVTPRPSNYEEEANNNAKKFKNYPAPNPGMFSPTNNNNGSKNLGSNVSVNAKKSNGQSQQKQEDLHMFVWSSSASPVSDVFGGHDFGAHDQKEVKLNVSPGKVEGHRETQEDYLEKDEFSFGNKGMEREMNQHEGGEKGGDGKSKVMPPASVMTRLILIMVWRKLIRNPNTYSSLIGLTWSLVSFRYHIEMPAIIAKSISILSDAGLGMAMFSLGLFMALQPKIIACGNSIAAFSMGVRFLVGPAVMAAASFAVGLKGVLFHVAIVQAALPQGIVPFVFAKEYNVHPDILSTGVIFGMLIALPITLVYYILMGL

SEQ ID NO: 10619 - protein, 234 aa, Oryza sativa
MAGHDELKLLGHWSSAYVTRVKLALHLKGVSYEYVEEDLRNKSDLLLASNPVHKTVPVLIHNGNPIRESQIIVQYIDEVFSGAGDSILPADPYERAVARFWAAYIDDKLLAPWKKVFRAKTEEERAAWMKQMFVAVDVLEGGLKECSKGKGCFFGGDSVGYVDVVLGGAVSFVHANDMITGGKLFDAARTPLLAAWLERFGELDAAKAVLQDVDRAVEHTKVRYARNAATAAND

SEQ ID NO: 10620 - protein, 209 aa, Arabidopsis thaliana
MEVKLWNDKREREMYENFAELYAIIKATEKLEKAYIRDLISPSEYETECQKLIVHFKTLSASLKDMVPNIERFAETYKMDCSAAVYRLVTSGVPATVEHRAAASASTSSSASVVAECVQNFITSMDSLKLNMVAVDQVYPLLSDLSASLNKLSILPPDFEGKIKMKEWLLRLSKMGASDELTEQQARQLHFDLESSYNSFMAALPNAGN

SEQ ID NO: 10621 - protein, 416 aa, Treponema pallidum
MVFGCSLRRRCFRRPAFVPVSRAHPVFLCVRANVDKDSLDGVIVAKKDYYEVLGISKTASGEEIKKAYRRLAIQFHPDRNQGNKEAEERFKEATEAYEVLIDAQKRAAYDRYGFDGLKDMHGAHGFNSSAFQGFEDIFGGGFSDIFENIFGTSSRRGGSGNDGSGGSGRGANLRYDLQISFEEAVYGKKSELHYVRDETCITCKGAGSASGGRKMCPDCKGTGQIRRSTGFFSIAQSCARCGGEGTIIESPCARCAGSGIERKKQKIIVSIPAGVEEGRRITIPRQETPVAQAVPTGTCTCLCLFVRMSISNVKVLTCTVQLRYRTQAILGAQVTVRALDGSAQQVRVPAGTQGGALLRVKGMGVPLARGAGDLYVKVLVRIPTTLSARSRALLAEISQEEGENAHPPLLELSSLK

SEQ ID NO: 10622 - protein, 179 aa, Bacillus firmus
MRDEIKEVLISEEEIQEKVKELGKAITEEYDGRFPLVVGVLKGAMPFMGDLTKRIDTHLEMDFMDVSSYGAGMVSSGEVKILKDLDTSVEGRDVLILEDIIDSGLTLSYLIKLFHYRKAKSVKVVTLLDKPDGRKVDLVPDMAGFTVPDAFVVGYGLDYAERYRNLPYIGVLKPEIYES

SEQ ID NO: 10623 - protein, 712 aa, Bacillus cereus
MSQEKQVFSIDLAGRQLTVETGQLAKQANGAVLVRYGDTAVLSTATASKEAKNVDFFPLTVNYEERLYAVGKIPGGFIKREGRPSEKAILASRLIDRPIRPLFADGFRNEVQVVSIVMSVDQDCSSEMAAMLGSSLALSISDIPFEGPIAGATVGRINGEFVINPTVEQQEQSDIHLVVAGTKDAINMVEAGADQVPEETMLEAIMFGHDEIKRLIAFQEEIVQAVGKEKSEVKLYEVDADLNQAVREMAEEDMHSAIQVHEKHAREDAINEVKKRVIEHYEAQEADADTLGQVNEILYKIVKEEVRRLITVEKIRPDGRKGDEIRPLASEVGILSRTHGSGLFTRGQTQALSICTLGALGDVQILDGLGVEESKRFMHHYNFPSFSVGETRPMRGPGRREIGHGAIGERALEPVIPSEKDFPYTVRLVSEVLESNGSTSQASICGSTLAMMDAGVPLKAPVAGIAMGLVKTGEHYTILSDIQGMEDHLGDMDFKVAGTAQGVTALQMDIKIDGLSREILEEALQQAKVGRVHILNHMLSVIPEPRTELSAYAPKIITMTINPDKIRDVIGPSGKQINKIIEETGVKIDIEQDGTVFISSINQEMNDKAKKIIEDIVREVQVGEIYEAKVKRVEKFGAFVELFSGKDGLVHISELALERVGKVEDVVKIGDVITVKVIEIDKQGRVNLSRKVLLKEEQEKEAVKEENKQEQQ

SEQ ID NO: 10624 - protein, 530 aa, Unknown
  Rhodococcus sp. RHA1
MLEASLAGQLKSLLEKLTLPIELVSSLDDGPKSVELAELLTQIAAMSEKITYERRDDDTRRPSFAVRRSGTDIEVRFAGIPLGHEFTSLALALLQVGGHPSKEAPELLEQVRDLDGDFHFETYFSLSCQNCPDVVQALNLMCVLNPRISHVAIDGALFQDEVDGRQIMAVPTVFLNGELFGSGRMSLEEIVGKLDVGAADRAAAAIAQKDPFDVLVVGGGPSGAAAAVYAARKGIRTGIAAERFGGQVLDTMAIENFISVPYTEGPQFGSALENHVRQYGVDIMNTQRAAKLVPAATENGLVEVELESGASLLARTVILSTGARWRSMNVPGEDAYRNKGVTYCPHCDGPLFKGKRVAVIGGGNSGVEAAIDLAGLVEHVTLVEFDSVLRADEVLQRKLRSLPNADILLSTLTTEVLGDGNKVTGLTYQDRTTDTSHTLDVEGVFVQIGLLPNTEWLAGSVELSDRGEIAIDDRGQTSVPGVFAAGDCTTVPYKQIVIAAGAGATAALSAFDRLIRTGVPAEESTAATVA

SEQ ID NO: 10625 - protein, 226 aa, Glycine max
MLRCLEGLKPLFASILRCCDLDIYNQPRGLEDPELLARETVFSVSEIEALYELFKKRLEAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 10626 - protein, 131 aa, Clostridium thermocellum
MNIALIAHDKKKELMASFCIAYRSILKNHTLFATGTTGAIIVEATGLNVHRFLPGVMGEQQISARAAYNELDLVIFFRDPISAKSDEPDIHSLLRECDINNIPFATNLGTAEMLIKGLERGDLDWRELIKK

SEQ ID NO: 10627 - protein, 381 aa, Nicotiana tabacum
MEVISTNTNGSTIFKNGAIPMNGYQNGTSKHQNGHQNGTSEHRNGHQNGISEHQNGHQNGTSEHQNGHQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFSDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKSKLAPLKFYNSDIHKAAFILPSFARSMIES

SEQ ID NO: 10628 - protein, 353 aa, Nicotiana tabacum
MEVISTNTNGSTIFKSGAIPMNGHHNGTSKHQNGHKNGTSEQQNGTISLDNGNELLGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEIDFKNPVNPIDKETAQVKSKLAPLKFYNSDIHKAAFILPSFARSMIES

SEQ ID NO: 10629 - protein, 166 aa, Campylobacter coli
MKNIILGGGCFWCVEAAFENFEGIIHTEVGYTGGNDNPSYESVCNGDGNIEVVKIIYNEAKISLEQILSLFFKIHDPTSFDKQGADIGIQYRSAIFYENQSDKNTIEDFIKKEQVNFSLPIVTQIYKLQKYYKAEDYHQHYFIHNPNQSYCRFVIAPKLEKIRNYE

SEQ ID NO: 10630 - protein, 403 aa, Chlorobium tepidum
MKRDYYEILGVARSADKDEIKKAYRKLALKYHPDKNPDNKEAEEKFKEVNEAYEVLSNDDKRRRYDQFGHAGVGSSAASGSGPGGAGYGDINDIFSAFNDMFSGGGGRARTGGSPFSGFEDVFSGGFSGSGSGRRRSAGIQGTDLKIRLKLTLEEIAKGVEKTIKIKKLVTCRECNGTGSKSGKTEICPTCHGSGEVRQATKTMFGQFMNISVCPTCGGEGRVVKDRCPSCYGEGIKQGEATVKITVPAGVQDGNYLTLQGQGNAGPRGGAPGDLIVVIEEKPHELFKRNGDDIIYDLSVGFPDLVMGTKIEVPTLDGHVKLTIPAGTQPNTMLRIGGKGIGHLRGGGSGDLYVRVNVFVPKEVSGKDRDLLKELKKSTVICPNHGDENHEKSIFEKAKDIFS

SEQ ID NO: 10631 - protein, 431 aa, Unknown
  Vibrio sp. Ex25
MNKSYPNHSLENFFSTNLSATDDAVFAGIQAESARQNEQIELIASENIVSKAVMQAQGTCLTNKYAEGYPGRRYYGGCEHVDTVEAIAIERAKKLFNCEYANVQPHSGAQANGAVKLALLQPGDTILGMSLDAGGHLTHGARPALSGKWFNAVQYGVDRETLEINYDDVRALAVEHKPKMIIAGGSAIPRVIDFAKFREIADEVGAILMVDMAHIAGLIATGAHPSPLPHAHVVTTTTHKTLRGPRGGMILTNHEDIIKKINSAVFPGLQGGPLMHVIAAKAVAFGEALGPEFKTYIDSVINNAKVLAEVLQTRGCDIVTGGTDTHLMLVDLRPKGLKGNKAEEALERAGITCNKNGIPFDTEKPMITSGIRLGTPAGTSRGFGAEEFKLIGNWIGDVLDGLVNNPEGDADVEKRVRKEVKELCSRFPLYQ

SEQ ID NO: 10632 - protein, 109 aa, Glycine max
  misc_feature (46)..(46): Xaa can be any naturally occurring amino acid
VPKSIRLNDMSFSVFNEGLTESEMSSHMNSLASKNKCFKSYIGMGXYNTHVPPVILRNIMENPAWYTQYTPYQAEISQGRLESLMNFQTMISDLTALPMSNASLLDEGT

SEQ ID NO: 10633 - protein, 361 aa, Prochlorococcus marinus
MSYSEANVIAGGLAHIPVLIGVFGFIQSFILKRTQAKGTSNQPSTQTKPASSVASSQPKVIKKPAHPNVPVNTYKPKTPFIGTVKENYSLLKSGAIGRVNHITFDLSSGDPLLKYVEGQSIGIIPAGEDANGKPHKIRLYSIASTRHGDDYKGNTVSLCVRQLQYEKDGKTIDGVCSTYLCDIKPGDKVKITGPVGKEMLLPEDENANIIMLATGTGIAPMRAYLRRMFDPTEQEKNSWNYKGNAWLFMGAPKTANLLYDSDFEGYKSKFPNNLRYTKAISREQKNARGGRMYIQDRVLEHADEIFALIENPKTHIYLCGLKGMEPGIDEAMTQAAASKGLVWSELRPQLKKAGRWHVETY

SEQ ID NO: 10634 - protein, 949 aa, Bacteroides fragilis
MKTDLLACRHIGVNKADAEVMLRKIGVASLDELIDKTIPANIRLKAPLALPAPMTEYEFARHIAELAGKNKLFTTYIGMGWYNTITPAVIQRNVFENPVWYTSYTPYQTEVSQGRLEALMNFQTAVCDLTAMPLANCSLLDEATAAAEAVTMMYGLRSRNQQKAGANVVFIDENIFPQTLAVITTRAIPQGIEIRTGKFRDLEFTDDLFACVLQYPNANGNAEDYREFTEKAHTANCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYTVYHGQEGIRNIASRIHSITVFLEKSIGKLGFKQVNKQYFDTLRFILPDSVSAQQIRTIALSKEVNLRYFDNGDVGLSIDETTDVAAANILLSIFAIAAGKDFQKVDDIPEATIISEELKRQTPYLTHEVFSKYHTETEMMRYIKRLDRKDISLAQSMISLGSCTMKLNAAAEMLPLSCAEFMCMHPLVPEDQAAGYRELIHNLSEELKVITGFAGVSLQPNSGAAGEYAGLRTIRAYLESIGQGHRNKVLIPASAHGTNPASAIQAGFTTVTCACDEHGNVDMDDLRAKAEENKDDLAALMITYPSTHGIFETEIVEICQIIHACGAQVYMDGANMNAQVGLTNPGFIGADVCHLNLHKTFASPHGGGGPGVGPICVAEHLVPFLPGHGLFGNSQNEVSAAPFGSAGILPITYGYIRMMGAEGLTMATKTAILNANYLAACLKDTYGIVYRGANGFVGHEMILECRKVYEETGISENDIAKRLMDYGYHAPTLSFPVHGTLMIEPTESESLSELDNFVLTMLTIWNEIQEVKNGEADKEDNVLINAPHPEYEVVSDQWEHCYTREKAAYPIESVRENKFWVNVARVDNTLGDRKLLPTCYGCFD

SEQ ID NO: 10635 - protein, 954 aa, Unknown
  Vibrio sp. Ex25
MTELLQSLSTQNEFVGRHNGPSKSDQQKMLDAINAVSLDALIEETVPAQIRLEQPMTLAEAKSEADMLVTMKQFAKQNQIKRTFIGQGYYNTFTPNVILRNVLENPGWYTAYTPYQPEISQGRLEALLNFQQMIIDLTGMEIANASLLDEATAAAEAMTLCKRAGKSKSNVFFVADDVHPQTLEVVKTRAKFIGFEVLVGSLESLPEQDVFGALVQYPSTTGEVRDLTDIIAKAQANKTLVTVATDLLASTLLKPAGEMGADVAIGSAQRFGVPMGYGGPHAAFMATRDKHKRTMPGRVIGVSIDTNGNQALRMAMQTREQHIRREKATSNICTAQALLANMASFYAVYHGAEGLRTIARRTHHMTAIIAAGLTKGGFELAHNSFFDTITINTGSKTEELYAKALSADINLRLLPGKLGISCDETTTVADVEALFAVFGVKEDVAALSTEIGGNEFAAIPEALRRTTEYLTHPVFNTHHSETQMMRYLKQLENKDFSLTHGMIPLGSCTMKLNAAAEMIPITWPEFGSIHPFAPAEQAAGYAALAKDLKEKLCEITGYDAFSLQPNSGASGEYAGLIAIQRYHESRGEGHRNVCLIPSSAHGTNPATASMVSMKVVVVKCDEEGNIDIDDLAAKIEKHKDNLSSIMITYPSTHGVYEEKVKEVCEMVHAAGGQVYLDGANMNAQVGLTSPGFIGSDVSHLNLHKTFCIPHGGGGPGMGPIGVKSHLAPFLPGHIEDGVEGEDFAVSAADMGSASILPISWAYIAMMGEAGLTDATKVAILNANYVMETLRQHYPVLYRGKNGRVAHECIIDIRPLKEETGISEEDIAKRLMDYGFHAPTMSFPVAGTLMVEPTESEDLEELDRFCDAMIAIREEMEKVKNGEWPLENNPLVNAPHTQVDLSAEEWDRPYSRELGCFPSKATKSWKYWPTVNRVDNVYGDRNLICSCPSIDNYED

SEQ ID NO: 10636 - protein, 513 aa, Candida albicans
MSEPTKNLESIRSQELDSDHSISYDSTTGLKHGLKDRHLSLIALAGIIGPGIMIGASLALASGPAALLLGFGIIGIVAFCMMQSLGEIATMYPTGATFSTLGAKFVDYSWGGAVGWNYVIIWIAVLANEYNTTASVLQFWGPQVPLYGYVLILWAVFTAFQFLGVSVWGEFEFWLALTKIVGLVAFYIFSIIYCAGGVKGTKAFGFHYWNDPGPFANGFKSFVSTLTFASTFYSGCEVTAIAASEAKNPSRALPKAIKQTFWRILIVYLGIAISYGLTVPYDDPRLSKGSKTLKSPMTIAIQRAGWDGGAHLINAFIIVVCISAISSSIYTGSRSMVNLANEGCAPSILKRVNGQGVPYAAVILMSTLGLISLMNQSTGAANAYQYIVNLSGVAVFIVWGNVCFYHIRFRQAMKLQGRSLDEIPFKGMLYPYLPILGLALNVILALIQGWSYFKPFDAGNWVDAYILLPFFFVLYFGFKLWHKSKWVNLEEVDLDEGRREDDEKGVDNNKWMI

SEQ ID NO: 10637 - protein, 446 aa, Debaryomyces hansenii
MPPKADWDKYVAPNEDDESQDKIQPLSEGDIQVLKTYGAAPYASSLKEIEKDLKTIEERIKENIGIKESDTGLAAPHLWDVMGDKQRMSEEQPLQVARCTKIIEATNPNPQAGLLQNADNKSKYVINIKQIAKFVVGLGERVSPTDIEEGMRVGVDRQKYEIQLPLPPRIDPSVTMMTVEEKPDVTYSDVGGCKDQIEKLREVVELPLLSPERFVKLGIDPPKGILLYGPPGTGKTLCARAVANRTDATFIRVIGSELVQKYVGEGARMVRELFEMARTKKACIVFFDEIDAIGGARFDDGAGGDNEVQRTMLELITQLDGFDPRGNIKVMFATNRPNTLDPALLRPGRIDRKVEFSLPDLEGRANIFRIHSKTMSCEKDIRWELISRLCPNATGAELRSVCTEAGMFAIRARRKVANEKDFLKSVEKVIKGNMKFSSTSQYMQYN

SEQ ID NO: 10638 - protein, 123 aa, Oryza sativa
  misc_feature (19)..(19): Xaa can be any naturally occurring amino acid
  misc_feature (30)..(30): Xaa can be any naturally occurring amino acid
  misc_feature (70)..(70): Xaa can be any naturally occurring amino acid
PGTLMIEPTESESKAELDXRFCDALISIRXEIAEIESGKADVNNNVLKSAPHPPQLLMSDSWTKPYSREXYAAFPAAWLRGAKFWPTTCRVDNVYGDRNLICTLQQGSQVAEEAAAGYRMIFQ

SEQ ID NO: 10639 - protein, 591 aa, Prochlorococcus marinus
MNVASKDTTVTTASTAPRLSLQCAAIASDTTTIRALDWDRSRFDIEFGLRNGTTYNSFLVRGAKTALIDTNHLKFEDTWLPMLKQQIDPKAIDYLIISHTEPDHSGLVGQIIDLNPEIEIVASKVAIKFLEDQVHRPFRSREVKSGEELDLGTNSTSGIAHRFEFLSAPNLHWPDTIFSFDHATGILYTCDAFGLHYCSEELFDQDPSALAPDFRFYYDCLMGPNARSVVQALKRMDQLPEITTIAVGHGPLLRHHLKLWVEDYRDWSSQRNQGESYAAICYLSYYGFCDRLSQAIAHGIGKAKGEVQLVDLRATDAQELSALIGEAKAVVVPTWPSQPDAELQSSIGTLLAALNQKQWVAVYDAYGGNDEPIDAVAAQLRSLGQKEAFEPLRVRQAPDGNVYQRFEEAGTDLGQLLNQKQNIAAMKSLDTELDKAMGTLSGGLYVVTASQDEESSQRRGAMIASWVSQASFTPPGLTVAVAKDRAIETLMQVGDRFVINVLREDNYQPLLRQFLKRFPPGADRFEGVNVLNNVAKGGPVLVDALAFLDCLVKQRLETPDHWIIYALVEQGNVADAEAKTAVHHRKVGNHY

SEQ ID NO: 10640 - protein, 615 aa, Prochlorococcus marinus
MSMSSIHEPAAAAQRTVITLPIEKGLISLRGLSPQRLRFELEYALERGSTANSFLFSAGDDSYGQPQAAVLVHPPGDAYAEVFMPALAKALPSDTTTLKVVVGHINPNRVALLKKLASTYPKLKLISSNPGAKLLRELWEQRKPATPNNNEQEESSLPSLPSIEIVRQEQKLSLSNEHALWLLPAPTARWPGGLLAFEESLGLLMSDKLFAAHLCTSEWAEANRISTEEERRHFYDCLMAPMASQVDTLVERLEELDIRTIAPCHGPAIETSWRSLLNDYRRWGESQQQAPLKVVLLFASAYGNTAAIADALAKGVSSTGIQVESLNCEFTPANELVNAIQQADAYLIGSPTLGGHAPTPIVSALGTLLAEGDRNKKVGIFGSYGWSGEALELLEKKLRDGGFSFGFEPIKVKFSPDAAMVKTLEETGTLFGRNLLKKQRRQQPRASSGMSASRSDPAVLALGRVVGSLCILTARKGEGNTALSGAMVASWVSQASFSPPGLSVAVAKDRAVEALLHRGDHFALNVLAAGRQHELMKHFLQPFPAGSDRFAGLDLDASPAGQPLLKNALAWLEGCVQQRMECGDHWLLYAEISHGALLEREGTTAVHQRRSGANY

SEQ ID NO: 10641 - protein, 103 aa, Zea mays
  misc_feature (67)..(67): Xaa can be any naturally occurring amino acid
MHTLHHGDSRRASRSEVVYVDMPAPYARTKKFTPLRGVRSDIDFVSPTVEEIKTKRQLAQYLKVHPXGPAVSKLDWRTADTPSCSARINENVKVFDSPDAEKI

SEQ ID NO: 10642 - protein, 108 aa, Triticum aestivum
LISRVSKPSQGTPPPPLASSARRGSHLSDFSQWPLGNYRGFVMSASVEGEGRCSKPTVEVGVAHVGCAEDAAAFVALAAAVDLSMDACRLFSHKLRKELSHLRSDVLR

SEQ ID NO: 10643 - protein, 597 aa, Oryza sativa
MDTTIGSVPTASDAAAPAPAANSAPREATLGRHLARRLAEVGARDVFTVPGDFNLTLLDELEAEAGAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLEAAVETAAAFLNKAVKPVLVGGPKMRVAKACKSFVELADACGYPVAVMPSAKGLVPEHHPRFIGTYWGAVSTPFCAEIVESADAYLFAGPIFNDYSSVGYSLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAKAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 10644 - protein, 156 aa, Triticum aestivum
  misc_feature (7)..(7): Xaa can be any naturally occurring amino acid
  misc_feature (12)..(12): Xaa can be any naturally occurring amino acid
SFLTPTXGLQGXWDPYPIDMEFRPPCMVLSTIGISKPGKLEGKSTQQCATHLHQLHVCLPSSTNKTRLLYRMSLDFAPWMKHMPFMHLLWSHFAEKVLNEDLRLVLGQQDRMNNGANVWNWPVSYDKLGIRYRLWRDAVERGVDRLPFSNEIESGS

SEQ ID NO: 10645 - protein, 1666 aa, Magnetospirillum magnetotacticum
MGLVVLANVVLIGRVISPQLDMQARVQSGIAGQQLMGLGLEAASRISAERGPSNGALGSELPLPPERTEALKAARTATDAALRQVVESLDKSPSLRHGAAVRNSLFAAGSQLETARRQIDALIARPRPERADQEVAAAVGGMVKVLPLMAPGLNVIETNLAQADPALINYVTISRLSTEMRDFAGQIGSIFTAPYVARRPLTVDELAQVERSLGTIAALDTQLRLAIDKTGSPPDLLAALATIDAEFFGGGLPLIRRIRDVGRSSGEYGMNAAEFAKIYVPQMNSILGLRAAALAAIADRMIHLEHETDATLRFNLLLTVIVVMSVLACFLLIRLRMSRPLSQVHRALGQLARGEDHMDLPVARRHDEIGEVVEALTQLAAVVRDRAHESYVSGLVARITADLQAAEDFESLARGLFSNMAPVIDLGFAVYFRCDGETGELVECGGYARHGDAPARSPSDGLVAECAAERREILISNPPEGYLKIRTGLLSAAPGAILLLPVVGGDECLGVIEMATMKPIEGRDRDVLDAVLPVLAMRMEILARSERTRQLLLATQRQAGELTAQQERIQALLSEQDAIFDNAPMGIMYTASGRIQRANPAMAELLGYTVESMKGLEASRLFATADSYREFGGLVAPKLGAGEGIHQEWDLIRGDGQLFSAMISAKGVRLEGLERASIWIVEDITERKRLEREMRESGERLRRILENSPAGVSINTEDGHSLFSNQRMAEMLATTPEELSHRSATEFWFDPTDRQEFIATLRRDGYVRDYQSRFVRADGTPITVLLASALTEFADGRYLVSWAYDITERQKAEDAVRFAGAEQQAIFEAATVGIAFLKNRVIVRGNPQLDRLFGYEPGELVGQSTRIWFPDDESFADVGDAYEALSRGEVHQREQCYVRKDGTRFWCRISGSAIDPSDLSRGAVWMLEDVTDARAAAEALAKARDVAEDAAKTKSDFLANMSHEIRTPMNAIIGMSHLALKTELNPRQRDYVKKIQQSGQHLLGIINDILDFSKIEAGKLEVEVTEVHLDKVLENVGNLISDKASAKGLELLFDLGAGVPLDLMGDSLRLGQVLINYANNAVKFTEEGEIVVAVRLLEDLGAEVMLRFEVRDTGIGLTEEQKARLFQSFQQADTSTTRKFGGTGLGLAISKKLAELMGGEVGVDSVPGEGSTFWFTARMGKGKPRAPLLPEPELVGRRMLVVDDNENARAVLVDMLSSMSFEVDSVEGGAAAIDAIREAMLDQPYEVVFLDWQMPGMDGLEVAERIHDIRLPFPPHLIMVTAYGREEIIKGAQAADIGEVLVKPVNPAALFDSIMRVFASDDRRSEEDEGTEGGTVDVSGLKGVRVLLVEDNELNQEVASEILGDAGLVVDIAANGQIAVDKAKTGHYDLILMDMQMPVMDGVTATREIRAMGFQDLPIIAMTANAMQADREKCLEAGMNDHIAKPIDPDSMFATMMKWLGRQPVAVAAPAASPDEAVAVIARLRALLADSDPEAEELVEAHGDLLRGLLGKKADRFAALVSGYDFDKALKLLPAEAKEDGRRNLPEIDPDIFDFEVMGSIYKWDLERLRPILAGFLDDAAAKVAKIEAAQPEDTALREIAHGLKGAANTAGAIRLGRLAADMESSAKADNTAALAMLAPLMAPTLDELKGALAPFLSSVTEKASS

SEQ ID NO: 10646 - protein, 72 aa, Actinobacillus pleuropneumoniae
MAKEDCIEMQGTILETLPNTMFRVELENGHVVTAHISGKMRKNYIRILTGDKVTVEMTPYDLSKARIIFRAR

SEQ ID NO: 10647 - protein, 292 aa, Symbiobacterium thermophilum
MPRVCFIVNPIAGRGQALERWRQIEPLAARLGEYGVKFTERPGHGTDLARLAIQEGYDRVVSIGGDGTLNEVGNGLVGTNAALAVIPAGRGNDWVRTAGVPTDAAEGCRLAFGGRVARMDVGLAHGYRYFFNAAGFGFDAEVCARVNTYGQRFPKFSYVRGVFDTLFHFTGVPVDVEIDGERRRLNRVLLLEVGIGRYFGGGMQVFPQADIADGLFEIAWGEDLGRLELIRLVSLIYSGRHVGHPKVRMARGRKLTADSPEKVVIQLDGEVVGHLPVTFEILPGALNVVLPG

SEQ ID NO: 10648 - protein, 199 aa, Haemophilus parasuis
EEGDIIIDGGNSNYPDTNRRVKALAEKGIRFIGSGVSGGEEGARHGPSIMPGGNSEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 10649 - protein, 518 aa, Unknown
  Burkholderia sp. 383
MCVARRHHAAQPRQYVSLSAFVIEVPVPAKSSVAPAIVWFRDDLRVTDQPALTRAVESGRPLVCVFVDDTGDGAGRALGGAARWWLHGSLAGLDAALARHGGRLLLLRGDAQREIERVVHDTGAEAVYWNRRYAQPQRDADAALKASLKARGVTVESSNGSLLNEPWEVLTGSGGPYQVFTAYWRAARRDRTVAVPLPEPERIAFHPWPKAVRDCALALDVLALRPPVPDWAGGLRDAWPAPDEAGAHARLDAFLTASLAGYADARDLPDRPATSRLSPFLRFGNLSPRQVWHAVQGAANAGGAAVAADADKFLSELGWREFSYTLLYHFPALASDNFRAQFDAMPWRDDPAALRAWQRGRTGYPLVDAGLRELWTTGWMHNRVRMVVASFLIKHLLIDWRAGEAWFWDTLVDADPANNAASWQWVAGCGADAAPYFRIFNPVAQGQKFDPDGAYVRRWVPELAGLDNASIHAPWEASPLELDAAGVRLGVDYPAPLVEHAAARARALDALAALPKRR

SEQ ID NO: 10650 - protein, 569 aa, Persea americana
MTTIRQKPKTFTIHSSLHSSPVLHLPKLLTTTTTPLHEKSQRELGLILQEPNRAKWNFFQRAAAVALDTVEDSFISGVLERRHPLPKTSDPAVQISGNFAPVDEHPVQHHLPVSGRIPRCLDGVYLRNGANPLLEPVAGHHFFDGDGMVHSVSLRQGTASYACRFTETHRLVQERAIGRPVFPKAIGELHGHSGIARLLLFYARTATGLVDGSSGTGVATAGLVYFNRHLLAMSEDDLPYHVRVTSSGDLETVGRFDFMGQLNSAMIAHPKLDPASGELFALSYNVIKKPFLKFFKFTSDGKKSPDVEIPIDQPTMIHDFVITENFVIIPDQQVVFKLQEMIRGGSPVVYDKKKTARFGILLKTAADSNGLRWIDAPDCFCFHLWTAWEEPETDQVVVIGSCMTPPDSIFNESNQSLKSVLTEIRLNLKTGLSSRREIDPSRHLNLEVGMVNRNRLGRGPGVSLSSHCRPWPKVSGFAKVDLSTGEVTKFIYGEQCYGGEPYFVSRDPVAPEDDGYVLSFMHDEKTARSELLIVNAITMQLEASVKLPSRVPYGFHGTFISSKDLANQA

SEQ ID NO: 10651 - protein, 349 aa, Arabidopsis thaliana
MAVSATGFEGFEKRLEISFFETTDFLDPQGKSLRSLTKSQLDEILTPAECTIVSSLTNSFVDSYVLSESSLFVYPYKIIIKTCGTTKLLLSIPHILRLADSLCLTVKSVRYTRGSFIFPGAQSYPHRSFSEEVALLDDYFGKLNAGSKAFVMGGSDNNPQRWHVYSASSTEESAVCDKPVYTLEMCMTGLDNIKASVFFKTNSVSASEMTISSGIRNILPGSEICDFNFEPCGYSMNSIEGDAVSTIHVTPEDGFSYASFETVGYDLKALNFKELVDRVLVCFGPEEFSVAVHANLGTEVLASDCVADVNGYFSQERELEELGLGGSVLYQRFVKTVECCSPKSTLGFC

SEQ ID NO: 10652 - protein, 586 aa, Lotus japonicus
MCGILAVLGCSDFTQAKRVRVLELSRRLKHRGPDWSGLHQHGDCYLAHQRLAIVDPASGDQPLFNEDKSIIVTVNGEIYNHEELRKQLPNHQFRTGSDCDVIAHLYEEHGENFMDMLDGIFSFVLLDTRDNTFIVARDAIGVTSLYIGWGLDGSVWISSEMKGLNDDCEHFEVFPPGHLYSSRERAFRRWYNPTWFSESIPSAPYDPLAVRHAFEKAVIKRLMTDVPFGVLLSGGLDSSLVASITSRYLATTKAAEQWGSKLHSFCVGLEGSPDLKAAKEVADYLGTVHHEFTFTVQDGIDAIEEVIYHVETYDVTTIRASTPMFLMSRKIKSLGVKWVISGEGSDEIFGGYLYFHKAPNKEEFHTETCRKIKALHQYDCLRANKSTFAWGLEARVPFLDKEFINVAMNIDPEYKMIKRDEGRIEKYILRRAFDDEEKPYLPKHILYRQKEQFSDGVGYSWIDGLKDHAAKHVTDKMILNAGNIFRHNTPLTKEAYYYRMIFERFFPQNSARLTVPGGPTVACSTAKAVEWDAAWSNNLDPSGRAALGVHLSAYDDKQNNLINNKPVEFEKLIPMEAPSLGVAIHS

SEQ ID NO: 10653 - protein, 481 aa, Pseudomonas aeruginosa
MNGLPMNLIWFRCDLRTTDNSALLAAADGRPCVALYLLSPAQWREHDDAPCKVDFWLRNLGELQRQLAALNIPLLVRDCGHWRQAPEVIGRLCRELGIGAVHVNQEYGVNEERRDQAVGQRLREQGVAFHSHLDQLFFAPGSVLTRTGGYFQVFSQFRKVCHERLYQALPGVRPRPQPQPPHALASDPLPDAVPAFPRPADSLRRLWPAGEEVAQERLRGFADQHLADYHERRDFPALPGTSQLSPYLAAGVLSPRQCLDAALVANRGEFSGGQQGAATWINELLWREFYKHILVGYPRVSRHRPFREETEALRWRQAPAELEAWQQGRTGIPIIDAAMRQLLATGWMHNRLRMVVAMFLSKNLLIDWREGERWFMRHLIDGDLAANNGGWQWSASTGTDAVPYFRLFNPLSQSERFDPRGEFIRHWLPELAGLERKAIHDPSSLGLFAGVDYPRPMVDLKASRERALAAFRNLPPRDGRA

SEQ ID NO: 10654 - protein, 524 aa, Prochlorococcus marinus
MNNNDKWARYCDLLYSDDSLGFWLDISRMDVAINDFEDFNEIYSKAFDALESLENGSIANIDEGRQVGHYWLRNPKVAPSPEISDSITKEIQDISKFGSSILNGEITNSDGEKYTDVFWIGIGGSGLGPLLIKESFKRESIGLDLHFLDNVDPEGISHKLNSILPNLNSTLFVVVSKSGGTPEPLIGMEQAMKFVRDNNQNWSSRAIAITSKGSKLDLLAHNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKKAATKIIKLQKEIEELLDDGKQRTLNEINDALSSDSTESIYLILRKLSENSDHYSMIGNQSNPDKLIISKT

SEQ ID NO: 10655 - protein, 143 aa, Glycine max
MFPSSSPTSLHTPILHPRYCHHPTPSCTQFSPLALPPFHRTLSFLAPPPLLPAAPALSAASAAKPDKSGEQKWVHEGLIMESLPNGMFRVRLDNEDLILGYISGKIRKNYVRILPGDRVKVEVTRYDSSKGRIVYRLRSSTPS

SEQ ID NO: 10656 - protein, 46 aa, Lemna aequinoctialis
VTDIPATTGATFGHEIVCYESPRPTMGIHRFAFILYEQLGRQTVYA

SEQ ID NO: 10657 - protein, 420 aa, Rhodobacter sphaeroides
MDGTDVTMLMREIGVRARAAAAELAFAEPSRKEEALNAAAEAMLARSDEILEANGRDLAFGAEKGLTPAMMDRLKLDAARIDGIVEGLRAVAGQPDPVGQVIAEWDRPSGLHIRRVRTPLGVVGVIYESRPNVTADAGALCLKSGNAVILRGGSESFHSSGAIHAALQDGLRQAGLPVDAIQRVPTRDRAAVAEMLRMVEHIDVIVPRGGKGLVGLVQAEARVPVFAHLEGICHVYADGEADLEKARRVVLNAKTRRTGICGSAECLLIDRAFLAKHGPVLIEDLLKAGVEVRAEGELAQVPGTVPAQPEDFGREFLDMIIAAKVVDGVDEAIAHIRRYGSSHTESILTENDATAERFFRRLDSAILMRNASTQFADGGEFGMGAEIGIATGKMHARGPVGAEQLTSFKYLVTGDGTIRT

SEQ ID NO: 10658 - protein, 586 aa, Lotus japonicus
MCGILAVLGCSDDSQAKRVRVLELSRRLKHRGPDWSGLHQHGDNFLAHQRLAIVDPASGDQPLFNEDQSIIVTVNGEIFNHEELRKQLPNHKFRTGCDCDVIAHLYEEHGENFVDMLDGIFSFVLLDTRDNSFLVARDAIGVTSLYIGYGLDGSVWIASELKGLNDDCEHFELFPPGHLYSSKEKEFRRWYNPPWFSEAIPSAPYDPLALRQAFEKAIIKRLMTDVPFGVLLSGGLDSSLVASVTARYLADTKAAKQWGSKLHSFCVGLEGAPDLKAAREVADYIGTVHHEFQYTIQDGIDAIEDVIYHVETYDVTTIRAGTPMFLMSRKIKSLGVKMVLSGEGSDEIFAGYLYFHKAPNKEELHQETCSKIKALHKYDCLRANKSTYAWGLEARVPFLDKKFIDVAMGIDPENKMIKRDEGRIEKWVLRKAFDDEENPYLPKHILYRQKEQFSDGVGYGWIDGLKDHAAKHVTDKMMLNASNIYPFNTPNTKEAYYYRMIFERFFPQNSARLSVPGGASIACSTEKAIEWDAAWSNNLDPSGRAALGVHDSAYDDQLNKSVSKGVEPEKIIPKMEVSPLGVAILS

SEQ ID NO: 10659 - protein, 46 aa, Perilla frutescens
VTDIPATTGATFGQEIVCYESPRPSMGIHRFVFVLFRQLGRQTVYA

SEQ ID NO: 10660 - protein, 428 aa, Agrobacterium tumefaciens
MPEQAVKQSHDIDALMMTIGAQAKAASRPLSIAGTDQKNRALLAMASAIEASKEAILAANRKDLAAAESAGLAASFVDRLTLNDARIAGIAEGIRSVAALADPVGEVIAAWDRPNGLKIERVRTPLGVIGVIYESRPNVTADAGALCLKAGNAVILRGGSDSQHSSRAIHACLVQGLRIAGLPENAIQLVPVTDRAAVGALLSGLKGTVDVIVPRGGKSLVARVQSEARVPVFAHLEGICHIYVDKSADLDMAKAIVVNAKMRRTGICGAAETLLVDASAVSSHLEPVVKALLDAGCEVRGSQPVRNVVEGLEAATEEDWRTEYLDAIISVAVVDGISGAIEHIGTYSSNHTEAVIAEDPDVVARFFNELDSAILLHNASTQFADGGEFGMGAEIGIATGKMHARGPVGVEQLTSFKYRVHGTGQTRT

SEQ ID NO: 10661 - protein, 586 aa, Brassica oleracea
MCGILAVLGCSDDSQAKRVRVLELSRRLRHRGPDWSGIYQNGFNYLAHQRLAIIDPDSGDQPLFNEDKSIVVTVNGEIYNHEELRKGLKNHKFHTGSDCDVIAHLYEEHGENFVDMLDGIFSFVLLDTRDNSFMVARDAVGVTSLYIGWGLDGSLWVSSEMKGLHEDCEHFEAFPPGHLYSSKSGGGFKQWYNPPWFNESVPSTPYEPLAIRSAFEDAVIKRLMTDVPFGVLLSGGLDSSLVASITARHLAGTKAAKRWGPQLHSFCVGLEGSPDLKAGKEVAEYLGTVHHEFHFTVQDGIDAIEDVIYHVETYDVTTIRASTPMFLMSRKIKSLGVKMVLSGEGSDEIFGGYLYFHKAPNKQEFHQETCRKIKALHKYDCLRANKATSAFGLEARVPFLDKEFINTAMSLDPESKMIKPEEGRIEKWVLRRAFDDEERPYLPKHILYRQKEQFSDGVGYSWIDGLKAHAAENVNDKMMSKAAFIFPHNTPLTKEAYYYRMIFERFFPQNSARLTVPGGATVACSTAKAVEWDASWSNNMDPSGRAAIGVHLSAYDGSKVALPLPAPHKAIDDIPMMMGQEVVIQT

SEQ ID NO: 10662 - protein, 382 aa, Pseudomonas fluorescens
MSAPVVIVGTGLAGYNLAREFRKLDSETPLLLITADDGRSYSKPMLSTGFGKNKDADGLSMAEPGAMAEQLKAEVRTHTRISGIDPGHKRLWIGEEAVAYRDLILAWGAETVRVPVQGDASELIFPINDLEDYARFRSAAAGKRRVLLLGAGLIGCEFANDLILGGYSVDLVAPCEQVMPTLLHPAAAAAVQAGLESLGARFHLGPVLNRLQRSADGLEAHLSDGQVIACDLVVSAIGLRPRIDLAAAAGLVVNRGVVVDRELKTSHANIYALGDCAEVDGLNLLYVMPLMSCARALAQTLAGKPTAVSYGPMPITVKTPVCPLVVSPPPRGAEGVWTAEGQGADIKVLCRNADGQLLGYALTGAAVMEKLALNKELPALLA

SEQ ID NO: 10663 - protein, 984 aa, Burkholderia pseudomallei
MTSSAFDSSRQGCGSGQCACRRAAQTRRADPFDDTDYGTPTRHADTDVTLDIDGRAVTVPAGTSVMRAAIEAGINVPKLCATDSLEPFGSCRLCLVEIEGRRGYPASCTTPVEAGMKVRTQSDRLQALRRNVMELYISDHPLDCLTCAANGDCELQDMAGAVGLREVRYGFDGKNHLSDAKDESNPYFSYDPSKCIVCNRCVRACEETQGTFALTIASRGFESRVAASAGEAFMDSECVSCGACVAACPTATLIEKSVARLGQPEHEIVTTCAYCGVGCALKAEMKGEQVVRMTPHKNGLANEGHACVKGRFAWGYATHKDRITKPMIREKITDAWREVSWDEAIGYAAARFRRIQDEHGRDSIGGITSSRCTNEETYLVQKLVRAAFGNNNVDTCARVCHSPTGYGLKTTLGESAGTQTFASVGSADVIVVIGANPTDGHPVFGSRLKRRVREGAQLIVVDPRRIDLVDGPHVKAVHHLQLRPGTNVALVNALAHVIVTEGLVDEAFVAERCEPHAFDVWRAFAARPENSPEATADITGVPADAVRAAARLYATGGRAAIFYGLGVTEHAQGSTMVMGIANLAMATGNLGIEGAGVNPLRGQNNVQGSCDMGSFPHELPGYRHIGDAAVRARFDEAWSTTLQPEPGLRIPNMFDAALDGSFKGLYCQGEDIVQSDPNTQHVAAALASLDCLVVQDIFLNETAKYAHVFLPGATFLEKDGTFTNAERRISRVRRAMRPLSGYADWEVTLMLSRALGYDMHYAHPSEIMDEIARLTPTFAGVSYALLDELGSVQWPCNDAAPQGTPTMHVDQFVRGKGKFVITQYIASPEKVTPRYPLILTTGRILSQYNVGAQTRRTENVRWHGEDRLEIHPHDANDRGIRTGDWVGVASRAGQTVLRALVTERMQPGVVYTTFHFPESGANVITTDSSDWATNCPEYKVTAVQVAPVAQPSEWQRAYTRFRAEQLALLEQRTAERAPAIATGK

SEQ ID NO: 10664 - protein, 962 aa, Prochlorococcus marinus
MRHIGPSLEDQQQMLLELGHRDLQSFVAAVVPPDILETTAPSSSLPEGCGEVQAMEELRLIAAANRVRRSLIGLGYYGTATPALIQRQVLENPAWYTAYTPYQAEISQGRLEALFNFQTLISELTGLPIANASLLDEGTAAAEAMSLSFAICKRPAAHRFLVDAEVLPQTLAVLRTRAEPLGIDLEVAEPMTFQFDAEVFGVLLQLPGRSGRLWDPTTSIQAAHEVGALATVAIDPLAQVLLAPVAEFGADIAVGSVQRFGVPMGFGGPHAAFFATLEIFKRQVPGRLVGQSVDAEGQPALRLALQTREQHIRRDKATSNICTAQVLLAVMASFYAVHHGPDGLAAIARRVLRLRAQLERGLHQLGYPVQSIARFDTIEVICREAPAVHQAAALAGFNLRVLPLGVAPEAAHGFGISFDELSTDQELKSILQILAEAAGQPVPVLEDPGNPHLEELVGLPLRQRPWLQQQVFHRYRSETELLRYLQRLVGRDLSLVHGMIPLGSCTMKLNAAAELIPISWREFAALHPFAPQDQCQGYQRLVQDLEHWFADITGFAGVSLQPNAGSQGELAGLLVIRAWHHSRGEQQRDVCLIPTSAHGTNPATCVMAGLRVVPVACDADGNVDLNDLASKAEAHAPQLAALMVTYPSTHGVFEPQIREICELVHGHGGQVYLDGANLNAQIGFCRPGTYGADVCHINLHKTFCIPHGGGGPGVGPIAVSAHLMPFLPGHPLAACGGEQGIGAISAAPWGSAGILPISWMYLRMMGAEGLRQASAVALLSANYLAHRLHPHYPVLFRGQAGLVAHECILDLRPLKRSAGLEVDDIAKRLMDYGFHAPTVSWPVAGTVMVEPTESESLEELNRFCDAMIAIREETAAIESGQIDPQNNPLRRAPHTLAAVTAEVWDRPYSRAEAAFPLAEQRQSKFWPAVSRIDNAYGDRNLLCSCPSVEELADNAVLKPPLV

SEQ ID NO: 10665 - protein, 702 aa, Alkaliphilus metalliredigenes
MVKTFEMKLGGRPFVVEIGKVAELAQGSCMIKYGDTTVLVTACASKEPKEGLDFFPLSCDYEEKLYAVGKIPGGFIKRESRPSEKATLTARLIDRPIRPLFPKGYHNDVQVIATVLSMDQDCPPDISAMIGSSIALSVSNIPFMGPTASVSVGMIDGEYIVNPTSKQKEDSTLELIVSGTKNAIMMIEAGANELTEAQILDAIMFAHEEIKKIVAFIENIVSEVGKPKSEVIAKQMDSNLLTEVVIFLDTKLANAIKTFDKTERNENIQAVSAEALDYFEEKYEGRSKEVHDILSMLIKVETRKMITSEGIRPDNRKLDEIRPISTQVGILPRAHGTGLFNRGETQVLTITTLGDLRDAQRIDGIGEEDEKRYMHHYNFPPYSVGETRFMRGPSRREIGHGALVERALLPMIPSKEDFPYAIRLVSEVLTCNGSSSQASVCGSTLSLMDAGVPIKRMVAGIAMGLIKEDDQVVILSDIQGMEDALGDMDLKVAGTEEGITAMQMDIKIAGIDRGIMETALEQARIGRLHILNKMKESITSPRIELSSYAPKVTQIKVHPDKVREVIGAGGKVINKIIDETGCKITIENDGTIYVAAPDQESSRRAVEMIELIVKDPVVGEVYTGKVIKIMDFGAFVEILPGKEGLVHISNLAHERVTKVTDVLAEGDLIEVKLMEINPQGKIGLSRKALLPKPETKSETQSE

SEQ ID NO: 10666 - protein, 195 aa, Spiroplasma citri
MKIHPLVKEILITTEEIDEKCFELGQQISHYYLNEYPAKDNTILCLGLLKGCIPFMAKFIAHLVGVECETEYIVVSSYFGGVKSKDTPQILLDLPMPITNRDILLVEDIIDSGKTIKMIKDYLYLKGARSVKVVTLLDKKAGRKINLVADWYGFDVPPAFLIGFGLDYQERLRNLPYIAIADQEKLATWKWDIKK

SEQ ID NO: 10667 - protein, 237 aa, Dactyloctenium aegyptium
GIVNGMDVSEWDPSKDKYIAVKYDAETAIEAKALNKEALQAAVGLPVDRKIPLIAFVGRLEEQKGPDVMAAAIPGIMEEEDVQIVLLGTGKKKFERLFKGAEEKYPDKVAAVVKFNAPLAHHIMAGADLLAVTSRFEPCGLIQLQGMRYGTPCACASTGGLVDTVVEGKTGFQMGRLSVDCKVVEPADVQKVATTLKRAIKVVGTPAYKEMVRNCMALDLSWKGPAKNWENVLLSMG

SEQ ID NO: 10668 - protein, 363 aa, Solanum tuberosum
KLKRSTIESASKRLGSTKEGKKQLLRLILDWVEQHRLQKKQMRVEQSIQNSAPFNFNNPNACLFNASFPDSSPVMTGPIQGYIGDLYSNGSLFAPPYNQTMSGSTTSRSWSPSQFTMATASQYNQFPENDSTNNVTIPDRPLFSAQYVPYQVFDGNSERLARLGTCATKEARKNRMARQRRVSLHHYRHQTQNQRQISNEKSVMMGGKINNCAMSRANSLGNWVYWPCAAAAPPITMVPLADTPQALPMERPAVQSQKHQKHGSTDRRQACKTEKNLKFLLQKVLKQSDVGNLGRIVLPKKEAESHLPQLETRDGISIAMEDIGTSRVWNMNIGFWPNNKSRMYLLENTGDFVLANGLQEGDF

SEQ ID NO: 10669 - protein, 266 aa, Medicago sativa
MAASSMALSSPTLAGKPVKLTPSSQELGAARFTMRKSATTKKVASSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLVHAQSILAIWATQVILMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 10670 - protein, 582 aa, Solanum tuberosum
MKRELNEVYYGGNKEDVHGFENINIVPTDFDPMDDTDIWLNGNFSNDFTSLQDFPCMSSSSSTSNSLPTEQSDPSSSWAVQKSDGDEQNFDTISDQECLNVMDLIDGDHEFLDPMISFFHSGENQQQKEQANDEQVSIFQGDSELALMFLEWLKQNKDNISAEDMRSIKLKRSTIESASKRLGSTKEGKKQLLRLILDWVEQHRLQKKQMRIEQSIQNSAPFNFNNPNACFYNASFPDSSPVMTGPIQGYIGDLYSNGSLFAPPYNQTMSGSATSRSWSPSQFSMATASQYNPFPDNDSTNNVAIPDQPLFSAQYDPYQVFDGNSERLARLGTCATKEARKNRMARQRRVPLHHYRDQTQDQRQISNEKSVMMGGKINNCAISRANSLGNWVYWPCAAAAPAPPITMVPLADTPQALPMERPAVQSQKHGSTDKRQACKTEKNLKFLLQKVLKQSDIGNLGRIVLPKKEAESHLPQLETRDGISIAMEDIGTSRVWNMKYRFWPNNKSRMYLLENTGDFVLANGLQEGDFIVIYADIQCGKYLIRGVKVRPNGAKSDSTQPAKKIVRKIAAVDSSPFAQAVR

SEQ ID NO: 10671 - protein, 438 aa, Actinobacillus pleuropneumoniae
MLTQEKNDLNKSGLDITNDTLVLILAGGRGSRLYELTDRRAKPAVYFGGCRRIIDFALSNCINSNLLKIGVITQYAAHSLLRHLQRGWSFLPYERNQYIDMLPARQQLDENTWYRGTADAVYQNMSMMKSHYRPKYVVILAGDHIYKMDYTQMLRDHVESGAKCTVGCIEVPREQAVEFGVMAVNDKLKVKEFVEKPADPPAMPGRPDSSLASMGIYVFDADYLYKMLEQEAAVPGTSHDFGKDIIPKAVEEGVLYAHPFERSCKGRNATGAIYWRDVGTIDSYWAAHMDLVSEEPQLDLYDESWPIHGRPQQTAPARFYYNKQRQRTLDNSLIAGGCVITDAEISNSVLFNRVHVAEETIIEHTVILPQVSIGKNCVIKRAVIDRHCVIPDGLQIGVNPEEDAKHFRVSKGGIVLVTQGMLDKLQGITSNIKLHHTI

SEQ ID NO: 10672 - protein, 208 aa, Arabidopsis thaliana
MSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 10673 - protein, 661 aa, Actinobacillus pleuropneumoniae
MKVTAGSPFPLGAQAVENGTNFAIFSENATAIELCLFKQSQEQRFAMRRTGDVWHLFVENIGEGIEYGFRVAGITDKQKGALFNPQKLLLDPYAKRIVGTVSAHTADEIKYFQWDDKRDNAHLAPKSVVVAPDNFDWEDDERPHYPWRETIIYELHVKGFSRLNQQIPEPLRGTYAGLAHPASIAYLKRLGVTTIELQPVSHHIDEVHLQKMGKTNYWGYNVIGHSAVEPVLAWDQEDPITEFKYLVKTLHKHGFEVILDLVYNHTAEGGTDSLTLCQRGIDNQNYYWLNQQGEYENWAGCGNALNLSHPRVCQWAIDSLVYWVSECHVDGFRFDLATTLGRTPEFDQLSPFFEKIKQTPELEHIKLIAEPWDIGPNGYQVGRFPIQFAEWNDKYRTTMREFFLGESGNLGEFARRLAGSDDLYWQYSPAKSINYFASHDGFTLQDLVSYNKKHNEANGENNRDGENTNHSNNHGVEGETDNEFVNILRDQTACSLLATLFLSNGVPMLRAGDELGHSQKGNNNAYCQDNEIAWIDWQNANESRIEYVAKWIALRKRIALLSHQNHWWTENDVQWFSSQGKVMEIEDWHNTESKALQILLQDHWLILINAKKTTQQFFLPTGKWHICLGKNIATLIANTQSVALQFEQMGVCVLQRKLSSY

SEQ ID NO: 10674 - protein, 184 aa, Arabidopsis thaliana
MSVDFSSERVCYVHCSFCTTILAVSVPYASLFTLVTVRCGHCTNLLSLNIGVSLHQTSAPPIHQDLQPHRQHTTSLVTRKDCASSSRSTNNLSENIDREAPRMPPIRPPEKRQRVPSAYNRFIKEEIQRIKACNPEISHREAFSTAAKNWAHFPHIHFGLKLDGNKKGKQLDQSVAGQKSNGYY

SEQ ID NO: 10675 - protein, 366 aa, Oryza sativa
  misc_feature (317)..(317): Xaa can be any naturally occurring amino acid
MAPSSLACSRKNKTKTNKLWFHHSALQVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIVSLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVXNMELHKYMNNSFQHIKAMCKSHDCNLRMGAFTLGVNRVARATLLRGWEA

SEQ ID NO: 10676 - protein, 524 aa, Pisum sativum
MEPLSSTKQINNNNNNLAKPSSLHVETQPLEPSPLRKIMVVASIAAGVQFGWALQLSLLTPYVQLLGIHHTWAAYIWLCGPISGMLVQPVVGYHSDRCTSRFGRRRPFIAAGSIAVAIAVFLIGYAADLGHSFGDNLDKKVRPRAIGIFVVGFWILDVANNMLQGPCRALLGDLCAGNQRKTRNANAFFSFFMAVGNVLGYAAGAYSKLYHVFPFTKTEACNVYCANLKSCFFLSIALLTVLATAALIYVKETPLIAEKAVVTAEDGGSNGGMPCFGQLSGAFKELKRPMWILLLVTCLNWIAWFPFLLFDTDWMGKEVYGGTVGEGHAYDMGVRAGALGLMLNSVVLGATSLGVDILARGVGGVKRLWGIVNFLLAICLGLTVLVTKLAQHSRQYAPGTGGLQDPLPPSGGIKAGALTLFSVLGIPLAITYSIPFALASIFSSTSGAGQGLSLGVLNLAIVIPQMFVSVLSGPWDALFGGGNLPAFVVGAVAALASGILSMILLPSPPPDMAKSVSATGGGFH

SEQ ID NO: 10677 - protein, 139 aa, Arabidopsis thaliana
MSRWSSCQEFLKHVESRNPGQPEFMQAVTEVIESLWPNIEKNPKYADASLLERIAEPERVVMFRVCWMDDKGVVQVNKGYRIQHSMAIGPYKGGLRFHPSVNLSILKFLAFEQTFKNALTTLPMGGGKGGSDFDPKGKS

SEQ ID NO: 10678 - protein, 443 aa, Burkholderia pseudomallei
MTTIDLNAGALAPVADEIDAVDLRVTGALARELNGVLVRNGPNPLRGRFDGGDVLSWWPQDAMLHAISFDDGRATRYRNRWARTRRWARVHDPAREPSLVDTNPNVNVLAHAGEILALAEGGAPLAITAGLDSIGAARRHPGLAHGMAAHPKVDPHTGELIAFRADWNRPWLRYLVADAAGAQTVDTEIALPAPSMMHDIAITATHSIVFDLNVAYDFSMLSRGHRMPLRWHDARGARIGVVPRRGGDARWFDIAPCFIQHVVNAYDLDRPAIVLDVVRYPWFLRVARDGRGFDDNPPGVLWRYVIDLVTGTVAEQPLDDAGIELPRIDARRTGRRHRFLYAAEQPTPVELRGIVRYDLDGGSTQRYRVPPGDQNSEPVFVPRPGAAGEDDGWLLVCVYRHATDTSDVVILDGRSIGDGPIATVHLPRRVPAGFHGAWLPAGA

SEQ ID NO: 10679 - protein, 301 aa, Bacillus cereus
MMKRARIIYNPTSGRELFKKSLPEVLQKLEQAGYEASCHATTGPGDATVAARQAVERKFDVVIAAGGDGTLNEVVNGLVGHEFRPKFGIIPVGTTNDFARAIGVPRSIEEAADIICEGKTVPLDLGRANDTYFINIAGGGRITELTYEVPSKLKTVLGQLAYYLKGIEMLPSLHPTYVEIEYDGKLLQEEITMFLITNTRSVGGFEKVAPYASINDGLFDLLVLKKGSIADLIKAATQAQRGEHINNPKVLYTQANRIKVHSPDKLMINLDGEYGGDAPMEFENMYHCLELFVPEHQEDAL

SEQ ID NO: 10680 - protein, 223 aa, Zea mays
IPGSTHASERIQRRNVLSTMLSAWTILLLSPGQVSLAETTGGAFREYIDTFDGYTFLYPKNWIQVRGAGADIFFRDPMVLDENMSVEISSPSSSRYTSVEDLGPPEKAAEKVLGQYLTEFMSTRLGVRRESNVLSASSKVADDGKLYYEVEVNIKSYASNNELAVMPQDRVQSLEWDRRYLSVLGVENKRLYELRLQTPEQVFMQEEEDLRRVMDSFRVIKAA

SEQ ID NO: 10681 - protein, 89 aa, Jasminum nudiflorum
MKEKEAKWVVEGLVTEGHPSGMFRVQLDNGARVLGYISGKIRRKAIRIMQGDRVQIELSHYDLTKGRIIYRLPPPPIPKPKDSEDDSED

SEQ ID NO: 10682 - protein, 434 aa, Chlorobium tepidum
MSAVIKRAQFAIPPLSLMILSSVEVLGVRQEICDLRFDKLPLDRSWDLVGISVQTGAVKPAVEVASLFRERGVPVVLGGPYVSIFPERCREHGDVLVIGEADDLWREVLEDLRRGALKPEYRQGAFPDLSAPRPVDKSALQINRYFTTNVVQTTRGCPYSCDFCSVHVMNGHKLRHRPVGEVVREVEAFLREDKRIFFFLDDTINADEAYALELFSKLIPFNIKWVGQATTLLGENPKLLDIFSRSGCGALLVGIESLADESNRAHHKFHNPAERQVRCIQEIRKAGICVYGSFIYGLDGDTLAMPERIDAFIDEAGVDVPGINLLRPIPGTGVFDRLAAEGRLLHPSHDHDAFRFSWGQEMLYYPKQMSLDQFIPSYTELTSKVFTPRRAIKRAMRAPTLRSAVLMFNMLYVHMYGLSRKDLRRQLAELSSVR

SEQ ID NO: 10683 - protein, 461 aa, Burkholderia vietnamiensis
MVSGNEKDGLKRGLKNRHIQLIALGGALGTGLFLGIAQTIKMAGPSVLLGYAVAGVVAFFIMRQLGEMVVDEPVAGSFSYFADKYVGHFTGFLSGWNYWVLYILVSMAELSAVGIYVQYWWPGVPTWVSALVFYVAINLLNLASVKSYGETEFWFSIIKVAAIVGMIGFGGWLLVSGHAGPEASIANLWQHGGFFPNGVSGLVMSMAAIMFSFGGLELIGITAAEADDPKHSIPRATNQVIYRILIFYIGALAVLLSLYPWEKVVTGGSPFVLIFHALSSNLVANVLNVVVLTAALSVYNSGVYSNSRMLFGLATQGNAPKVLCSVNRRGIPLAALGASALATGVCVLVNYFMPGKAFEVLMGLVVSALIINWAMITLIHLKFRQAKRIAGEQTSFRSLGYPFTNYLCLAFMAGILVVMYLTPDLRLSVYLIPVWLAVLAIGYRFRQKNARYALGDGASAR

SEQ ID NO: 10684 - protein, 424 aa, Unknown
  Acinetobacter sp. ADP1
MKLDNIQVDTVVVGAGQAGVAMSEHLTALGISHLVIEKNRIAEAWRSRRWDSLVANGPCWHDRFPNMTFDADQDSFVHHDQVAEYFEKYAKQFNAPIETGVEVTKAYKNKNKKGFTVETSQGVIQTQRIVVATGAFQKAIIPSIAPKQPDFYQIHSDQYRNPQALPEGNVLVIGSGSSGVQIADEINRSGRKVYLSVGPHERPPRSYRNRDNVWWLGVLGGWDYMKSDNSPLKGLAVSGARGGVNIDFRLLANEGITLLGMTRSFEGDKIYFQNDLQKNLKDGDETLLKFLDSADEYVRQNELNLPLEHQVREILPDPSCVTDPILALDLKEANITTVIWASGFGLDYDWLQVKAFNDQGRPAHKQGISDERGVYFLGLPYLTGRGSSFIWGVWYDAKHIADHIQIQRSYLDYQTDKDSLDHSA

SEQ ID NO: 10685 - protein, 250 aa, Prochlorococcus marinus
MNLLSIVGAGPGAPDLLTVRALDRIQKAEILIWTDSLISPQIAALAPKNCQKIKTSSLTLEEIIPLLIKETKKGKKVVRLHDGDPNLFGAISEQICSLAEAGIEVEVIPGISAYQATACALQKELTIPGVVQTIVLSRTEGRTAIPENEKLENLASLKATLCLYLSARHVDKVQATLLKYYSDDTPVAIGYRVSWQDEWLTIVPLRKMASVSKKKGLFRTTLYIISPALNPNKRRSRLYSPDHKHLFRQT

SEQ ID NO: 10686 - protein, 197 aa, Raphanus sativus
MPRSRSRVLILLLPLAFVFYLYRYLPSPAIVDQSSYSSIYHISVKDIDGNDVSLSKFTGKVLLIVNVASKCGLTQGNYKELNILYAKYKTKGLEILAFPCNQFGSQEPGSNKEIKDNICTTFKGEFPIFDKIEVNGENASPLYKFLKEQKGGLFGDSIKWNFAKFLVDKQGNVVDRFAPTTSPLEIEKDIEKLLAST

SEQ ID NO: 10687 - protein, 237 aa, Dactyloctenium radulans
GIVNGMDVSEWDPSKDKYIAVKYDAETAIEAKALNKEALQAAVGLPVDRKIPLIAFVGRLEEQKGPDVMAAAIPEILEEEDVQIVLLGTGKKKFERLFKGAEEKYPDKVAAVVKFNAPLAHHIMAGADLLAVTSRFEPCGLIQLQGMRYGTPCACASTGGLVDTVVEGKTGFQMGRLSVDCKVVEPADVQKVATTLKRAIKVVGTPAYKEMVRNCMALDLSWKGPAKNWENVLLSVG

SEQ ID NO: 10688 - protein, 237 aa, Coelachyrum piercei
GIVNGLDVSEWDPSKDKYIATKYDVSTAIEAKALNKEALQAAAGLPVDRKIPLVAFVGRLEEQKGPDVMAAAIPQLMEDDVQIVLLGTGKKKFERMLMSSEEKYPDKVRAVVKFNAALAHHIMAGADLLAVTSRFEPCGLIQLQGMRYGTPCVCASTGGLVDTVIEGKTGFHMGRLSVDCKVVVPADVQKVASTLKRAIKVVGTPAYEEMVKNCMIQDLSWKGPAKNWENVLLSLGV

SEQ ID NO: 10689 - protein, 237 aa, Eleusine coracana
GIVNGMDVSEWDPSKDKYIAVKYDEETATEAKALNKEALQAAVGLPVDRKIPLIAFVGRLEEQKGPDVMAAAIPEILEEEDVQIVLLGTGKKKFERLFKAAEEKYPDKVAAIVKFNAPLAHHIMAGADLLAVTSRFEPCGLIQLQGMRYGTPCACASTGGLVDTVVEGKTGFQMGRLSVDCNVVEPADVKKVSTTLKRAIKVVGTPAYKEMVRNCMTQDLSWKGPAKNWENVLLSMG

SEQ ID NO: 10690 - protein, 316 aa, Neisseria meningitidis
MSQHRKLIILGSGPAGYTAAVYAARANLNPVIITGIAQGGQLMTTTEVDNWPADADGVQGTELMARFLAHAERFGTEIIFDQINAVDLQKRPFTLKGDMGEYTCDALIVATGASAKYLGLPSEEAFAGKGVSACATCDGFFYKNQDVAVVGGGNTAVEEALYLANIAKTVTLIHRRSEFRAEKIMIDKLMKRVEEGKIILKLESNLQEVLGDDRGVNGALLKNNDGSEQQIAVSGIFIAIGHKPNTDIFKGQLEMDEAGYLKTKGGTADNVGATNIEGVWAAGDVKDHTYRQAITSAASGCQAALDAERWLGSQNI

SEQ ID NO: 10691 - protein, 237 aa, Calamovilfa gigantea
RDRHGMDVSEWDPSKDKYIAVKYDVETAIQAKALNKEALQASVGLPVDRNIPVAAFVGRLEEQKGPDVMAAAIPHILAEKNVQIVLLGTGKKKFERLFKGAEEKYPDNVRAVVKFNAPLAHHIMAGADLLAVTSRFEPCGLIQLQGMRYGTPCACASTGGFVDTVVEGRTGFQMGRLSVDCNVVEPADVQKVATTLKRAIKVVGTPAYNEMVRNCMAQDLSWKVPAKNWEKVLLGMG

SEQ ID NO: 10692 - protein, 417 aa, Pseudomonas aeruginosa
MFSKHDQIRGYDDELLAAMDAEEARQEDHLELIASENYTSKRVMQAQGSGLTNKYAEGYPGKRYYGGCEHVDKVERLAIDRARQLFGADYANVQPHSGSSANAAVYLALLNAGDTILGMSLAHGGHLTHGAKVSSSGKLYNAVQYGLDTATGLIDYDEVERLAVEHKPKMIVAGFSAYSKTLDFPRFRAIADKVGALLFVDMAHVAGLVAAGLYPNPIPFADVVTTTTHKTLRGPRGGLILARANEEIEKKLNSAVFPGAQGGPLMHVIAAKAVCFKEALEPGFKDYQAQVIRNAKAMAEVFIGRGYDVVSGGTDNHLMLISLVRQGLTGKEADAALGRVGITVNKNAVPNDPQSPFVTSGIRIGTPAITTRGLQEAQSRELAGWICDILDHLGDADVEAKVATQVAGLCADFPVYR

SEQ ID NO: 10693 - protein, 237 aa, Calamovilfa longifolia
RDRHGMDVSEWDPSKDKYTAMKYDVETAIQAKALNKEALQASVGLPVDRNIPVVAFVGRLEEQKGPDVMAAAIPHILAEKNVQIVLLGTGKKKFERLFKGAEEKYPDNVRAVVKFNAPLAHHIMAGADLLAVTSRFEPCGLIQLQGMRYGTPCACASTGGFVDTVVEGRTGFQMGRLSVDCNVVEPADVQKVATTLNRAIKVVGTPAYNEMVRNCMAQGLSWKGPAKNWEKVLLSMG

SEQ ID NO: 10694 - protein, 70 aa, Unknown
  Musa x paradisiaca
GNEIVCYESPRPTAGIHRFVFVLFRQSVRQTIYAPGWRQNFNTKDFSALYNLGDPVAAMFFNCQRESGCE

SEQ ID NO: 10695 - protein, 775 aa, Unknown
  delta proteobacterium MLMS-1
MVKRVRTAIIVMGFSGLVAEILLLRELLIVFAGNELSIGIILANWLILEAFGCYFAGGRAAESPRRVEVFTVITILFSLFLVAAVVATRLLKEMLGVSIGENVGFLPMFYSSFLILLPVSVLHGALFTSGCRIYADCAPAAGPDASPAGRVYVYETVGTIIGGIACTYLLIPYLDAMHTTAWLALLNFVVCLALLAPHRRRRRLTGMVAAALGGLILLTGTLLATGQVERLHWYTVAGQWQNLNVVEYRNSPYGNICVIENEGQYIYFLDGIATILTPIPDIPFVEEFVNVPLLTHRQPEKILILSGGAGGIINEALKHPSLAAVEYAEQDPLLFELLRKFPTELTESELDDPRVKIHHTDGRLLLQTTPRQYDLIFIGILEPSSLQTNRYFTREFFTLARERLNPGGILVFGLPGSMTYLNDELKNLNSSVFHTVKSVFPHVRVIPGDGHNLFLSSDAPDVAAVDAHQIMARLTEREIRAEAMLPWHIEKKLHPGWQEWFYEFIEESSRQLNRDFTPLGVFYSISHWNALYSPEFGRFFNKLERADLKGAALVPLLLLAAYLLLRAGVKRAVRPGIPLAIATTGFAGMISSLVLIFTFQAFYGYLFSWIGLLVAAFMAGAAAGAQLVTSALGRIQDHRQLFKRIELAIVVFSLLLPLGLLAANTWVASVAAFDLLRVLFLVVSLVAGFLLGAQFPLANKLYLGDNAHLSRTAALLYTADLLGGWLGGIVGAVVLLPVLGLVGTCLVMGLLKAVSFVIISFEFSDLVTVHQGRQP

SEQ ID NO: 10696 - protein, 181 aa, Vibrio parahaemolyticus
MKGLLKLAAYLGFISMSSFVLASECPDILQGKQRMLNSTEEIELCEVFKGKTLLVVNTASQCGFTPQYEQLETLYQTYKDKNFAVIGFPSNDFRQDKGSEENTAKICYLDYGVTFPMMARSSVLGNDANPVFSEISTQAGVTPKWNFYKFLISKEGKVIATFPSSTSPTSTTLTNMIEQQL

SEQ ID NO: 10697 - protein, 245 aa, Variovorax paradoxus
GGNKLRKLEYLIPEALEGGYDTLVSIGGVQSNQTRQVAAVAAHLGLKCVLVQENWVNYSDAVYDRVGNIEMSRIMGADVRLDAAGFDIGIRQSWEQAMADVRAAGGKPFPIPAGCSEHPRGGLGFVGFAEEVRQQEAELGFKFDYIVVCSVTGSTQAGMVVGSAADGRADRVIGIDASAKPQQTFEQILRIAKNTAELVELGRDITEKDVVLDRRFGGPEYGLPNEGTLEAIRLSARFEGMLTDP

SEQ ID NO: 10698 - protein, 317 aa, Unknown
  Shewanella sp. MR-7
MSQVRHSNLLILGSGPAGYTAAVYAARANLKPVMITGMQQGGQLTTTTEVENWPGDAEDLTGPALMERMQKHAEKFDTEILFDHINEVTLTERPFRLKGDNGEYTCDALIIATGASARYLGLESEEAFKGRGVSACATCDGFFYRNQKVAVIGGGNTAVEEALYLSNIAAEVHLIHRRDTFRSEKILIDRLMDKVANGNIILHLDQTMEEVVGDAMGVTGLKMKSTKDGAITDLAVAGVFVAIGHSPNTGIFEGQLEMNNGYLKVQSGLQGNATQTSIEGVFAAGDVMDQHYRQAITSAGTGCMAALDAERYLDTKK

SEQ ID NO: 10699 - protein, 955 aa, Vibrio fischeri
MSQLLQQLGTDNEFIRRHNGPASSEHQHMLNTIGAETLQQLIEETVPSSIRLPQPMQLPHGLSENAMLAELKQIAQQNTLNTSYIGQGYYNTHTPNVILRNVLENPGWYTAYTPYQPEISQGRLEALLNYQQMVMDLTGLEIANASLLDEATAAAEAMTLCKRGGKSKSNLFFVADDVHPQTLAVIKTRAKFIGFDVVVDHESNLDSHDVFGALLQYPGTTGEVKDLTDLIAQAHTKKTLVIVATDLLASVLLKPVGEMGADIAIGSAQRFGVPMGYGGPHAAFMATREKLKRSMPGRVIGVSIDSKGNQALRMAMQTREQHIRREKATSNICTAQALLANMASFYAVYHGPEGLKTIARRVHHFTAIVAKALQTAGFELEHQHFFDTLTVKTEQQTDILYTKALASSINLRKFDTKLGISFDETTTVSDLVTLLAVFGIDNAECETLSAEVGKDEFAAIPKHCQRTSSFLTHPVFNTYHSETQMLRYLKKLENKDFSLTHGMIPLGSCTMKLNAVAEMLPVTWPEFGGIHPFAPLNQAAGYTTLATSLKSMLCEITGYDEFSLQPNSGASGEYAGLIAIQRYHESRGDAHRNVCLIPSSAHGTNPATASMVSMKVVVVKCDENGNIDMIDLAEKIEKHQENLSSIMITYPSTHGVYEEQVREVCDMVHAAGGQVYLDGANMNAQVGLTSPGFIGSDVSHLNLHKTFCIPHGGGGPGMGPIGVKSHLAPFLPGHTENGVQGMDYAVSAADLGSASILPISWAYIAMMGEMGLTEATKVAILNANYVMERLRPHYPVLYRGTNGRIAHECIIDIRPLKETTGISEEDIAKRLMDFGFHAPTMSFPVAGTLMVEPTESEDLAELDRFCDAMIAIREEMNKVEQGEWPLDNNPLVNAPHTQVDLMSDSWEHPYTREVACFPSSQSKDSKYWPTVNRVDNVYGDRNLICSCPSIENYEE

SEQ ID NO: 10700 - protein, 1262 aa, Arabidopsis thaliana
MVSDADASTSSSSIDIMPSANIQNDVPEPSVHTSHRRTRKPAYLQDYYCHSVASLTIHDISQFLSYEKVSPLYHSFLVCIAKAKEPSTYNEAKEFLVWCGAMDDEIGAMETTHTWEICTLPPNKKPIGCKWVYKIKYNSDGTIERYKARLVAKGYTQQEGIDFIETFSPVCKLTSVKLILAISAIYNFTLHQLDISNAFLNGDLDEEIYMKLPPGYAARQGDSLPPNAVCYLKKSIYGLKQASRQWFLKFSVTLIGFGFVQSHSDHTYFLKITATLFLCVLVYVDDIIICSNNDAAVDELKSQLKSCFKLRDLGPLKYFLGLEIARSAAGINICQRKYALDLLDETGLLGCKPSSVPMDPSVTFSAHSGGDFVDAKAYRRLIGRLMYLQITRLDISFAVNKLSQFSEAPRLAHQQAVMKILHYIKGTVGQGLFYSSQAEMQLQVFSDASFQSCKDTRRSTNGYCMFLGTSLISWKSKKQQVVSKSSAEAEYRALSFATDEMMWLAQFFRELQLPLSKPTLLFCDNTAAIHIATNAVFHERTKHIESDCHSVRERSVYQATLSYSFQAYDEQDGFTEYLSPILRGTIMYIVSMFGLAGLEALICFIFLFLFSFLTSFKASAQNPFYLNHDCPNRTTYSSNSTYSTNLKTLLSSFASRNASYSTGFQNIRAGQTPDRVTGLFLCRGDLSPEVCSNCVAFSVNESLTRCPNQREAVFYYEECILRYSHKNFLSTVTYEGELIMRNPNNISSIQNQRDQFIDLVQSNMNQAANEAANSSRKFSTIKTELTSLQTLYGLVQCTPDLARQDCFSCLTSSINRMMPLFRIGARQFWPSCNSRYELYAFYNETAIGTPSPPPLFPGSTPPLTSPSIPGKSGNSTVLVVAIVVLAVLLFIALVGYCFLAQRTKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQTQLDWMQRYNIIGGIARGILYLHQDSRLTIIHRDLKASNILLDADINPKIADFGMARIFGLDQTQDNTSRIVGTYGYMAPEYAMHGQFSMKSDVYSFGVLVLEIISGRKNSSFDESDGAQDLLTHTWRLWTNRTALDLVDPLIANNCQNSEVVRCIHIGLLCVQEDPAKRPTISTVFMMLTSNTVTLPVPRQPGFFIQSSPVKDPTDSDQSTTTKSTPASIDDELITDLYPR

SEQ ID NO: 10701 - protein, 619 aa, Gibberella zeae
MALMSMIPSPRRCVVLLSLSLTPTLVAAVNPATSTKAAAADYYVRDLPGLPADGPKVNMHAGHIEVTPESHGNLFFWHFENQHIADKQRTVIWINGGPGCSSEDGSMMEIGPYRLTDQDNLVYNNGSWNEFANLLFVDNPVGTGFSSVDTNSYIHELKEMADQFVIFLEKWFALFPQYDRDDIYIAGESYAGQHIPYIARAILDRNKKDSKTAWNLKGLLIGNGWISPAEQYPAYITFGIEKGIIEKDSDNHKKLQADLRSCEKMMASDVGHVDYGECEAILSNMLKLTKKGDGDDACINMYDVRLKDSYPSCGMNWPPDLVHLTPYLRKPEVTSALHVDAIKKSVGWTECNGAVGGAFNAKNSKPSVELLPNLLKEVPIMLFSGAEDLICNHVGTENMINKMEWNGGKGFEVTPGNWAPRRDWDFEGETAGFWQEARNLTYVLVYNSSHMVPFDLPRRSRDMLDRFMGVDISSVGGDPADSRIDGEKGPKTTVGSAKNSTQNAAEDEHQKQLDEAKWAAYYKSGEIVLVIVVIGAVAWGYWIWRERRKGAAYSVLADHDLSRRSTGHRAKSQPGDLETAAFDESELDDLHVTTPGTSTSARFPKNQDGSEKFVTKYAE

SEQ ID NO: 10702 - protein, 645 aa, Arabidopsis thaliana
MSSLISFIFLFLFSSITASAQNTFYLYHNCSVTTTFSSNSTYSTNLKTLLSSLSSLNASSYSTGFQTATAGQAPDRVTGLFLCRVDVSSEVCRSCVTFAVNETLTRCPKDKEGVFYYEQCLLRYSNRNIVATLNTDGGMFMQSARNPLSVKQDQFRDLVLTPMNLAAVEAARSFKKWAVRKIDLNASQSLYGMVRCTPDLREQDCLDCLKIGINQVTYDKIGGRILLPSCASRYDNYAFYNESNVGTPQDSSPRPGKGGNSSVIIIAVVVPITVLFLLLVAVFSVRAKNKRTLNEKEPVAEDGNDITTAGSLQFDFKAIEAATNCFLPINKLGQGGFGEVYKGTLSSGLQVAVKRLSKTSGQGEKEFENEVVVVAKLQHRNLVKLLGYCLEGEEKILVYEFVPNKSLDHFLFDSTMKMKLDWTRRYKIIGGIARGILYLHQDSRLTIIHRDLKAGNILLDDDMNPKIADFGMARIFGMDQTEAMTRRVVGTYGYMSPEYAMYGQFSMKSDVYSFGVLVLEIISGMKNSSLYQMDESVGNLVTYTWRLWSNGSPSELVDPSFGDNYQTSEITRCIHIALLCVQEDAEDRPTMSSIVQMLTTSLIALAEPRPPGFFFRSKQEQAGPSIDSSTHCSVDEASITRVTPR

SEQ ID NO: 10703 - protein, 1068 aa, Crocosphaera watsonii
MNNPKSEIEKDKIIEKLQAEITRLKAVQEATLIMQENLRESEERWQLVLKGTNEGIWDWNLKTDEMFFSPRWKEMLGYSEQELPNHIDTWKQLLHPQDRERVMKILGDHFAKKTDHYSAEFRLKCQDGNYKWILSRGQALWDEAGNPVRMAGSHTDISDRKNEQILLTSLIDCIPDLVFYKDSKGVYKMCNNAFETFAGRDRKYIIGRNDFDLFLTEEALAFREQDRFMMLQKQSRRNEEWITYPNGNRRLVDTLKTPFCCPEGKLMGTIGISRDITDRKQKEEAIKKQAERDALLSNIARQLIDQDLNTAVNFVLESIGKFTQCDRSYIIRYFPQEKVWSMVHEWCDEYSPSTIHDSQNISLEVFPWFSQQLIEGKSICINKLDDFPSEATPEREAYKTSLSPNLLVVPMMTRCQTVGYLGIDTNVYKHWTKDDINLLKLVGELMAIAEARAIAEEAQSESQARFAGILDNANEAIISIDENQKITLFNHAAEQTFGYTSNEVLGQPFNLLIPSRFTNNHYQYINSFKNTQETARQMGGRRPVFGQRKDGTEFLAEVSISKIKPRGKTIFTAIIRDITERKQAEEALKKAKEKADAANCAKSEFLASMSHELRTPLNAILGFTQVMQRDQELNPDHKQNLEIIGRSGEHLLELINDILEMTKIEAGRTTFNRTQFDLYRLLDNLESMLHLKAEEKNLQLLFEKIENLPQYIETDESKLRQVLINLLGNAIKFTQEGGVILRIKTNEMIGDNQEIILTFEVEDTGPGIAPEEVDQLFEAFGQTETGRNSNEGTGLGLPISQKFVQLMGGEISVSSVLGRGSLFTFTIKATIVDANAIKINKSPRRIIGLVPGQPNYRILAVDDRLESRILLVKLLSSMGFNVRQASNGKEALEIWKSWQPHLIWMDMRMPIMDGYTATQHIKANPKGQETVIIALTASAFEEERNLVLGAGCDDFMRKPFREEVLWEKIAQHLGVNYVYDDLDKQKFSSQPNQQAKPQTTLTLQLFLEKMPSQWINALHQAALECSDDSILELVEQIPPDSQPLAISLREWSENFLFEPVIELTQTMI

SEQ ID NO: 10704 - protein, 294 aa, Saccharomyces cerevisiae
TTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHTLGKTHLKNSGYEGPWTANNNVFDNSFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 10705 - protein, 460 aa, Bacillus cereus
MSTKMTPPVEKNEFIDVVFEDLTHDGAGVAKVKGYPIFVKNGLPGEEAQIKIIKVKKNFAFGRLMKLHTESPYRKDAECPVYNQCGGCQLQHLTYEGQLQAKEKQVRDVMQRIGGLSDVPVHPVLGMKNPWVYRNKAQVPIGEREGGLVAGFYRQGTHDIINMESCLIQAEENDTLIQEVKRICEKHGISAYNEERNKGTLRHVMARYGQVTGEIMLVFITRTAELPNKKAIIEEIATKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDAKRNAALNNMTNAEFGVGEAEVVIPKWYKEGVIADTMVVDPPRKGCDEALLNTIIDMKPKRVVYVSCNPATLARDLKVLEEGGYKTQEVQPVDMFPHTTHVECVVLMSRVEK

SEQ ID NO: 10706 - protein, 103 aa, Sesbania rostrata
MSGRGKGGKGLGKGGAKRHRKVLRDNIQGITKPAIRRLAKRGGVKRISGLIYEETRGVLKIFLENVIRDAVTYTEHARRKTVTAMDVVYALKRQGRTLYGFGG

SEQ ID NO: 10707 - protein, 207 aa, Triticum aestivum
  misc_feature (133)..(133): Xaa can be any naturally occurring amino acid
  misc_feature (191)..(191): Xaa can be any naturally occurring amino acid
FVEGTRFTPAKLLAAQEYAVSQGLTAPRNVLIPRTKGFVSAVSIMRDFVPAIYDTTVIIPEDSPKPTILRILQGQSSVVHVRIKRHSMGDMPNSDEDVSKWCKDIFVAKTRYWDKHIATGTFDEEIIPIGRPXVKPLMVVLSWACFLLYGAHRSLQWTQLLSTWKGVILLAPGLAMVTAVMHVFIMFSQAXERSSSAKAARDRVKKD

SEQ ID NO: 10708 - protein, 359 aa, Spiroplasma citri
MAKELTREMLWEAGAQFGHQTKRWNPKMKPYIYGEKNKIHIIDLQQTLWRLEDVKKLMANIAARKGKILFVGTKKQAKWIVKDAAERCESFYVNQRWLGGTLTNLKTIHLRVKRLWNIERQEKNGELKLLPKKEQMLIKKEKDKLEKFLGGIKGMKELPQALFVVDPKEEHIAVREARKLRIPVIAICDTNVDPVPIDYIIPANDDTSRSIAIITHHIADLYGDAMGIKMPEPQFKPSEFTRRDGDENRNSRGGQYDNRRMSGRNERGRDTHYSHKAPNSGKEEAPVGTEPVATTSAPSFNFNTINVVDNDLEKTLSKLKVDELEILSEGFALPKAKKAEMVSELSKHLTIVDNKIVKK

SEQ ID NO: 10709 - protein, 291 aa, Chlorobium tepidum
MNTDQVRIALVQMSCVENPQENLRKAQERIRQAAAGGANIVCLQELFTTLYFCQTEEYEPFGYAEPIPGPSTAALQELAAELGVVIVASLFEIRAKGVHHNTAAVIDADGSYLGKYRKMHIPDDPGFYEKFYFVPGDLGYKVFDTKFGTIGVLICWDQWYPEAARLTALRGADILFYPTAIGWATSETSQEVRASQRQAWKTSHLGHAVANGVFVAAANRAGTEGELEFWGNSFVSDPFGQVIAEAAHNSEEILYADCDLSKIGFYRSHWPFMRDRRIDSYGDITRRWIDE

SEQ ID NO: 10710 - protein, 128 aa, Unknown
  Vibrio sp. Ex25
MKFLHTMIRVVDLDKSIEFYTKVLGMSVLDRFENQEYRYSLVFVGSPDQPDGATIELTYNWDTDSYDLGNAFGHIALGCEDIYAACEKIKALGGNVTREPGQMKGGETHIAFIKDPDGYPIELIQTKQ

SEQ ID NO: 10711 - protein, 250 aa, Unknown
  Polaromonas sp. JS666
MSTSMREMLEAGVHFGHQTRFWNPKMAPYIFGHRNRIHIINLEKSLPMFQDAMKFAKQLSANRGTILMVGTKRQAREIVATEAKRAGVPYVDQRWLGGMLTNFKTVKTSIKRLKEMKAQQEAGLDSISKKEQLTFKREIEKLEKDIGGIQDMNALPDAIFVIDVGFHKIAILEAKKLGIPLIGVVDSNHSPIGIDYVIPGNDDSSKAVALYARGIADAILEGRANAVNDVVKAVSAESSDEFVEVENAAN

SEQ ID NO: 10712 - protein, 951 aa, Haemophilus influenzae
MRFILRFFKYLIRELTMKRMLINATQKEELRVALVDGQRLFDLDIESPGHEQKKANIYKGKITRVEPSLEAAFVDYGAERHGFLPLKEIAREYFPDDYVFQGRPNIRDILVEGQEVIVQVNKEERGNKGAALTTFVSLAGSYLVLMPNNPRAGGISRRIEGDERTELKEALSSLDVPDGVGLIVRTAGVGKSPEELQWDLKVLLHHWEAIKQASQSRPAPFLIHQESDVIVRAIRDYLRRDIGEILIDSPKIFEKAKEHIKLVRPDFINRVKLYQGEVPLFSHYQIESQIESAFQREVRLPSGGSIVIDVTEALTAIDINSARSTRGGDIEETALNTNLEAADEIARQLRLRDLGGLVVIDFIDMTPIRHQREVENRIRDAVRPDRARIQISRISRFGLLEMSRQRLSPSLGESSHHICPRCQGTGKVRDNESLSLSILRLLEEEALKENTKQVHTIVPVQIASYLLNEKRKAISNIEKRHNVDIIVAPNEAMETPHFSVFRLRDGEEVNELSYNLAKIHCAQDENTEESLLSRNVETTAVIEQPAVESAVVALSISEAAPTPVERKSNEPSLLAKIIAKIKGLFATKSEENKPKNNRTSRNPNRNQRRSQDRRSSRRPRSENNETERTEEQVRNVRERNQRRPRRNLVEESIAESAVNSTPVFEAKEERTEPVTQRRQRRDLRKRVRVEDNETVVENNFSTTEKMPEVDVITVQNNDEKPVHQNQRSERQERQRRTPRHLRAANNQRRRRDQEPKSPMPLFAAVVSPELASGKAWIDYSTVNLPKENHFLSVDELLEQEKTKKGFITPAMGIVVEEKSPDVKPALDFITQPANESVQKKVQESLDRLSSYKPQEVVESIDPAINVDEPETLEKVSKFVRTYEFNGRLGTISSVPHTKAEMTLAKANDEMPEDFPIRAWQDSRYYFYGKGAAGHHCAISHVYSEPTRTKSE

SEQ ID NO: 10713 - protein, 236 aa, Spartina pectinata
DRHGMDVSEWDPRRDKYIAVKYDVETAIQAKALNKEALQASVGLPVDRNIPVIAFVGRLEEQKGPDVMAAAIPHILAKKNVQIVLLGTGKKKFERLFKGAEEKYPDNVRAVVKFNAPLAHHIMAGSDLLAVTSRFEPCGLIQLQGMRYGTPCACASTGGLVDTVVEGMTGFQMGRLSVDCDVVEPADVQKVATTLKRAIKVVGTPAYNEMVRNCMTQDLSWKGPAKNWEKVLLSMG

SEQ ID NO: 10714 - protein, 730 aa, Streptococcus pneumoniae
MFASKSERKVHYSIRKFSIGVASVAVASLVMGSVVHATEKEVTTQVATSSNRANESQAGHRKAAEQFDEYIKTMIQLDRRKHTQNFALNIKLSRIKTEYLRKLNVLEEKSKAELPSETKKEIDAAFEQFKKDTNRTKKTVAEAEKKVEEAKKKAKAQKEEDHRNYPTNTYKTLELEIAESDVEVKKAELELVKEEAKESRDDEKIKQAEAKVESKKAEATRLENIKTDREKAEEEAKRRAEAKLKESVEKNVATSEQDKPKGRRKRGVPGEQATPDKKENDAKSSDSSVGEEALPSPSLKPEKKVAEAEKKVAEAEKKAKAQKEEDRRNYPTNTYKTLELEIAESDVKVKEAELELVKEEAKESRNEEKVNQAKAKVESKKAEATRLEKIKTDRKKAEEEAKRKAAEEDKVKEKPAEQPQPAPAPQPEKPTEEPENPAPAPKPEKPAEQPKAEKPDDQQAEEDYARRSEEEYNRLTQQQPQKPEQPAPAPKIGWKQENGMWYFYNTDGSMATGWLQNNGSWYYLNSNGAMATGWLQNNGSWYYLNANGSMATGWLQNNGSWYYLNANGSMATGWLQNNGSWYYLNANGDMATGWLQYNGSWYYLNANGDMATGWLQNNGSWYYLNANGSMATGWLQYNGSWYYLNANGAMATGWLQYNGSWYYLNANGDMATDWVKDGDTWYYLEASGAMKASQWFKVSDKWYYVNGSGALAVNTTVDSYRVNANGEWVN

SEQ ID NO: 10715 - protein, 237 aa, Eragrostis advena
GIVNGMDVSEWDPSKDKYIAVKYDAETAAQAKALNKEALQAAVGLPVDRKIPLIAFVGRLEEQKGPDVMAAAIPQIMAEKNVQIVVLGTGKKKFERLFKGAEEKYPDNVRAVVKFNAPLAHHIMAGADLLAVTSRFEPCGLIQLQGMRYGTPCACASTGGLVDTVVEGKTGFQMGRLSVDCNVVEPADVQKVATTLKRAIKVVGMPAYYEMVRNCMAQDLSWKGPAKNWENVLLSMG

SEQ ID NO: 10716 - protein, 73 aa, Unknown
  Musa x paradisiaca
YESPRPTLGIHRFVFVLFLQLGRQTVYTPGWRQNFNTRDFAELYNLGSPVAAVYFNCQRESGCEGRIRLNLQD

SEQ ID NO: 10717 - protein, 236 aa, Pappophorum bicolor
RDRHGMDVSEWDPSKDKYIAVKYDVETAIEAKALNKEALQAAVGLPVDRKVPLIAFVGRLEEQKGPDVMAAAIPEIMEENAQIVLLGTGKMKFERLFKGAEEKYPDNVRAVVKFNAPLAHHIMAGADLLAVTSRFEPCGLIQLQGMRYGTPCACASTGGLVDTVVEGKTGFQMGRLSVDCNVVEPGDVQKVATTLKRAIRVVGTPAYNEMVRNCMAQDLSWKGPAKNWENVLLSMG

SEQ ID NO: 10718 - protein, 466 aa, Arabidopsis thaliana
  misc_feature (266)..(266): Xaa can be any naturally occurring amino acid
  misc_feature (276)..(276): Xaa can be any naturally occurring amino acid
MYSSEFEVKFRRGREMEVFRLGELRHLLVTVFLSGLAEYLIRPVMTDVTVAAVCSGLDDSCSLAVYLTGVQQVTVGMGTMVMMPVIGNLSDRYGIKAMLTLPMCLSVLPPAILGYRRDTNFFYAFYVIKTLFDMVCQGTIDCLANAYVAKNVHGTKRISMFGILAGVSSISGVCASLSARFLSIASTFQVAAISLFIGLVYMRVFLKERLQDADDDDEADSGGCRSHQEVHNGGDLKMLTEPILRDAPTKTHVFNSKYSSWKDMYXSESSFWVQQXNDFAELFLLVTIIGSISQLFILPTLSSTIGERKVLSTGLLMEFFNATCLSVAWSPWVPYAMTMLVPGAMFVMPSVCGIASRQVGSSEQFSDEWLEESSSLKNVRNLTFEGKVQGCISGVRAFAQVVAPFVYSPLTALFLSENAPFYFPGFSILCIAISLMIGFLQSLLIKDHPSLPLVNITINNPSKAEA

SEQ ID NO: 10719 - protein, 72 aa, Unknown
  Musa x paradisiaca
SARTGRELVCYESPRPTIGIHRMVFVLLRQMGRGTVFAPQMRHNFSTRRFVLQYYLAPVAATYFNCQRESGC

SEQ ID NO: 10720 - protein, 420 aa, Deinococcus radiodurans
  misc_feature (122)..(122): Xaa can be any naturally occurring amino acid
MEQDTAWRQEANQTFHTRATFLECARVNLGSGGRADLSRRKRRPMDYYELLGVSRTASADEIKSAYRKLALKLHPDRNKEEGAAEKFAQVSEAYSVLSDTEKRAHYDRFGSAPGAGMPGGDXFGGMGGMGGVGFDPMDIFEQLFGGAAGMGGRGRRGPARGDDLETEVRITLEQARAGEEVEVTVDRLTECEHCHGTRTEPGGKPPVTCSTCNGSGAVRGQARTIFGVVETQQVCPTCKGDGKMVVDPCTVCHGRGRTLKSEPVKVKLPKGIDEGYRIRVAGQGNEGPGGNGDLYVHIEMEPHPELHRQDENLIFPARIGFATAALGGRIQVPTLDGPQEVEVKPGTQHGELHRLRGQGMPRLQGAGTGDLIVDYEIVVPKHLNAEAKDALQAYARAVGDEVPEEHEGLFGKIGKLFGRD

SEQ ID NO: 10721 - protein, 317 aa, Unknown
  Bradyrhizobium sp. BTAi1
MTAGDEKVLVATAPPSRPPVATRRLLVIINRGSRSGGTAAGVAVSRLSGAGYDLVISAPHSPREVAPWIEAHADGAHAVVIAGGDGSLNAAAPALVKTGLPLGIIPAGTANDLARTLGLPEDMEAAADVIAAGHRRNIDLGDVNGHPFFNVASLGLSADLARQLTKETKRRFGRLGYAITALKVLTNARPFRAMIVSSDGAVRVKTLQIAVGNGRYYGGGMAVEHSAEIDDSHLDLYSLEIGRVWKLLAMAYDFRKGRHGLWQEVRASRDTAFEIRTRRPRPINADGELVTFTPARFNVLPRAVTVFVPETPSQDRN

SEQ ID NO: 10722 - protein, 411 aa, Triticum aestivum
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAVVTGKPIDLGGSLGRDAATGRGVMYATEALLAEYGKSISGSTFVIQGFGNVGSWAAQLIHEKGGKVIALGDVSGTIRNKAGIDVPALMKHRNEGGQLKDFHGAEVMDASELLVHECDVLLPCALGGVLNRENAPEIKAKFIIEAANHPTDPEADEILTKKGVVVLPDIYANAGGVIVSYFEWVQNIQGFMWEEEKVNMELHKYMNSAFQNIKAMCKSQDCNLRMGAFTLGVNRVARATILRGWEA

SEQ ID NO: 10723 - protein, 236 aa, Pappophorum bicolor
  misc_feature (234)..(235): Xaa can be any naturally occurring amino acid
GIVNGMDVSEWDPSNDKYIAVKYDVETAIEAKALNKEALQAAVGLPVDRKVPLVAFVGRLEEQKGPDVMAAAIPEIMEENAQIVLLGTGKKKFERLFKGAEEKYPDNVRAVVKFNAPLAHHIMAGADLLAVTSRFEPCGLIQLQGMRYGTPCACASTGGLVDTVVEGKTGFQMGRLSVDCNVVEPGDVQKVATTLKRAIRVVGTPAYNEMVRNCMAQDLSWKGPAKNWENVLLXXG

SEQ ID NO: 10724 - protein, 398 aa, Arabidopsis thaliana
  misc_feature (225)..(225): Xaa can be any naturally occurring amino acid
  misc_feature (248)..(248): Xaa can be any naturally occurring amino acid
SADAPPSLKKSVSTPFMNTTAKMYSMSEVKKHNSADSCWIIVHGHIYDCTRFLMDHPGGSDSILINAGTDCTEEFEAIHSDKAKKMLEDYRIGELITTGYSSDSSSPNNSVHGSSAVFSLLAPIGEATPVRNLALVNPRAKVPVQLVEKTSISHDVRKFRFALPVEDMVLGLPVGKHIFLCATINDKLCLRAYTPSSTVDVVGYFELVVKIYFGGVHPRFPNGGXLMSQYLDSLPIGSTLEIKGPLGXHVEYLGKGSFTVHGKPKFADKLAMLAGGTGITPVYQIIQAILKDPEDETEMYVIYANRTEEDILLREELDGWAEQYPDRLKVWYVVESAKEGWAYSTGFISEAIMREHIPDGLDGSALAMACGPPPMIQFAVQPNLEKMQYNIKEDFLIF

SEQ ID NO: 10725 - protein, 238 aa, Enneapogon scoparius
  misc_feature (30)..(30): Xaa can be any naturally occurring amino acid
RDRHGMDISEWDPSKDKYIAVKYDAETAVXAKALNKEALQAAVGLPVDRDIPLVAFVGRLEEQKGPDVMAAAIPEILEEEEDVQNVLLGTGKKKFERLFKSIEEEYPDKVCAVVRFNAPLAHHIMAGADLLAVTSRFEPCGLTQLQGMRYGTPCACASTGGLVDTVVEGKTGFLMGRLSVDCNVVEPADVKKVATTLKRAVKVVGTPAYKEMVRNCMAQDLSWKGPAKNWENVLLSMG

SEQ ID NO: 10726 - protein, 283 aa, Clostridium perfringens
MELWYTEEHTDKVRFSIKVDEQLYSGKSDFQRIDVFKSQEFGTFFTLDGLMMVTEKDEFIYHDMIVHVPMATNPNIKNVLVIGAGDGGTVRELTRYETIEKIDMVEIDKLVVDVCREYLPQTANKLDDPRVSLFFEDGLKFVRSVENKYDLIIVDSTDPFGPGEGLFTREFYGNCFKALKEDGILVNQHESPYYEEYARGMKRAHKRIKECFPVCRVYQAHIPTYPSGHWLFGFASKKYDPLNADIEKWNDLGLKTKYYNTELHKGCFALPNYVKEMLENVDE

SEQ ID NO: 10727 - protein, 611 aa, Oryza sativa
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKAISDLSISEPKRESMSQCENIIGDGNDTCGLSCMNAFLCTYHCEANASLSVKKKPELALTRLEEDDTTYRQICAGAAAVRAMEEGRGGDPPSSSSSAAAAAGVAIGYPFLEPQQGARLRRRRTISPFKKYFSRGFAIGMEIAFIVFGTIVHFPVWARIFLIISLSILPFSAFSITFQEY

SEQ ID NO: 10728 - protein, 272 aa, Unknown
  delta proteobacterium MLMS-1
MPAPMDFAQLHTVSVEDGRPTLLYRRGEHAVYWLGIEEETAFRCNTYLITDGDQALLVDPGNRRFFSTVYDRVAQIIDPATLDGLIICHQDPDVAASFNDWLAVAPRARVYTSPRTQVLLPHYGRDDYDYRDVTATPRLELPSGSALRFIEAPFLHFPGAFVTYDEASGALFSGDIWAALDIDWQLVVDDFAQHCQYMDLFHLDYMASNVAARGFVRRLAGLEIDAILPQHGSLIPPRHVAAALDYLRELRCGTDIYYPDLHTNSRGTALHE

SEQ ID NO: 10729 - protein, 313 aa, Amelanchier bartramiana
GGLGDVLGGLPPAMAANGHRVMTVSPRYDQYKDAWDTSVLVEIEVGGRVETVRFFHCYKRGVDRVFVDHPLFLEKVWGKTESKIYGPRTGVDYMDNQFRFSLMCQAALEAPRVLNLNSNEYFSGPYGDDVVFIANDWHTALLPCYLKTIYKPKGIYKNAKVVYCIHNIAYQGRFPFSDFSLLDLPENLKGSFDFFDGHDKPVKGRKINWMKGGILESDRVVTVSPYYAQELVSGEDKGVELDNIIRKTGITGIVNGMDVQEWNPATDKYLDIKYDNTTVLDAKPLLKEALQAEVGLPVDRNIPVFGFIGRLEE

SEQ ID NO: 10730 - protein, 313 aa, Crataegus nigra
GGLGDVLGGLPPAMVANGHRVMTVSPRYDQYKDAWDTSVLVEIEVGGRVETVRIFHCCKRGVDRVFVDHPLFLEKVWGKTGSKIYGPRTGEDYMDNQFRFSLLCQAALEAPRVLNLNSNKYFSGPYGDDVVFIANDWHTALLPCYLKTIYKPKGIYKNAKVVFCIHNIAYQGRFPFSDFSLLDLPDNLKGSFDFIDGHEKPVKGRKINWMKAGIIESDRVVTVSPYYAQELVSGEDKGVELDNIIRKTGITGILNGMDVQEWNPATDKYLDIKYDNTTVLDAKPLLKEALQAEVGLPVDRNIPVFGFIGRLEE

SEQ ID NO: 10731 - protein, 482 aa, Mycobacterium leprae
MSIPAVPSPQIAVNDVGSSEDFLAAIDKTIKYFNDGDIVEGTIVKVDRDEVLLDIGYKTEGVIPARELSIKHDVDPNEVVSVGDEVEALVLTKEDKEGRLILSKKRAQYERAWGTIEALKEKDEAVKGIVIEVVKGGLILDIGLRGFLPASLVEMRRVRDLQPYIGKEIEAKIIELDKNRNNVVLSRRAWLEQTQSEVRSEFLNQLQKGAIRKGVVSSIVNFGCVCRSGGVDGLVHVSELSWKHIDHPSEVVQVGNEVTVEVLDVDMDRERVSLSLKATQEDPWRHFARTHAIGQIVPGKVTKLVPFGAFVRVEEGIEGLVHISELAERHVEVPDQVVAVGDDAMVKVIDIDLERRRISLSLKADQRGLHRGVRPGKVRYGPTATTSRATTSSLEGFDPDSNEWLEGFDTQRAEWEARYAEAERRYKMHTIQMEKFAATEEAGHGSSEQPPASSTPSAKATGGSLASDAQLAALREKLAGSA

SEQ ID NO: 10732 - protein, 313 aa, Crataegus rivularis
GGLGDVLGGLPPAMVANGHRVMTVSPRYDQYKDAWDTSVLVEIEVGARVETVRIFHCCKRGVDRVFVDHPLFLEKVWGKTGSKIYGPRTGEDYMDNQFRFSLLCQAALEAPRVLNLNSNKYFSGPYGDDVVFIANDWHTALLPCYFKTMYKPKGIYKNAKVVFCIHNIAYQGRFPFSDFSLLDLPDNLKGSFDFFDGHDKPVKGGKINWMKAGIIESDRVVTVSPYYAQELVSGEDKGVELDNIIRKTGITGILNGMDVQEWNPATDKYLDVKYDNTTVLDAKPLLKEALQAEVGLPVDRNIPVFGFIGRLEE

SEQ ID NO: 10733 - protein, 1102 aa, Desulfotalea psychrophila
MKEFRNGWNRASVWLTIILGLLLSGIMAYINYQQVSENTIAQFQREADRQAAAIRRDIEVDLSILTPAVAFFDASHLVERYEFRLWFQSVKVVDNSLDVLGWIPRVANSQRAKFVDEARAVGLSGFRFSELQNGKLVRAGVREKYFPVFYIEPTGVNGAAFGFDLSSEPKRRTMLMQARDSGKVTASQVIHLVQHKKKRFSFLVVAPVYQGLASTIAERRETLRGFVVAAFAVDTIGERALAQIDPGQFHIMMHIHDGAELIYPAGGKCPGEQYFKEGIRTSGLHVIREIAVAGRQWRVCLSPSEAGQIQGFPPSAMAVFIVGIVLTVLLALQFRNNALRTSEIEWQVAEKTAQLRKSELRAEAIIDKAVIPIITIDETGIVQSFNRSAEKMFGYGPEEIIGRNVRMLMPEPHRSSHNKYVDHYLKTGRMKAIGVGNKLTGVRKDGVEFPMHLSVSEVRLEKRIFVGMVVDLSEINRAEEALRKHRDNLARLVEERTYELKIAKEAAETANIAKSAFLANMSHEIRTPMNSVLGFIQITLESRLLCAELRRHLETAYSSAKGLLIIINDILDVSKLESGEFALEATCLDMPRIVQEALKTVESQAEEKGIGLDFHFDADLPHCYLGDPTRLGQVIINLVGNAIKFTKTGKITIGVRASDQGDASLHFSVADRGIGMTAEQAANIFNPFTQADISTARCYGGTGLGLTISKQLVELMGGRIWVESELGRGVTFHFTAQLPVISPCRATGVDHALTGEASSPESPRRFQILLAEDVPGNATLAQLRLEQQGHRVRHVWNGSQAVEMYKGGTFDLILMDVMMPEMDGIEATRKIRALERESKGHITIIALTASIMKEDRQRYMRAGMDAVVGKPIILEGLFATMERVVPKGIGSLNEETFPGDQARQDIDLTPLADVVDIDRGLASWRDPLVFAKSLASFADRHSADAEKIQQLLDENSKEARMISHTLKGLAGNLSLPEVARLATEINAALKAGSHEPAATLLPSLQAALKNAAVVIRKLKMPVARIATPEFDSKAVSSLLQELLIMLDQDDPVVAEPGLSKLGEYLTQDDMINIRRAIDAFDFARAKSQTRILAERLGIQLEG

SEQ ID NO: 10734 - protein, 545 aa, Ustilago maydis
MTPAIDLEAAANRLDSYTPAAFHMQQHHHLHKDTADLLMEAKEAQRIKTLEIMDARAELLRSKLNDDASSITTAVDSNSGSPEKVIDDFHDPCGPFEGPEKLLELWFAEEPADVSACRWSDPDARPNHFGLRSVPRAIWETMLDIVKCKVLSVIQGSHVDAYLLSESSMFVFPHKLILKTCGTTTLLLGLEKLLTIAAKALAGLNTASSFAKLSSPDIDDQDHDDEASTAMSDSSFVQERQLGAIVKHAFYSRKSFMFPERQKGPHRDWMLEVAVLDRFFDHGSAYTVGKMNGDHWLLWMGCEGAREAEPFSIAAADTIERPLTLPAPCVEDQTLEILMTHLSPASCARFVFDEQLPHPTVAECYPRNHLSATEASAPASSLDKGHALGLALSNKLGLTELFPETELDAFAFEPCGYSANAVMPRGGKNDNAGYWTIHVTPEQDSSYASFETNVALCSNSPSSTIRDEQTTLELPTNLPTLVRRVVDIFEPGKMSVTLFVSTSEHAEEVEGDKAVLTNEDILHALTIKGSHTNSRGTISSLCLLK

SEQ ID NO: 10735 - protein, 338 aa, Ralstonia solanacearum
MNLNKHPRHPLTFGPTPIQPLKRLSAHLGGKVELYAKREDCNSGLAFGGNKTRKLEYLVPEVLAGGYDTLVSIGGIQSNQTRQVAAVAAHLGLKCVLVQENWVNYADAVYDRVGNIELSRILGADVRLDAAGFDIGIRPSWEQAMEDVRRAGGKPFPIPAGCSEHPLGGLGFVGFAEEVRQQEAEFGFRFDYIVVCSVTGSTQAGMVVGFAADGRADRVIGIDASAKPEQTREQILRIARDTAKLVELGRDITEDDVVLDTRYGGPEYGLPNEGTLEAIRLCARQEGMLTDPVYEGKSMHGMIDRVRGGEFPEGSRVLYAHLGGVPALNAYSFLFRNG

SEQ ID NO: 10736 - protein, 235 aa, Zea mays
MTVLDAESRFHVLAVDDSIIDRKLIEMLLKSSSYQVTTVESGNKALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPKQKNKPQAQAVESPEQQLDPHPQPVHELELEEAAADRNGVNKRKAAAMEEGLTVVVTAPESTKPRRLSTSSLTVET

SEQ ID NO: 10737 - protein, 316 aa, Haemophilus influenzae
MAIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 10738 - protein, 441 aa, Thermotoga maritima
MIGYQIYVRSFRDGNLDGVGDFRGLKNAVSYLKELGIDFVWLMPVFSSISFHGYDVVDFYSFKAEYGSEREFKEMIEAFHDSGIKVVLDLPIHHTGFLHTWFQKALKGDPHYRDYYVWANKETDLDERREWDGEKIWHPLEDGRFYRGLFGPFSPDLNYDNPQVFDEMKRLVLHLLDMGVDGFRFDAAKHMRDTIEQNVRFWKYFLSDLKGIFLAEIWAEARMVDEHGRIFGYMLNFDTSHCIKEAVWKENTRVLIESIERAVIAKDYLPVNFTSNHDMSRLASFEGGFSKEKIKLSISILFTLPGVPLVFYGDELGMKGVYQKPNTEVVLDPFPWNESMCVEGQTFWKWPAYNGPFSGISVEYQKRDPDSILSHTLGWTRFRKENQWIDRAKLEFLCKEDKFLVYRLYDDQHSLKVFHNLSGEEVVFEGVKMKPYKTEVV

SEQ ID NO: 10739 - protein, 199 aa, Haemophilus parasuis
EAGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGSNALDFGIPLTLITESVFARCVS

SEQ ID NO: 10740 - protein, 456 aa, Streptococcus thermophilus
MKGNIDMTTGKEYVASVFEKVKAQNSHEAEFLQAVEEVFNSLVPVFDKYPKYIEENLLERLVEPERIVSFRVPWVDDKGQVQVNRGFRVQFSSAIGPYKGGLRFHPSVNQSIIKFLGFEQIFKNSLTGQPIGGGKGGSNFDPKGKSDNEIMRFCQSFMTELSKHIGADTDVPAGDIGVGGREIGYLYGQYKRIRNEYTGVLTGKGLNWGGSLARTEATGYGAVYFAEQMLNARGENFNGKTAVVSGAGNVAIYAIEKLQSLGAKAVTCSDSSGFVYDPDGIDVDLLKEIKEVKRERIVKYAEARPNATFTPAGGEKTVWSIKADLAFPCATQNELDETDAETLVANGVLAVSEGANMPSTLGAIDVFLKAGVSFGPAKAANAGGVAVSALEMAQNSGRTSWTFDEVDAKLYDIMKGIYENAAAAAKEFGQEGNLVVGANIAGFLKVADAMSAQGIV

SEQ ID NO: 10741 - protein, 78 aa, Zea mays
  misc_feature (30)..(30): Xaa can be any naturally occurring amino acid
  misc_feature (50)..(50): Xaa can be any naturally occurring amino acid
YAPTMSWPVSGTRMIHPAESEIKSEPFRLXLGLLSVRLVIAEIESVQNSXVLHNVMKGAPLPPPLLMGGPWTHPYFRE

SEQ ID NO: 10742 - protein, 267 aa, Sulfolobus solfataricus
MEVKIKQVDEVKISRYIIKETMEDWYQFVESDVVIVGAGPSGLSAAYYLAKAGLKTLVFERRLSFGGGIGGGAMLFHKLIIEKPADEILREVNIRLKEVEEGVYVVDSAEFMAKLATAAIDAGAKIIHGVTVDDVIFRENPLRVAGVAVEWTATQMASLHVDPIFISAKAVVDATGHDAEVISVAARKIPELGIVIPGEKSAYSERAEELTVINTGKVAEGLYATGMAVTEVKGLPRMGPIFGAMVLSGKAVAGEITKDLLKSEIRA

SEQ ID NO: 10743 - protein, 1342 aa, Burkholderia thailandensis
MPHALALDAGAPAPLGSRWDGGGVNFAVYSRHAARVELCLFDASGRQERARLTLPARTGDVWHGYLPGAAPGTVYGYRVHGCYAPHRGERFNPHKLLLDPCACALTGDFVWHDAVYGYRRDRGADDPHARDPRDSAPYVPKSRVVAPAVRGARPPKPGTPWRDTVIYELHVRGFTRRHPDVPAPLRGTVAGLGTRAAIAHLRELGVSAIELLPTAAFIDEAELARRGRRNYWGYNPLAPCAPHPRYLAHDGDDEFACTVDRLHEAGIEVIVDVVLNHTAERDARGPTLCLRGLDNASYYRLDPERPARYVDYTGCGNTLDLSRPAAIALALATLRHWACDIGVDGFRFDLATTMLRDADGRVGNEAPLVAAILADAELASLKLIAEPWDATLSGYRLGGFAPPFAEWNDRYRDGMRRFWRGDRGAAGECATRFAGSSDVFARAGRAPSASVNFVTAHDGFTLADLTSYAAPRGGGPGASSGRRDEITVCGADESAADDASVRLRRRRLRASMLGALAMSHGTPMIVAGDEFSRTLHGDNNAYCVDSPASWIDWSARGDPDRDLRTFVTRALSVRRALDMLRQTRFFDGRPIAAQGADKDIAWLLPEGRELTEDDWRANETRGFAALLADPRRGGDASPSRIYVAMNARDTRCAFRLPESAGERTPDWLVALDSDATECAAAGALYPGGSWITVEGGGFVALVPADTAGVGVAGPLAARARRAGIAIDYVGADGLRRQVPAEALERLVAALGERADAAEGPDGTTRAGADAARPSSARRPATQAPARCWLPLALRQRPGCWALSVQTYGLRSARSWGIGDFDDLAHMIDVAARLGAAGVQSSPVHALSLSQPQRASPYAPCDRLMLNPLLISAPLAAGDAPPPDYLRFVEQPRVRAELSRIERAATIDYPAVASLKRQALALLHAAFVRDGPDAERTAYRAFCHGEGVALREYATFEALGEWQAAQQGRYVGWMQWPSAYRDPRSTPVADFADAHRERIDFFMYLQWQARRQWHRAAARGRDARMALGLVADLALGAGADSVEAWRWPGLAALDAELGAPPDAFAARGQRWGLAPWRVQRLADADFAPFAAVLDAAMRDAGALRIDHAAGLMRQFWVPRGGDAARGAYVSYPFDALLARITRASAAHRCAVIGEDLGNVPPGLRERLAQAHILGCRVVYFERTPDHAFVAGDRYPPLTAAMASTHDLPTIAGFYSGADNDELDARGLRASPSLAALAREERRVALATLRARLAPYGDTTNAAAFARALHRFLADCASRLVIVQLDDALGVERQANLPPLGDAPPNWRQRIPVAIDALANHGGLRDLAWIFEKRAPSNGSSRTE

SEQ ID NO: 10744 - protein, 352 aa, Candida albicans
MATSQELTADIQALATSFPKRLANDSDNSLLINVAPTGRQAKRHIQQINYSEEFGDDLDFDEFPSSTPGTRSLNENKAQIEAQRYSLAKNTPTPKRILEKPVLSELVEKPVVLIPIKIMIENLNTNQKLIDSFMWNLNESLITPTEFAEVVCSDLDLPFSMAAQIADSINQQIEEYSYASNLQLPNKGPYNVTIDLSVNLNKQLYQDRFEWDMNQNEVTPEIFAEIVVADLGLSLEFKNAISHALHEIIIRVKKEVIDGTFNNEMHNLHLVKGIMFEQGIRIFTENSVQNGNDRWEPLVEVLTSSEIERRENERVRNLRRLKRENMRRDYDDHSRRRQAGKRRYDELEGAWV

SEQ ID NO: 10745 - protein, 1431 aa, Arabidopsis thaliana
MAQILAASPTCQMRVPKHSSVIASSSKLWSSVVLKQKKQSNNKVRGFRVLALQSDNSTVNRVETLLNLDTKPYSDRIIAEYIWIGGSGIDLRSKSRTIEKPVEDPSELPKWNYDGSSTGQAPGEDSEVILYPQAIFRDPFRGGNNILVICDTWTPAGEPIPTNKRAKAAEIFSNKKVSGEVPWFGIEQEYTLLQQNVKWPLGWPVGAFPGPQGPYYCGVGADKIWGRDISDAHYKACLYAGINISGTNGEVMPGQWEFQVGPSVGIDAGDHVWCARYLLERITEQAGVVLTLDPKPIEGDWNGAGCHTNYSTKSMREEGGFEVIKKAILNLSLRHKEHISAYGEGNERRLTGKHETASIDQFSWGVANRGCSIRVGRDTEAKGKGYLEDRRPASNMDPYIVTSLLAETTLLWEPTLEAEALAAQKLSLNNCMDNVHPFILVLLTVRACPMVEFKLRKHLSQHRQEKKREREGETKTETKEDRSGQNKLSDSSWSFWRRFSVRPELFRNHRRWFLIQKVLGKLSEPSKPSEKTKEADASTVNGASTGFSWDINRCSAGAAATSVWWDINRCPLPNDVDVRRVSPFIKRALEKLGYTGALTTTAIGILTDVPHDFLTQVYSSGIAIHHIPLDIFELSSAVIYWTWDNLPPSNIMLISNELIFSSLLDKLCGFGYNVALEEDKCSETCETAFPCAQFIVVVQGFENFSTHLKSEEHRKNKFSRKWTKKDLLSPFVKVRTGFHGSPSVAPTEDLTVEELPPRLFALDRYPSETKMNAYSKPEYISYIANVLKGKPEMQFLLDSPFGELFKIPKNKASFNAKLVLGLICRQLVTKKVNEMWIVFGGHPIKFGLREFSILTGLECGKYPKKKDVEDVISVKPECESVWKTLFDERFGDTVPTIADLVSWLQEEESMEGWKQLALSLIILVDGVVAAHSNPNRATSKTVEKTKNLEFFCKYPWGRVSFTRTLGRIAKFQTPYDAQQLIRGLLIGFYLFETIPSIAKLGPDDVPNMTFAERSIHRLASLRAIRTSRILECEAADEVEVNYIVKPADNVCPPSLSWDDEVDDPRVDYIEALLIDGHQWQEDEWVGGYARVPKQRKRNAPGPSPKEPAMKKQKSQMDCDNEENAEDCFGEPVPERIIVEMRRSFKELEDQMYQMQEDMKDFVREQIRVALDPKGKRPEQTILSHDSREPPTSMDKAPVTAKKPSRRMSTKGSTGTRKSSRLTRVSHDVDTFALSVGCNSKEEDLDVPGVHTTAVGGRRKPSKPKKNVSFAVDTTELSDSNKEDMQGFIDEQYGANNESDFTTNDGLDSSAAEEEILDTGFLIVPYAGSTQSHLERRPVEEATVDTEMEEVPSNVSARVSEVDLVDNGPKDVVEPGLVGTHTGADEIADADTEMVDNPSGLPSTSAQEETRDVSVATEANGSESEETYEQCF

SEQ ID NO: 10746 - protein, 739 aa, Oryza sativa
  misc_feature (700)..(700): Xaa can be any naturally occurring amino acid
VEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKGMGYEKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRXTPSTCSLISSTPISTPCSATPPSSLNCSLMIERTKYSIV

SEQ ID NO: 10747 - protein, 123 aa, Astragalus membranaceus
RLVEADATKGSDHLRDVFGKGMGLSDQDIVALSGGHTIGAAHKERSGFGGPWTSNPLIFDNSYFKELLSGEKEGLLQLPSDKALLTDPVFRPLVEKYAADEDAFFADYAVAHQKLSELGFAEA

SEQ ID NO: 10748 - protein, 303 aa, Streptococcus pyogenes
MKTVRIFYNPNSGKKEDQLAGQVKDYFCQHGFSEDSVEIITPKDADQAFQLAKQAAKDKIDLVIPLGGDGTLNKIIGGIYEGGAHCLIGLVPSGTVNNFAKAMHIPLQITEALDTILTGQIKQVDICKANQQYMISSLTLGLLADIAADVTAEEKRRFGPLAFLKDSIRILKRNRSYAISLISHNHRIHLKTKFLLITMTNTIAGFPSFSPGAQADDGYFQVYTMKKVSFFKFLWHINDFRQGDFSKAEEISHFQANTLSLLPQAKKQAILPRARIDGDKSDYLPIQLDIIPKAISIIVPTED

SEQ ID NO: 10749 - protein, 745 aa, Bradyrhizobium japonicum
MTNLRFVLLATTALTAMQLANTASHAQGASPLVVAQAQPQETGPDGKPKQPPKGPPGAAPPAAPARPAAPPPAAAPPHPPAAPPPAAAPPRPAAPPPPPPPPAARPAPPPPPPPPAAPKQPSPPPAAAPQQHAPTPPPPAPPAARPAPTPPAPPPAAAPQHAPPPPPPPAARPTPTPPPPPPAGPAARPTPAPTATPTPVAPPPAAPTARPGSPAPAATPAPTPTPAPTATPAPTATPAPGSTPGAPPAGRPGAPPPGVRPGSPPAAGSPPAPGATPAPTTTPAPGGTATPPSGRPGPASTPAPGAATPAPTATPAPGGALTPPPGRPGAGPTPGPQGGTPPAGAPAAGTPAAPPQAGGLPARPAAPAGAAAPSTVPGSAAATPPPNRAQFAPPTVTPAFQAAPTVVAPLPPPPRPPQRDLTPLAIGAGVVAGAVIGATIADLHNQRRESIEGGRTVYTEPDRIIIRDPGGQAYVRGNDLYRFRYGARDIRTDTVGGDTRTVVIRPDGSEIITVVAPDGRLLRRIRRDPGGRELIIIDNSYRDPQSVGGFYVDAPPPVVNIPYDRYIVDAEEASPDVIYQTMEAPPVQRINRRYTLDEIRYSPNIRMQMPSIDVNTITFETGSWTIPPDQAAKLQVIADGLNRAIQANPRVVFLIEGHTDAVGNEVDNLSLSDRRAQSAAELLTQQFGVPAENLTSQGYGEQYLKEQTQGPSAINRRVTVRNITPLLNGGQASLPPPPPGTAPPR

SEQ ID NO: 10750 - protein, 433 aa, Nitrosomonas europaea
MKVQPAVQTNDNPRFVSTLTRNTLALILAGGRGTRLKNLTDWRAKPAVPFGGKFRIIDFTLSNCVNSGVRRIGVVTQYKAQSLIRHIQRGWSFLDGRFQEFIELLPAQQRTEEGTWYQGTADAVFQNLDILRTHNPGYVLILGGDHIYKMDYGRILAEHVERQADLTIACLEVPVEDASAFGVMAVDDSWRTTSFAEKPEHPAPIPGKPGHALISMGIYVFNAKFLYEQLIQDHDMDQSSHDFGKDVIPRLVASNARVYAHRFQNSCVNMASGVPYWRDVGTVDAYWKANIDLTTITPDLNLYDEDWPIWTHQEQLPPAKFVFDDDDRRGQALDSMVSGGCIISGATVRRSLLFSNVQIRGYSTIEDSVILPNVSIDRHAYLKRVVVEKECQIPEGLKVGFNPDEDRKHFYVTDDGITLITPEMLGQGIHYIR

SEQ ID NO: 10751 - protein, 237 aa, Schmidtia pappophoroides
RDRHGMDVSEWDPSKDKYIALKYDAETAVEAKALNKEALQAAVGLPVDREIPLIAFVGRLEEQKGPDVMAAAIPEILKEEDVQTVLLGTGKKKFERLFKSIEEEYPDKVCAVVKFNAPLAHHIMAGADLLAVTSRFEPCGLIQLQGMRYGTPCACASTGGLVDTVVEGKTGFQMGRLSVDCNVVEPADVKKVATTLKRAVKVVGTPAYKEMVRNCMAQDLSWKGPAKNWENVLLSMG

SEQ ID NO: 10752 - protein, 295 aa, Nicotiana tabacum
AASDSAQLKSAREDIKELLKTKFCHPIMVRLGWHDAGTYNKNIEEWPQRGGANGSLRFDVELKHGANAGLVNALNLLKPIKDKYSGVTYADLFQLASATAIEEAGGPKIPMKYGRVDVTEPEQCPEEGRLPDAGPPSPAQHLRDVFYRMGLNDKEIVALSGAHTLGRSRPDRSGWGKPETKYTKDGPGAPGGQSWTAQWLKFDNSYFKDIKERRDEDLLVLPTDAALFEDPSFKVYAEKYAADPEAFFKDYAEAHAKLSNLGAKFGPAEGFSLEGSPAGAAPEKFVAAKYSTGKD

SEQ ID NO: 10753 - protein, 168 aa, Plantago major
MATSTQPQSIHDFTVKDAKGDDVDLSIYKGKVLLIVNVASQCGLTNSNYTELTTLYQKYKDQGLEILAFPCNQFGSQEPGSNEEIQNFVCTRFKAEYPIFDKVDVNGATAAPIYKFLKSAKGGLFGDGIKWNFSKFLVDKEGKVVDRYAPTTSPLSIEKDVKKLLEKA

SEQ ID NO: 10754 - protein, 176 aa, Chlorobium tepidum
MIENVPFTELISAERIAARVAELGAEISRDLAGIDELTVVCVLKGGFIFTADLVRHITIPCRIEFIRASSYGTHRASTGKVMLDHHHDPHVEGKNVLLVEDILDTGLTITRVLEELRGHNPASLHVCTLLDKPSARTTPVKADFTGFTIPDVYVVGYGLDAAGKHRELPYVASLNA

SEQ ID NO: 10755 - protein, 228 aa, Magnetospirillum magnetotacticum
MARRRGGPRPARLRRAALVPASAEEAGRRLPEAAMTAQEGAGLRTATFAGGCFWGVQGVFQHVKGVTKAVSGYAGGDRASARYEQVGTGRTGHAEAVQVTYDPAVIRYDELLQIFFSVALDPTEVDRQGPDTGPQYRSALFPADEGQATVARAYIAQLDRAKAFDKPIATRIESGAFYPAEGYHQDYMTLHPNNGYIVANDTPKLRDLKALFPERANAQPVLVGRPPA

SEQ ID NO: 10756 - protein, 423 aa, Thiomicrospira crunogena
MFDKNMTIAGYDDALADAMNAEAQRQEDHIELIASENYTSPRVMEAQGSVLTNKYAEGYPNKRYYGGCEHVDVVEQLAIDRAKELFGADYANVQPHSGSQANAPVYMALLEPGDTVLGMSLAHGGHLTHGSHVSFSGKMYNAVQYGLNPETGVIDYDEVERLAKEHKPKMIIAGFSAYSQVVDWQKFREIADAVGAYLMVDMAHVAGLVAAGEYPNPVQIADVTTTTTHKTLRGPRSGLILAKSNPEIEKKLNSAIFPGAQGGPLMHVIAAKAVAFKEAMEPEFKTYAKQVKVNAKAMADVFMARGFDVVSKGTENHLFLVSFIEQGLTGKLVDAALGEAHITINKNSVPNDPMSPFVTSGIRVGTAASTTRGFTEEDSKNLASWMCDVIDSCQQASESWDEKVVADVREKVKALCAARPVYK

SEQ ID NO: 10757 - protein, 237 aa, Fingerhuthia sesleriiformis
RDRHGMDVSEWDPSKDKYVAVKYDAETAVEAKALNKEALQAAVGLPVDRTIPLVAFVGRLEEQKGPDVMAAAIPEILEEEDVQIVLLGTGKKKFERLFKSAEEKYPDKVCAVVKFNAPLAHHIMAGADLLAVTSRFEPCGLIQLQGMRYGTPCACASTGGLVDTVVEGKTGFQMGRLSVDCNVVEPADVKKVATTLKRAIKVVGTPEYKEMVRNCMALDLSWKGPAKNWENVLLSMG

SEQ ID NO: 10758 - protein, 429 aa, Kineococcus radiotolerans
MVRAVPAIVRAPHLFLAEVTRRHGPVAAIPLPRTPVLVLADPDGVRRVLVENARGYGKATIQYSALATVTGPGLLAGDGEVWKQHRRTVQPAFHHGSLEDVAAHAVHAARGLVAEADALPPGTPLEVLGATSRAGLEVVGHTLAAADLSGDAPLLVEAVGRALELVVRRAASPVPAAWPTPARRRLAREVAVIDEVCARIVATRRARPLEDPRDVVGLMLAAGMDDRQVRDELVTFVVAGHETVASSLTWTLDLLARAPSVLARVHAELAGALGGREPGWDDLGKLPLLRAVVDESLRLYPPAWVVTRQALADDVVAGVAVPAGTLVIVCTWGLHRDPALWEAPEEFRPDRFLDAPRPAAGSYVPFGAGPRLCIGRDLALVEEVLVLATLLCERTVRPAGPAPRVDALVTLRPRGGLPLHVERLAPSAS

SEQ ID NO: 10759 - protein, 238 aa, Tetrachne dregei
RDRHGMDVSEWDPSKDKYIAVKYDAETAVEAKALNKEELQAAVGLPVDRKIPLVAFVGRLEEQKGPDVMAAAIPEILEEEEDVQIVLLGTGKKKFERLFKSVEEKYPDKVCAVVKFNAPLAHHIMAGADLLAVTSRFEPCGLIQLQGTRYGTPCACASTGGLVDTVVEGKTGFQMGRLSVDCNVVEPADVKKVATTLKRAIKVVGTPAYKEMVRNCMALDLSWKGPAKNWENVLLSMG

SEQ ID NO: 10760 - protein, 86 aa, Zea mays
PNPRKVLIIGGGDGGVLREVVKHPSVESVVQCEIDEDVIQVSKKFLPGMAIGYSSSKLTLHVGDGFEFMKQNQDAFDVIITDSSDP

SEQ ID NO: 10761 - protein, 222 aa, Pogonarthria squarrosa
RDRHGMDVSEWDPSKDKYIAMKYDAETAMEAKALNKEALQAAVGLPVDRKIPLVAFVGRLEEQKGPDVMAAAIPEILEQDVQIVLLGTGKKKFERLFRSAEEKYPDKVCAVVKFNAPLAHHIMAGADLLAVTSRFEPCGLIQLQGMRYGTPCACASTGGLVDTVVEGKTGFQMGRLSVDCKVVEPADVKKVATTIKRAIKIVGTPAYKQMVMNCMAQDLSWK

SEQ ID NO: 10762 - protein, 81 aa, Zea mays
MVTSTTAAAVLSPPSVAGLRLAPSPRARVAFRAAPARRSVAARAELNPSLVINLSTGLSVFLGRFVFFNFQRENLAKPGPQ

SEQ ID NO: 10763 - protein, 236 aa, Eragrostis airoides
  misc_feature (234)..(234): Xaa can be any naturally occurring amino acid
GIVNGMDVSEWDPSKDKYIAMKYDAETAMEAKALNKEALQAAVGLPVDRKIPLVAFVGRLEEQKGPDVMAAAIPEILEQNVQIVLLGTGKKKFERLFKSAEEKYPDKVCAVVKFNAPLAHHIMAGADLLAVTSRFEPCGLIQLQGMRYGTPCACASTGGLVDTVVEGKTGFQMGRLSVDCKVVEPADVKKVATTIKRALKFVGTPAYQEMVRNCMAQDLSWKGPAKNWENVLLXMG

SEQ ID NO: 10764 - protein, 473 aa, Tropheryma whipplei
MNMKVIDELSSEDLLLSEIDKTVKSFSDGDIVVGTVVRVYRDEVLVDVGYKTEGVIPVKELSLRADVDPNELLEVGSTVEALVFQKEDSQGRLILSKKRAQYEKAWSDLEKIKDSDLTVTGKVIEIVRGGLIVDIGLRGFLPASLIDIRRVRDLSSYLGMEIEAKVLELDRQRNNVVLSRRVLLEQNQSEARTSLFGNLHKGQVRKGTVSSIVSFGAFVDLGGIDGLVHISEISWKHVTQPSEVLKVGEEVTVEILEVDSERHRVSLSLRATQEDPWQVFAHDHAIGQIMPGVVTKVMNFGVFVRLAEDVEGLAHVSELLDSSLESTEDVFSPGDEVFVKIVDIDIDSRRISLSLKQATAALTLDSKGFDPALYGMLAEYDDDGNYKYPEGFDPEANQWKEGFEEEKARWEQGYAVARDVWHAHTVFVSEFQKKLEALSVSNAPETLPSAESVSAIDSDTTNSPESAKGSEQD

SEQ ID NO: 10765 - protein, 236 aa, Pseudomonas putida
SLIPIPQALEQGCDTLVTIGGIQSNHTRMVAAVAAKLGLACVLVQENWVDYSDAVYDRVGNIMMSRLMGADVRLVDQGFDIGFRRSWEEALEDVKRRGGKPYAIPAGASDHELGGLGYVGFAEEVRRQEAGLGFKFDYIVVCAVTGSTQAGMVVGFAADGRADRVIGIDASATPDQTRAQILRIARRTADMVGLGRAIGDEDVVLDTRYAYPAYGLPSAETNEAIRLCARLEGMMT

SEQ ID NO: 10766 - protein, 593 aa, Rhodobacter sphaeroides
MRIVFVHPNYHSGGAEIAGSWPPAWVAYLCGALKKAGYTDYHFIDAMTDYVSHEKLAEKLRELQPDIVATTAITPSIYVAEETLKVAMEVVPNALRVLGGIHATFMFRQVLEEAPWIDVIARGEGEEVLVNLVKAYEADNFAETRRQVKGLAFLDGDEIVSTAAAPTIRDVDSIDPDWGIINWKNYIYEPLGVRVPIPNMARGCPFTCSFCSQWKFWRDYRVRDPKKVVDEIEKLVNEHGVGFFILADEEPTINRKKFIEFCEEMIARGLPDKVKWGINTRVTDVKRDKELLKFYRKAGLVHISLGTEAAAQLKLDVFNKETTVAENKEAIRLLREADIFTEAQFIVGLDNETKETLEETYRMAWDWQPDLANWSMYTPWPFTPLFQELRDQVEVFDYSKYNFVTPIMKPKALTRGELLDGVMNNYRRFYMKKALFHYPWRGTGFRRRYLLGCLKAFLKAGVGRTFYDLGKAGYWGPQSKDKVDFHFDETRKIGNAQMADWEASADRAAKAAERREAARAGQGPCRGAQCGQGRGAPILTAGGGGCGGHADGSDCGCGGKKQQQVDEFAMPMACGGGKQQMEEAEERLVRPAE

SEQ ID NO: 10767 - protein, 390 aa, Mycobacterium smegmatis
MAQREWVEKDFYKELGVSSDASADEIKKAYRKLAAELHPDRNSDPGAAERFKAVSEANSVLSDPAKRKEYDETRRLFAGGFGRRFNQGGGGFGGGFGSDGVEFNLGDLFDAAGQTGGANIGDLFGGLFGRGPQQRPSRPRRGNDLETETELSFLEATKGVAMPLRLTSPAPCTNCHGSGARPGTSPKVCPSCNGSGVISRNQGAFGFSEPCTECRGSGSIIEHPCQECRGTGVTTRTRTINVRIPPGVEDGQRIRLAGQGEAGLRGAPSGDLYVTVHVRPDKVFGRDGDDLTVTVPVSFHELALGTTLSVPTLDGKVGVRVPKGTSDGRILRVRGRGVPKRSGGHGDLLVTVKVAVPPNLEGEAAEALEAYAKAERASGFDPRAGWAGNV

SEQ ID NO: 10768 - protein, 441 aa, Pseudomonas fluorescens
MGRRDSYNQPLSSLPRPHQTMTESVLDYMTRLGRAARQASRVIARATTAQKNRALLAAADALDAARPELTAANEQDLANGRANGLEPALLDRLALTPARIDEMIEGLRQVAKLPDPIGEIRDMRYLPSGIQVGKMRVPLGVIGIIYESRPNVTIDAASLCLKSGNATILRGGSEAIHSNRAIATCIQQGLAAADLPPHVVQVVETTDRAAVGALITMPEFVDVIVPRGGKSLIERVSRDAKVPVIKHLDGVCHVYIDVAADLDKAIRIADNAKTQRYAPCNTMETLLVHSAIAERVLPPLAAIYRDKGVELRGCAQTRALLGAGVLEATEEDWRTEYTAPILSIRVLDNLEQAIEHINTYGSHHTDSIVTENFSDARRFLNEVDSSSVMVNASTRFADGFEYGLGAEIGISTDKLHARGPVGLEGLTSEKYVVFGDGHVRT

SEQ ID NO: 10769 - protein, 287 aa, Arabidopsis thaliana
MGKASRDKRDIYYRKAKEEGWRARSAFKLLQIDEEFNIFEGVKRVVDLCAAPGSWSQVLSRQLYLPAKSSAESKDGDLPLIVAIDLQPMAPIEGVIQVQGDITNARTAEVVIRHFDGCKADLVVCDGAPDVTGLHDMDEFVQSQLILAGLTIVTHILKEGGKFIAKIFRGKDTSLLYCQAFAVCENYSPPEGFNPRDLHRLLEKVGSPSGGSDLDCSSGWLEGPNKVYIPFLACGDLTGYDSDRSYPLPREADGSSYQSLDPIQPPIAPPYKRALELKKASAQSFNS

SEQ ID NO: 10770 - protein, 435 aa, Unknown
  Dehalococcoides sp. BAV1
MKADYLIVGCSAGGIGAAEAIREVDRDGSIVIVGEEPYLAYSRPMIAKYLSGQKTVEKILFRRPEFYANNNITCLTDTKVEAVNTATHEVSLSNGEKISYGKLLLAPGGKPIVPPIDGSNKAGVFNFINMKDAVLIDGYVKAENVKKAVIIGGGLIGMSAADALTKLGIEVDIIELKGHILNTILDEAAGKIAAQTVTSYGVKLNTGRTVSKVLGLHKVAGVELDNGHQIESQMLVIAIGVIPRTELFKAAGLEVNRGVVVNDNMRTSNPDVYACGDACESFDFIYNSRRVTPIWPNAYIGGRIAGYNMAGMDTTYHGGTVMNSLNYFGMDIATAGMSVLPPDASGLEVLSTLTANGYKKLVLNAEGKIVGMLTLGETDTAGIIFGLMRDQSDVRPIKDNILNENFGLAYLSADSREEHLHGNTSGRVAPADFKH

SEQ ID NO: 10771 - protein, 252 aa, Pyrococcus abyssi
MLREVTISRAIIESYYRDLLNNLELDVAIVGAGPSGMVAAYYLAKGGAKVAIFEKKLSIGGGIWGGGMGFNKVVVQEEAREILDEFDIRYEEFEKGYYVADAIEVATTIASKTVKAGVKIFNMIEVEDLVVKDNRVSGIVINWTPVLMTGLHVDPLTVEAKYVIDSTGHGAQVAQFLLKRGLIERIPGEGAMWAEQGERLTVENTREVFPGLYVTGMAANAIAGAPRMGPIFGGMFLSGKKAAQEILEKLNL

SEQ ID NO: 10772 - protein, 532 aa, Burkholderia thailandensis
MSSTTDWNAARALDDHAPQAATGGNARAKTDFDVLIVGAGLSGIGAAYYLRERCPDATYAILEGRATMGGTWDLFRYPGVRSDSDMFTLGFSFRPWRSDKAISDGQTILDYIKDTARAYGFDKTIRFNHKVTAANWDSASARWTVRVQRATDDGRHEQAVYTCRFLYMCSGYYDYEEGHAPSWPDMDAYQGRIVHPQHWPSDLDYKDKRVVVIGSGATAVTLVPSMAADARHVTMLQRSPTYIVSLPARDAIANTLRRWLPSGLAHRLVRLKNVLLTMYFYNLARRRPDATKKFIIRAAGKQLGPQFDVNKHLTPRYKPWDQRLCLVPNGDLFKAIRSGRASIATDEIERFTPTGLRLKSGQRIDADVIVTATGLKLKMLGGAAVTVDSRPVDLSQTVSYKGMMYSGVPNLASSFGYTNASWTLKAELIAQYVCRLLEHMRTHGYDVCVPRLAPGSMELEPVVDLTSGYIQRAAGVLPKQGTKKPWKSYQNYARDFATFRFGALADGAMQFERRRPAPAERDATRQPAYEGR

SEQ ID NO: 10773 - protein, 762 aa, Vitis vinifera
MHMDAMDPTRAFVKDVKRLVIKFGTAVVTRSDGRLALGRLGALCEQIKELNSQGYQVIVVTSGAVGLGRQRLRYRSLLNSSFADLQKPQAELDGKACAAVGQNNLMALYDTLFSQLDVTSAQLLVTDNDFRDEAFRNQLTQTVDSLLALRVIPIFNENDAEVTRKAPYEDSSGIFWDNDSLAGLLALQLKADLLVLLSDVDGLYSGPPSDPRSLLIHTYLEKGHQGQITFGDKSRVGRGGMTAKVKSAVYSSQAGIPVVITSGYATGSILKVLNGERIGTLFHRDAYKWVQVKEVGAREMAVAARESSRRLQAMSSQDRKKILLDIANALETNEELIKIENDADVEAAQLAGYEKSLVSRLVLKPGKISSLANSIRVLANMERPIGHVLKKTEVADGLILEKMSCPLGVLLIVFESRPNALVQIASLAIRSGNGLLLKGGKEAKRSNAILAKVITEAIPDSVGKKLIGLVTSREEIPNLLKLDDVIDLVIPRGSNKLVSQIKDSTKIPVLGHADGICHVYVDKSANMDTAKHIVLDAKVDYPAACNAMETLLVHKDLVQTGGLNQLIVELRNEGVTLYGGPKASALLNLPEAHSFHHEYNSMACTVEIVDDVHSAIDHIHRHGSAHDCIIAEDLEVAEVFLRQVDSAAVFHNASTRFCDGARFGLGAGGWISTSRIHARGPVGVEGLLTTRWILRGNGQVVNGDKGVTYLHPQGAYFAALSLSHSLLGGDLLNNVGLGTFDFSFCNGRRVNWTLDLKEVIYQ

SEQ ID NO: 10774 - protein, 326 aa, Borrelia garinii
MLEFETINVNLTKKENLSQKEIEFIEDVIILGSGPAGLTAGIYSVMSNYKVTILEGPEPGGQLTTTTEVYNYPGFKNGISGRDLMLNMREQVVNLGAKTFPETVFSIKRENSIFYLYTENYIYKSKAVIIAVGSKPKKLETLKNSDLFWNKGISVCAICDGHLFKGKRVAVIGGGNTALSESIYLSKLVDKVYIIVRKDYLRAIAMLRDSVAKLPNIEIFYNSEAIEVDGESSVSSIKIFNEKDNVVNKLKVNGVFMAVGYKPNTEFLKGFLDLDEEGFIITKDIVKTSVDGVFSCGDVSNKLYAQAITAAAEGFIASVELGNFLK

SEQ ID NO: 10775 - protein, 105 aa, Unknown
  Dehalococcoides sp. BAV1
MELTDQSFAAEVLKSDKPVLVDFWAPWCGPCRMVAPIIDKLSTKYAGKFKFCKLNVDENKTTATQYRVMSIPTLLFFKGGQVADMVVGAVPESALSQKIDQLIQK

SEQ ID NO: 10776 - protein, 196 aa, Arabidopsis thaliana
  misc_feature (74)..(74): Xaa can be any naturally occurring amino acid
  misc_feature (119)..(119): Xaa can be any naturally occurring amino acid
  misc_feature (132)..(132): Xaa can be any naturally occurring amino acid
  misc_feature (167)..(167): Xaa can be any naturally occurring amino acid
EREREREFSIPPPPPEIEEEEEILVSYMISSDAELTSPAQDTMLAPFTVLKTSASFQVSRKANNDITSITTNVXTVSCMNERPPLGKKKFETISYLPDLTDSELLKEVDYLLRNQRIPXVQFDLYQGFEYRXEHRNTLVYYYGLYWNMWKIPLLRCSDSAQVLKEIXLCKKEYPVAFIMIIVFENNRQVQCISLIV

SEQ ID NO: 10777 - protein, 317 aa, Prochlorococcus marinus
METIEADVVIVGGGPAGCSCALYTSRADLKTVILDKNPDVGALAITHQIANYPGVSSEMSGEALLALMREQAVSFGSDYRRAQVFGVDVNGEWKTVYTPEGTFKARALVVATGALGRPASFKGEAEYLGRGVSYCATCDGAFYKGREVAVVGANKEAVEEGQVLTKFASRVHWLTTSDPKEDDAHAQALMTQPNVQHWSRTRLMLIEGDDAGVTGIKLKNRTQETEQDLAVEGVFVYMSGSKPITDFLGDQVAFKEDGGVVVDDFMATTVDGVWAIGDIRNTPFKQAVVAASDGCIAAMAIDRFLNSRKGIRVDWVH

SEQ ID NO: 10778 - protein, 383 aa, Vibrio alginolyticus
MNDVIRDFFKMESAGGILLVIAAAIAMTIANSPLGETYQSVLHTYVFGMSVSHWINDGLMAVFFLLIGLEVKRELLEGALKSKETAIFPAIAAVGGMLAPALIYVAFNANDPEAISGWAIPAATDIAFALGIIALLGKRVPVSLKVFLLALAIIDDLGVVVIIALFYTGDLSTMALLVGFIMTGVLFMLNAKEVTKLTPYMIVGAILWFAVLKSGVHATLAGVVIGFAIPLKGKQGEHSPLKHMEHALHPYVAFGILPLFAFANAGISLEGVSMSGLTSMLPLGIALGLLVGKPLGIFTFSWAAVKMGVAKLPEGVNFKHIFAVSVLCGIGFTMSIFISSLAFGNVSPEFDTYARLGILMGSTTAALLGYALLHFSLPKKAQA

SEQ ID NO: 10779 - protein, 80 aa, Tropaeolum majus
SAYNRFIKDEIQRIQAGNPDITHREAFSAAAKNWAHFPHIHFGLMPDQTIKKTNVRQQEGEDVLMKEGFFASANVGVTPY

SEQ ID NO: 10780 - protein, 311 aa, Prochlorococcus marinus
MHHRPTLASKPYGGLSWKKVLGLLAMDSPSTTANGWIDEHHQGVRYGLQGRVLVDETSPYQRITVIDSSRYGKGLLLDGCWMTAEHQERHYHESLVHPALCSAAQLERVLVIGGGDGGTARECLRYQDVKHLDMVEIDRRVVELSQKHLPSLGSHAWSDPRLQLNLENGIAWVANATESSYDVILIDGSDPAGPAEGLFNQTFFEHCRRILRPGGVFATQSESPEAFRQVHIDTVRLIRQVFGYADPLYGWVPMYPSGWWSWTFAAIDGPRYRNPLPARAAAISAGCEIWSPRWQQGAFEAIPAFIERELT

SEQ ID NO: 10781 - protein, 348 aa, Tropheryma whipplei
MEDLYGILGVDHNASVDEIRRAYRRLARELHPDINPDSADRFKAVTHAYNILSDPEQRQRYDRHVSGGFSSDFNLSDLFQSFFDTSAEFQRGSDLLVNIDIDLKTAIYGGSQVVKIDSLVVCDVCNGTRSEPGYKAEVCFDCNGSGVVRGEVRTTLGNLITQNTCSKCRGNGERIDHPCRRCYGNGSRSAPRDITINIPPGVETGMRIKIPNMGNAGGAMPGDLYVDCKVKEHPYFLRDGQDLYCRLDISLVDALLGTKVKIDSLDGELAVVIPALSQNRDVIRIANKGAVTLRGGKGDLCIVLNVLLMQKLDPEHRALLKKIMPNPPKPKLAKRTSGFFSWLKNKFT

SEQ ID NO: 10782 - protein, 314 aa, Unknown
  Magnetococcus sp. MC-1
MSEAKHHKLIILGSGPAGFTAAIYAARANLSPVVIQGLQPGGQLTITTDVDNYPGFADGIQGPELMQRMQAQAERFNTEVIFDTVMHADLSKRPFTLNCDSGDVYTCDALIISTGASARWLGMESEKKLNGFGVSACATCDGFFFKNQDVCVVGGGDTAVEEALYLSNICNKVYLIHRRDALRAEKIMQDHMFAKENIIPVWDSVPDEMLGDPNKGGLTGVRIKNVKTGALSELTVTGCFIAIGHRPNTEIFGDQLDKDANGYLVTKPGSTAMNIEGVFAAGDVQDTVFRQAITAAGTGCMAAIEAERWLAAHA

SEQ ID NO: 10783 - protein, 325 aa, Allium tuberosum
MGEVGPAIAKDVTELIGKTPLVYLNKVTAGCKARIAAKLEMMEPCSSVKDRIGYSMITEAEKQGLITPGVSVLIEPTSGNTGIGLAFMAAAKSYKLILTMPASMSLERRIILKAFGAELVLTDPVKGMKGACEKAEEIAAKTPNSYVLQQFENPSNPKIHYETTGPEIWKATDGKIDGLVSGIGTGGTITGSGKYLKEQNPSVKLYGVEPVESAILSGGKPGPHKIQGIGAGFIPGVLDVNLIDETLQVSSEEAIEMAKQLALQEGLLVGISSGAAAIAAIRVAQRPENEGKLIVVVFPSFGERYLSTVLFQSIKKEAESMVFEP

SEQ ID NO: 10784 - protein, 359 aa, Schizosaccharomyces pombe
MSQYDVEPLLSKAAILNKYADLPQNGKVMAEYIWIDGFNHLRSKTMTLDAKPSSIDQLRVWNFDGSSTGQAPGNNSDTLLKPVAMYNDPFRRGDNILVLAACYTADGSPNGFNHRDACAKLLEKHADKETWFGIEQEYTMLDYYDRPFGWPKGGFPGPQGPFYCGVGTGRVFARDIVEAHYKACLYAGINISGINAEVMPSQWEYQVGPCAGIEMGDQLWMSRFLLHRIAEDFGVKISFHPKPILGDWNGAGCHTNVSTKDTRAEGGIKAIESYLEKFAKRHKEHIAVYGDDNDLRLTGRHETGSIDKFTYGVADRGASVRIPRSVAMNGCGYFEDRRPASSIDPYLVTGIITETMFEH

SEQ ID NO: 10785 - protein, 484 aa, Aggregatibacter actinomycetemcomitans
MSVKGDIGVIGLAVMGQNLILNMNDHGFKVVAYNRTTSKVDEFLEGAAKGTNIIGAYSLEDLANKLEKPRKVMLMVRAGEVVDHFIDALLPHLEAGDIIIDGGNSNYPDTNRRVAALREKGIRFIGTGVSGGEEGARHGPSIMPGGNEEAWQFVKPVLQAISAKTEQGEPCCDWVGKDGAGHFVKMVHNGIEYGDMQLICEAYQFLKEGVGLSDDELQATFNEWRNTELDSYLIDITADILGYKDADGSRLVDKVLDTAGQKGTGKWTGINALDFGIPLTLITESVFARCVSAFKDQRVAASKLFHKTIGKVEGDKKVWIEAVRKALLASKIISYAQGFMLIREASEHFNWNINYGNTALLWREGCIIRSRFLGNIRDAYEANPDLIFLGSDSYFKGILENAMSDWRKVVAKSIEVGIPMPCMASAITFLDGYTSARLPANLLQAQRDYFGAHTYERTDKPRGEFFHTNWTGRGGNTASTTYDV

SEQ ID NO: 10786 - protein, 366 aa, Clitoria ternatea
MASPVKTLTTLAEEKTLESSFVRDEDERPKVAYNEFSDEIPVISIAGIDEVDGRRGEICNKIVEACENWGIFQIVDHGVDPKLVSKMTLLAKEFFAMPPEEKLRFDMSGGKKGGFIVSSHLQGESVRDWREMVTYFSYPIKERDYKRWPDTPKEWRAVTEEYSEKVMNLACKLLEVLSEAMGLERDALTKACVDMDQKVVINYYPKCPQPDLTLGLKRHTDPGTITLLLQDHVGGLQATNDNGKTWITVQPIQGAFVVNLGDHGHYLSNGRFKNADHQAVVNSNYSRLSIATFQNPAPNATVYPLKIREGEKPVLEEPITFAEMYRRKMSKDLELARMKKLAKEKQLQDIENAKKLETKPLKEILA

SEQ ID NO: 10787 - protein, 712 aa, Haemophilus ducreyi
MTPIVKQFKYGQHTVTLETGAIARQATAAVMASMDDTTVFVSVVAKKEVKEGQDFFPLTVNYQERTYAAGRIPGGFFKREGRPSENETLIARLIDRPIRPLFPEGFFNEIQIVATVVSVNPQISPDLVAMIGASAALSLSGVPFNGPIGAARVGFINDQFVLNPTITEQKQSRLDLVVAGTDKAVLMVESEADILSEEQMLAAVVFGHQQQQIVIENIKEFVKEAGKPRWDWQPAEANTALINQVKALAETRIGDAYRITEKQARYEQIDAIKADVIAQLTAQDETISEGAIIDIITALESSVVRGRILAGEPRIDGRTVDTVRALNICTGVLPRTHGSAIFTRGETQALAVATLGTERDAQIIDELTGEKSDRFLFHYNFPPYSVGETGMIGSPKRREIGHGRLAKRGVLAVMPSAEEFPYVVRVVSEITESNGSSSMASVCGASLALMDAGVPIKATVAGIAMGLVKEDEKFVVLSDILGDEDHLGDMDFKVAGTRKGITALQMDIKIEGITPEIMHIALNQAKGARMHILNVMEQALPAPRADLSDFAPRIHTMKIDPKKIKDVIGKGGAVIRSLTEETGTSIDIDDDGTVKIAATDNNAAKMVMSRIEEIVAEVEVNAIYTGKVSRVVDFGAFVTILGGKEGLVHISQITDARVERVSDYLSVGQEVNVKVVEIDRQNRIRLTMKDLDNNLSTNVTPEAVVQEESTEN

SEQ ID NO: 10788 - protein, 479 aa, Brassica rapa
MANIAGQLKRGISRQLSSVSLRRTFSRQFTRQASHDPRRINMRFSFGRQSSLDPIRRSPEGSGHPQLAVPDNLDATMQLLFVACRGDVEGVQDLLDEGIDVNSIDLDGRTALHIAACEGHVDVVKLLLTRKANIDARDRWGSTAAADAKYYGSMDVYNILKARGAKVPKTKRTPMVVANPREVPEYELNPQELQVRKADGISKSCQGIYQVAKWNGTKVSVKILDKDLYKDNETIEAFKHELTLLEKVRHPNVVQFVGAVTQNVPMMIVSEYHPKGDLGSYLQKKGRLSPSKVLRFALDIARGMNYLHECKPEPVIHCDLKPKNIMLDNGGLLKVAGFGLISFEKLSSDKSKVLNHGAHIDLSNYCVAPEVYRDEIFDRSADSYSFGVVLYEMIEGVQPFHPKPPEEAVKLMCLEGRRPSFKAKTKSCPEEMRELIEECWDVKAVVRPTFSEIIVRLDRIFVQCSKQGWWKDTFKFPWK

SEQ ID NO: 10789 - protein, 155 aa, Deinococcus radiodurans
MSTTEYVSGLWALIGHRPVNWAGACALVLNGAGEVLLQRRQDTGGWGTPGGIAELGEALEDTLRRELQEETGLRPLEVQLLTVVSGAETHVQLPNGDEFYQVTAVYVVSGWEGKPAPDGAEGTELRFFPLDALPAGLGPVDRHALDLLRVCWSVQ

SEQ ID NO: 10790 - protein, 314 aa, Gillenia trifoliata
LVDSVMFLEASHRLWRANGHRVMTVSPRYDQYKDAWDTSVPVEIEVGGRVETVRFFHCYKRGVDRVFVDHPLFLERVWGKTESKIYGPRAGVDYTDNQFRFSLLCQAALEAPRVLNLNSNKYFSGPYGDDVVFIANDWHTALLPCFFKTIYKPKGIYKNAKVAFCIHNIAYQGRFPFSDFSLLGLPENLKSSFDFIDGYNKPVKGRKINWMKAGIIESDRAVTVSPYYAQELVSGEDKGVELDNIIRKTGITGIVNGMDVQEWNPATDKYLDIKYDNTTVLDAKPLLKEALQAEVGLPVDRNIPVIGFIGRLEE

SEQ ID NO: 10791 - protein, 371 aa, Unknown
  Burkholderia sp. 383
MRAVPIPDSGTLGEPSSGAAVRDLRRVPIHPDHWYPLAWSRELKRGKTLGVHFAGDPIVLVRTESGAVYALEDRCAHRQVPLHAGVVSGETLRCCYHGWTYACDSGRCVDVPYLGRERLPNGVRAYPCREAHGLIFVFPGDATLADTRPFPALESADDRAYKTRRFGREVKCHYSFMHENLMDMNHQFLHRKQMGQMRARSVGRRRGDDWVEVDYTFARMEGKQPVGEALVFGASKKPADQSDKSVMTVRTGYPYQTLQIRSSEGTLVMDLWIVYVPLDAEQRTNRTFGLLSIHKPGIPFALDLAWPLLVWFTERIFREDRWIVEREQEAHDAQGADWNHEVFPVINELRDLLRQCGARTVIPIRDMRDGA

SEQ ID NO: 10792 - protein, 306 aa, Gillenia trifoliata
GGLGDVLGGLPPAMAANGHRVMTISPRYDQYKDAWDTEVTVELKVGDKTETVGFFHCYKRGVDRVFVDHPLFLEKVWGKTASKIYGPITGVDFKDNQLRFSLLCQAALEAPRVLNLNSSKYFSGPYGEEVVFIANDWHTALLPCYLKAIYKPKGIYKTAKVAFCIHNIAYQGRFAFADFALLNLPDEFKSSFDFIDGYDKPAKGRKINWMKAGILESDKVLTVSPYYAEELVSAVEKGVELDNIIRKTGILGIVNGMDVQEWNPLTDKYTTVADAKPLLKEALQAEVGLPVDRDIPVIGFIGRLEE

SEQ ID NO: 10793 - protein, 334 aa, Mesoplasma florum
MSKKNITIIGTGAYGTALANVLADNDNNVIMYGIVEQQVDDINIYHQNSVFFDNKKINKTIRATNSMAAALENTDILILGVPTAAIKHVVNDIIKYAKKPMDIINTAKGLDEENLGLLSDKIKKYFEGSNVISTYSALYGPSIAIEVVDRQPTAIMIASETIEKAKELCNVFSNEYFYMYPTTDIAGCEISAALKNAIAIGGGILKAYNAGDNAHATLLTLGLNEMYEFGKHFGAKLETFLNFAGLGDLILTASSKKSRNFRLGERIVELNDAKKALESFNLTVEGVETARIAHEIGVKYQISMNFFEIIYNILYNNVKPISLLNNVFRDVKLV

SEQ ID NO: 10794 - protein, 247 aa, Unknown
  Burkholderia sp. 383
MNTTSPRGPAPQRRTAMLRRIGAIAIAAAAVFGYQRIVNSAEPMRTVPAPTLDETPGTSHDETAVLAGGCFWGVQGVFEHVKGVKQVTAGYAGGASETAHYALVGSGLTGHAESVRIVYDPTQITYGRLLQVFFSVAHDPTELNRQGPDEGSQYRSAIFPTTAQQRAVATAYIAQLGTAHVFPAPVVTRVEDYKGFYPAEAYHQNYLELHPDAPYIAYNDMPKITGLKQHFPALYRTDAVLWRDARS

SEQ ID NO: 10795 - protein, 306 aa, Kageneckia oblonga
GGLGDVLGGLPPAMAANGHRVMTISPRYDQYKDAWDTEVTVELKVGDKTETVRFFHCYKRGVDRVFVDHPMFLEKVWGKTASKIYGPVAGVDFKDNQLRFSLLCQAALEAPRVLNLNSSKYFSGPYGEEVVFIANDWHTALLPCYLKAIYKRQGLYKTAKVAFCIHNIAYQGRFAFADFALLNLPDEFKSSFDFIDGYDKPVKGRKINWMKAGILESDKILTVSPYYAQELVSGVGKGVELDNIIRKTGIFGIVNGMDVQEWNPLTDKYTTVADAKPLLKEALQAEVGLPVDRDIPVIGFIGRLEE

SEQ ID NO: 10796 - protein, 363 aa, Magnaporthe grisea
MTSHPEWDQQTTGTEVVKAFADAIKGKNGMAAKNATNNPEVTCAAKRGIGSATALAVASQAPNHLILASRTASKLEEVIADINQKYPGVKAVPVRLDLGSIDSIRDAASKIESLLVGEEINVLINNAGVTDKTRAPITTPDGTRLDKQFFVNHIGTFLLTNLLTPLLQKAAAGSPSGATRVVNVSSHGHRISPIRFSDYALDKYGSDEAIPEAERTHPETPAFLLKGMDDEGFPGFVAYGQSKTANILHATELSRRLKKSGVVAFSIHPGFIETDLDRSLDKEFSDALKAMAANGFKTLDGGAATTLVAAFDPALGQVDVGVEVTGYLSDCQLSEQLVRDHAKDPAIARRLWEETERMLQISK

SEQ ID NO: 10797 - protein, 394 aa, Solibacter usitatus
MAGKRIGILTGGGDVPGLNSVIKTVVYRGSEIGCEVIGIRRGWEGLTHVNLQDPASRTRYVLPLNRENTRTIDRTGGTYLHSSRTNPSKMKKLPPVLEGQDFPKVTSTKKGVTSEVFDVSKAVLKNIETLNLDYLIAIGGDDTLSYAAELDRQGFRVIAVPKTMDNDVQNTEYCIGFSTAITRAMDAIERQRTTVGSHERIGLFRVFGRDAGYTALYTAYVTSVRCCIPEHKVDLPKLIDLLVTDKKNNPSNYSLAILSEGAEWVGYTVKEYGEADAFGHRKKMSVAEDLSNEIKNSTGEETIVSDLTYDLRSGSADFVDRMVASTFAGMAMDAIQEGKHGLMTAISNGSYTMVGIPDPKLGPRRVDVASMYNTDRYRPVYDHKLGLPIFLTRA

SEQ ID NO: 10798 - protein, 306 aa, Kageneckia oblonga
GGLGDVLGGLPPAMAANGHRVMTISPRYDQYKDAWDTEVTVELKVGDKTETVRFFHCYKRGVDRVFVDHPMLLGKVWGKTASKIYGPVAGVDFKDNQLRFSLLCQAALEAPRVLNLNSSKYFSGPYGEEVVFIANDWHTALLPCYLKAIYKRQGLYKTAKVAFCIHNIAYQGRFAFADFALLNLPDEFKSSFDFIDGYDKPVKGRKINWMKAGILESDKILTVSPYYAQELVSGVGKGVELDNIIRKTGIFGIVNGMDVQEWNPLTDKYTTVADAKPLLKEALQAEVGLPVDRDIPVIGFIGRLEE

SEQ ID NO: 10799 - protein, 268 aa, Arabidopsis thaliana
MSQLLSSPPMAVFSKTFINHKFSDARFLSSHSILTSGGFTGKIIPLKPTARLKLTVKSRQSDYFEKQRFGDSSSSQNAEVSSPRFYVGHSIYKGKAALTIEPRAPEFVALESGAFKLTKEGFLLLQFAPAAGVRQYDWSKKRVFSLSVTEIGNLVSLGPRESCEFFHDPFKGKGSDEGKVRKVLKVEPLPDGSGRFFNLSVQNKLLNVDESVYIPITKAEFAVLISAFNFVLPHLIGWSAFANSIKPEDSNRLNNASPKYGGDYEWSR

SEQ ID NO: 10800 - protein, 171 aa, Nicotiana glutinosa
LRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNLNFGVSGRVDSSVETNATASLISEM

SEQ ID NO: 10801 - protein, 118 aa, Glycine max
  misc_feature (25)..(25): Xaa can be any naturally occurring amino acid
LLVTCPSFTDIHPFAPVDQAQGYQXMSNNLGELCCTITGFDSFSLQPNAGAAGEYAGLMVIRAYHLARGDHHRNVCIIPVSAHGTNPASAAMCGMKIVSVGTDAKGNINIEELRKAAL

SEQ ID NO: 10802 - protein, 291 aa, Clostridium acetobutylicum
MEKFRTIAITGATSGLGKLVAIELVKRDAHLILTARNKERAEATKKMLESINPKAKIDFFFGDLSVMRDVKRVGEEIKAVHPRIDVLVNNAGLHAFEQRVTSDGLAEMMAVNYLAPWLLTNTLLQSLIASRNARIVNVASEASRNHGELKLPGDLTDISEFTSRESSAIYGKTKLLNIMFTAELARRLSGTGIIVNALNPGFNVTGLGRELWFATALERILKFFHIGDPRKGADIILRLSIDAQYNSVTGGYFNVITGNPISPIYPGGDKVMQNKLWSDTETLLKQRGFIE

SEQ ID NO: 10803 - protein, 146 aa, Brucella suis
MRYLHTMVRIRDIDESLDFYVNKLGLEEIRRIENEKGRFTLIFLAAPSDTDRARAERAPELELTYNWDPETYTGGRNFGHLAYMVDDIYATCEKLKSAGVTINRPPRDGHMAFIKSPDGISIELIQKGERLAPQEPWASAENIGTW

SEQ ID NO: 10804 - protein, 220 aa, Burkholderia pseudomallei
MAKNRFNQSWLHDHINDPYVKMAQREGYRARAAYKLKEIDEQDKLIRPGQVIVDLGAAPGSWSQYARNKLAQGKRRDAVREGGIDGTIIALDMLPMEPVADVHFIQGDFREESVLHQLEEVLAGRAVDLVISDMAPNLSGVAVADAARIEHVCDLALEFAQNHLKPDGALLVKCFHGSGYSQIVEKFKHQFKTVAPRKPKASRDKSSETFILGRHLKQPR

SEQ ID NO: 10805 - protein, 364 aa, Borrelia garinii
MKKDYYEILGLSKGASKDEIKKAYRKIAIKYHPDRNQGNEEAASIFKEATQAYEVLIDDNKKAKYDRFGHSAFEGGGFEGFSGGFSGFSDIFEDFGDIFDSFFTGNKGQERNRKHARGEDLGYNIEISLENAYFGYKNNINITRQILCHSCLGKKSEKGTSPSICNMCNGSGRVVQGGGFFRVTTTCSKCYGEGKTISNPCKSCKGKGRITNQETIQLNIPSGIDNNQQIKMKGKGNVNPDNQEYGDLYVKILIRSHKIFKRNGKDLYAMLPISFTQAALGKEVRIKTIASKEIKIQIPKGIENEEQIIVKGAGMPILQTEKFGNLILITKIKTPKNLNSNAIKLFENLSKELRDGDEIDLLKV

SEQ ID NO: 10806 - protein, 308 aa, Bacteroides fragilis
MSVEPGKWGVIYNPKAGTRKVQKRWKEIKEYMDSKGVSYDYVQSEGFGSVERLAGILANNGYRTIVVVGGDGALNDAINGIMSSNAEKKEEIAIGIIPNGIGNDFARYWELNLEYKQAVDWIINNRRKKIDVGYCNFYDGEKHQRRYFLNAVNIGLGARIVKITDQTKRFWGVKFLSYLAALFLLIFERKLYRSHLKINDEHIRGRIMTVCVGSATGYGQTPSAVPYNGWLDVSVIYRPEFLQILSGLWMLIQGRILNHKVVKSYRTRKVKVLRAQNAAVDLDGRLLPRHFPIEIGIIPEATTLIIPN

SEQ ID NO: 10807 - protein, 526 aa, Chlamydophila pneumoniae
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIVQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 10808 - protein, 193 aa, Herminiimonas arsenicoxydans
MKKSLFTLVCGTLLTVLFGTAHIASAQTAAPAACPATLNHVVPRLQDEAPQNLCQYAGKVVLVVNTASYCGFTVQYEGLEQLYAKYQPQGLVVLGFASNDFGQQEPGANKEIAEFCKNTYGVKFPMFAKSSVIGPNSNPVYLSLMKAGAKPPQWNFHKILLGRDGKVIASYPSKIRPDDKKMIADLEQALAKK

SEQ ID NO: 10809 - protein, 642 aa, Streptomyces coelicolor
MRKRDRTPKTYTRLTHPLVRDSREAPLRRATWEEALDRTARGLTAARGAFGMFSCARATNEMNYVAQKFARVVMGTHNVDSCNRTCHAPSVAGLSAAFGSGGGTSSYEEIEHTDVIVMWGSNARFAHPIFFQHVLKGIRGGARMYVVDPRRTSTAEWAESWLGPNVGTDIPLAHAVGREIIHAGLANEAFIERATTGYDDYKALVEPWTLSLAEKVTGVPAAAIRELAHAYARAERAQLCWTLGITEHHNGTDNVRALINLSLLTGHVGRYGSGLQPLRGQNNVQGGGDMGAIPNRLPGFQDVLDPEVRRKFETAWDTVVEPHHGLTLTEMFEAMDEGTLRAVYCIGENPAQSEADAEQAVRRLRALDFLVVQDIFLTKTAELADVVLPATAGWAETEGTTTNSERRVQRVRRAVSPPGEAREDIDILCDLAARLGHDWKYADAEAVWNELRSLSPDHHGMTYARLEEHQGIQWPCPSTQELEPTYLHGRLWAQDPASRGRLAPFGIVRHDPPVDLTDEQYPIRLTTGRRLDSYNTGVQSGGYASPLRRGESVELCPEDAERYGVVVGEEVRVTSRRGSLLAPVWVDTALRPGLAFMSFHFPDEVDTNQLTIEANCPIAGTAEFKASAIRIEKVSASGPALR

SEQ ID NO: 10810 - protein, 434 aa, Prochlorococcus marinus
MNVPEPSTELVQRAISVRRAATYLGQSTDIQRKEALGAIADALSLCRKEIVSANQQDLKRSIENGLSESLLSRLKLNENKLDAAIEGVRKVACLPDPIGIRQLHRQLDEGLYLERLTVPLGVIGVIFEARPDALIQIASLALRSGNAAILKGGSEAKLTNEAIVKAIDHGLGNSSINSDAICLLTTRRESLSLLRLDGMVDLIIPRGSNDLVRFIQDNTRIPVLGHADGICHLYIDSAADLDKALRIAIDSKCQYPAACNAIETLLLHKDIAPSFLDKAIPFFNESGVKLLGDQVCNSLGIENKAEESDWSTEYLDLVLSVKVVSSIDQALDHISRHGSRHTDSIVTNDPKTANKFLHSVDSSGVFLNCSTRFADGFRYGFGAEVGISTQTLPPRGPVGLEGLVTYRYFLKGDGHVVSEFASGAKSFSHKDLGL

SEQ ID NO: 10811 - protein, 217 aa, Plantago major
SEAYVMGGADEHENWHIYSAHVKPTDNLGNVYTLEMCMTNLDQRKASVFFKTHSSSAAVMTAASGITKILPESEICDFDFDPCGYSMNALEGGAVSTIHVTPEDGFSYASFEAVGYDFNKVVDLGYLVERVLACFGPAKFSVALHSSVAGKELGSVFNVGVKGYSCGELCRESFGDGSSVIYSSFIRTCGCGSPTSILHSWSGSESEDEEVCKKFSL

SEQ ID NO: 10812 - protein, 155 aa, Deinococcus radiodurans
MSTKDYVRDLRRLVGHAPVNFVGAAGLICNAAGEVLLQRRRGSERWGLVAGIAELGEPLEQTLRREVQEELGLTVQAAEFLELLNPAGLSRVANGDEFYSYTALYRVTAWTGIPVPDGVEIAEARFFSLAEFPPLTRLGQRAKEVMSSPASMAAW

SEQ ID NO: 10813 - protein, 159 aa, Pseudoalteromonas tunicata
MASIFDFTAPLTNGEHCDLAQFKGKPLLIVNTASKCELTPQYFALEQLYQKYKDQGFTVLAFPCNQFENKEPAENDEIKHFCELQFGVSFPIFAKVAVNGPDALPLFNFLKTNSRGLMQARAIKWNFTKFLINRTGQVVARYAPRTKPDAISSVIESIL

SEQ ID NO: 10814 - protein, 348 aa, Tropheryma whipplei
MEDLYGILGVDHDASVDEIRRAYRRLARELHPDINPDSADRFKAVTHAYNILSDPEQRQRYDRHVSGGFSSDFNLSDLFQSFFDTSAEFQRGSDLLVNIDIDLKTAIYGGSQVVKIDSLVVCDVCNGTRSEPGYKAEVCFDCNGSGVVRGEVRTTLGNLITQNTCSKCRGNGERIDHPCRRCYGNGSRSAPRDITINIPPGVETGMRIKIPNMGNAGGAMPGDLYVDCKVKEHPYFLRDGQDLYCRLDISLVDALLGTKVKIDSLDGELAVVIPALSQNRDVIRIANKGAVTLRGGKGDLCIVLNVLLMQKLDPEHRALLKKIMPNPPKPKLAKRTSGFFSWLKNKFT

SEQ ID NO: 10815 - protein, 145 aa, Unknown
  Erythrobacter sp. NAP1
MVKYLHSMIRVTDPQATVDFFKLIGLEEVRRFDVEAGRFTLIFLAAPGQEGVAEVELTYNWPPEDGSEPEDYDGGRNFGHLAYRVENIYDTCQRLADAGHTIHRPPRDGHMAFVKSPDGISVELLQEGNLEPQEPWASMENTGSW

SEQ ID NO: 10816 - protein, 110 aa, Neisseria meningitidis
MSSELIVHTGDAAFEQDVLKSDLPVLLDFWAPWCGPCKMIAPILDDIAAEFEGRLKVVKINIDDNEATPSRFGVRGIPTLMVFKNGDVVATKVGALAKGQLTAFVEASIA

SEQ ID NO: 10817 - protein, 317 aa, Deinococcus radiodurans
MIESFIGHTPLVQLRRVVTPDMADVFIKLEGQNPGGSIKDRTALGLVQDAERRGVLKPGGTIVEPTSGNTGIGLAQVAAAKGYKLILCMPAQMSEERKRTLRAYGAELILTDPERRMLAAIEEAEKIAAETGAVMMNQFANPANPATHEASTGPELWEQMEGRVDAFVYGTGTGGTITGTGRYLKRQDPNIQVIACEPARSNVLSGGERGNHGFQGMGPGFIPDNLDRSLLDDVIQVWEEDAYPLARRLAQEEGIFIGMSSGAMVWTALEVARRLGPGKRVVTIACDTGARYLTTALFSGEGDTPAGYLPYSRERVE

SEQ ID NO: 10818 - protein, 315 aa, Bacillus cereus
MTLNINRVFPRNWYAVSYSKDIKKIPVKKRVAGKDFVLYRDQKGEVQALSPYCPHRGADLSLGQVVNGKLVCPYHGWEFDSCGTCVRIPSQPNKPIPKFSHTFSYPVKEKIGLIWIYPDSEETPPEWQTFHVMENTPFKLSSFHATWNAHLTRSIESVLDIAHLAYVHKKTIGRKTKADSTNYKLEGTLDQFIFSNGDAYLEYKFPHQWMLHSGKQENESFIQYITFTPIDEEETLIMGYTGRTFLKYFPLLDQILAKFSLRVLKEDQIIVESQHPRPIPEALKMEAHVHADMAQVQFRKRWFQFLQNESCFSLD

SEQ ID NO: 10819 - protein, 486 aa, Medicago sativa
MAPPLTRIGLAGLAVMGQNLALNIADKGFPISVYNRTTSKVDETVERAKQEGNLPLYGFHDPEAFVNSIEKPRVIIMLVKAGAPVEQTTKTLSAYLEKGDCIIDGDNEWYENTERREKEVAELGILYLGMGVSGGEEGARRGPSMMPGGSFEAYKYIEDILLKVAAQVPDSGPCVTYIGNGGSGNFVKMIHNGIEYGDMQLIAEAYDVLKSVGKLTNEELQSAFTEWNKGELLSFLIEITADIFGIKDDKGDGYLVDKVLDKTGMKGTGKWTVQQAAELSVPAPTIEASLDARFLSGLMDERVEAAKVFKSGGFGDILTDQQVDKKQLIDDVRKALYAAKICSYAQGMNLIRAKSAEKGWDLALGELARIWKGGCIIRAIFLDRIKQAYDRNPNLANLLVDPEFAKEIIERQTAWRRVVSLSVNSGISLPGMSASLAYFDSYRRERLPANLVQAQRDYFGAHTYERVDIEGSYHTEWFKLAKQSRI

SEQ ID NO: 10820 - protein, 334 aa, Clitoria ternatea
MEVLRVQTVASESKDAVIPAIFVRPETEQPGITTVQGVNLEVPIIDFSNPDEGKVVQQIVEASREWGMFQIVNHEIPNEVISKLQNVGKVFFELPQEEKEVYAKVDGSDSIQGYGTKLSKEVNGKKGWVDHLFHIIWPPSSINYRFWPKNPPSYREVNEEYRKYLRVVIEKLFKSMSIGLGLEEMELKEAASGDDMILLLKINYYPPCPCPDLVLGVPPHTDMSYLTILVPNEVQGLQAFRDGRWYDVKYIPNALIIHIGDQMEILSNGKYKAVYHRTTVNKEEARMSWPVFIEPQAEHEVGPHPKLVDQHNPPKYKTKKYKDYAYCKLNKIPQ

SEQ ID NO: 10821 - protein, 246 aa, Rhizobium sullae
GGNKTRKLEYIIPDAIASNADTLVSIGGVQSNHTRMIAAVAAKIGFKCRLVQESWVPHEDAVYDRVGNILLSRIMGADVQMVDEGFDIGIRQSWEEAIEDVKAKGGKPYPIPAGASVHKYGGLGYVGFAEEVRAQEAELGFKFDYIVVCTVTGSTHAGMTVGFAKDGRERNVIGIDASFTPTQTKAQVLEIAQRTAELVDLGRDLTLDDIILIEDYAYPVYGVPSDETKDAIRLCARLEGMITDQS

SEQ ID NO: 10822 - protein, 81 aa, Oryza sativa
MSWKYVLFYVRLKSKYLDLDLTTAMFSVPEARRADYVRVANELVDNMTEFDRFVRTPKVYESYLYYEKTLKSLDDVTEFLA

SEQ ID NO: 10823 - protein, 605 aa, Campylobacter lari
MNNKGILYSAISATIVAIAGVLWLNQDITAKTNDSVGGIISQEIVKLGDENPTFDYWGKNFPDYLDMHTAVEKQAPNATEFGGNLAYSKLIRYPQLTVLWAGYPFSIDANEERGHFWVQVDQMDTARNNKDFLNAHGFAGFGGQPTACMNCHSGWTPWLLNNTAKGDWVAFNSAKYWTMIKTIPAVNGAKENSPEHSGPHGGKRMGVTCADCHNPTDMSLRLTRPALIKALISRGYEADEKQGIKASRSEMRTLVCSQCHVEYYFKPTGTKVKTIGESIANDSSKKWWNGTQKTYDEFDSWRDGNKPIEIEVDGIELTYPWSEWKKGESFRIEMFDDYYEKNRENFPSDWVHKITKAPMLKIQHPESELYSGGVHAANGVSCADCHMPYIRKGAKKVTNHNITSPLVDINSACKTCHTQSESYLAKQVKDIQNSVAHDLRTAEYSLVSLIKDVEIIRAELGKMPKFQTDGKADDAKISAELKEVLELHRKSQIRADFVGAENSTGFHNPREASRMLLQSVDMSRQGQTKLAEIAAKNGIKDFKTSNLGFEDIQKLNPGEIHYKVDLNGNKAGDRYYKHQEVNGNPPAKLLEDDKNLKPYNYKVID

SEQ ID NO: 10824 - protein, 302 aa, Lindleya mespiloides
GGLGDVLGGLPAAMAAIGHRVMTISPRYDQYKDAWDTEVTVELKVGDKTETVRFFHCYKRGVDRVFVDHPLFLEKVWGKTASKVYGPVAGVDFKDNQLRFSLLCQAALEAPRVLNLNSSKYFSGPYGEEVVFIANDWHTALLPCYLKAVYKPRGIYSTAKVAFCIADFALLNLPDEFKSSFDFIDGYEKPVKGRKINWMKAGILESDKVLTVSPYYAEELVSAVELGVELDNIIRKTGIFGIVNGMDVQEWNPLTDKYTTIKYDASTVADAKPLLKETLQAEVGLPVGRDIPVIGFIGRLEE

SEQ ID NO: 10825 - protein, 238 aa, Haemophilus ducreyi
MAQVSMRDMLNAGVHYGHQTRYWNPKMKPFIFGARNGVHVINLEKTLPLFNEALAELTRISSNNGKVLFVGTKRAASEAVKAAAVDCQQFYVNHRWLGGMLTNWKTVRQSIKRLKDLEAQTQDGTFDKITKKEALMRTRELEKLELSLGGIKDMAGLPDAIFVIGADHEHIAIKEANNLGIPVFAIVDTNSTPDGINYIIPGNDDATRAIQLYLDAASAAVKEGRGSNVEAELQIPAE

SEQ ID NO: 10826 - protein, 668 aa, Prochlorococcus marinus
MPLGSSITSKGVNFSLIATNAEYIEILVFEKEDSVAPKAIFKLDQNHKTGPYWHAEINDLKEGSIYAFRIKQKVNEPNKDYSKTVLIDPCSRGITGWSKYSRKNALNNFDNMDSCLKSVVCDRKVFNFKNFPRPKHSWEETIIYELHIKAFTQSSNEDESCFKKFLKKIPYLKELGITSIELLPVFCFDPNDAPNGLENFWGYSPINWFTPHFQYLSNKSAEQNREEFRKFVEECHKENIEVILDVVYNHTSEGDSGGPAISWKGIDENLYYFIDKDKNYQDVTGCGNTIAANRGLVRKLIIESLKCWANEFGVDGFRFDLGIALSRGEDLVPLDNPPIFEDIECEPELADIKLISEPWDCGGLYKLNNFPSKKTFTWNGHFRDDLRRFWRGDKDSAWNMSDKIKGSPSHYKENISFPKSINFITSHDGFTLKDLVSFNKKHNFANKEQNRDGDNHNNSWNHGVEGPTSNLFIKKLRKRQQKNFLLSLLISKGVPMILMGDEIGRSQGGNNNSWCQNNSLGWMNWDESQQDLELLTYLKYLIKIRKKFIKFFNPISPQNRKDIDNLVNYYWHGAKLESPDWSSWSHTIAFSMNKGKNNPLIWAGLNAYTKSIDFHLPESKSKWLKVVDTNESGTIMPIPLEHKSITVENRSSVLIISEEVFGTKNIIF

SEQ ID NO: 10827 - protein, 313 aa, Amelanchier laevis
GGLGDVLGGLPPAMAANGHRVMTISPRYDQYKDAWDTEVTVELKVGDKTETVRFFHCYKRGVDRVFVDHPLFLEKVWGKTASKVYGPVAGVDFKDNQLRFSLLCQAALEAPRVLNLGSSKDFSGPYGEEVVFIANDWHTALLPCYLKAVYKPRGIYSTAKVAFCIHNIAYQGRFAFADFALLNLPDEFKSSFDFIDGYEKPVKGRKINWIKAGILESDKLFTVSPYYAEELVSAVEKGVELDNIIRKTGIFGIVNGMDVQEWNPFTDKYTTIKYDASTVADAKPLLKETLQAEVGLPVDRDIPVIGFIGRLEE

SEQ ID NO: 10828 - protein, 963 aa, Xanthomonas campestris
MTPAVMQQQATTAAQRVSERGVGVAMTGAMRLRVVLYRLCRRARDGRPGTTQQPLQRSLRAGCMALICLCTTAGVVTAAEPTNAPRERISLNADWRFRRGDPPGNTVRLEYDVRPEVVRSEDGKVADARPEQAQRIDADARNVLKPWILPTANSLIADPTQRHVRPPGHPGSAVAYVQPMFDDSAWQRVDLPHDWAIAGPFLADGPHGGMGRLPSWGVGWYRKALQIPASDRGRSLFLDLDGAMSYATVWLNGKLVGGWPYGYTSWRVDLTPYVVPGGHNQLTIRLDNPPDSARWYPGGGLYRNVWLTKTGPLRVAQWGTQLSTPQVSAERAQVQLAVQLDNAGAAPVQAQVSTALYALDDASGLRRGPAVAQIAAVQVQVAAGGNARVQGSTQIEAPRRWGPPPTQQPHRYVAVTEVSQGGRVVDRVETPFGVRSVVFDPDKGLVINGEHVPIRGVNNHHDLGALGAAFNVRAAERQLQLLQHMGANAIRMSHNPPAPELLELTDRMGLLVVDEVFDSWEMKKTPLDFHLIFPQWHEPDLRAMLRRDRNHPSIILWSVGNEVGEQYTGEAGAAIARRLHAIVYAEDPTRPATAAMNYASPEMPLPAALDVISLNYQGEGIRDTPEFEGTERIRKPPQYPAFHAKFPRKAILSSETASALSSRGVYLFPVSAQSSAPVRDGRGGDSVAHQVSAYELHAVDFGSSADKVFAALDRHPFVAGEFVWTGFDYLGEPTPYYSSRSSYSGILDLAGFPKDRYWLYQARWRPELPMAHLLPHWSWPGREGQVTPVHVFTSGDEAELFVNGVSQGRKRKAPLQYRLRWDAVVYQPGELRVQAYKHGRPWASDRVQTAGRATRMQLSADRNQIRGDGKDLSFITVRLLDADGRPAPTAGDRLRFRVEGAGELVATDNGDPTNLEAFVLPERNAFNGLCLVIVRAKPGAQGPITVHVQSDTLQSASVQVLAE

SEQ ID NO: 10829 - protein, 424 aa, Xylella fastidiosa
MFFSGVAMFPRDARLDMYDPELAKAIAAEVRRQEDHVELIASENYCSTLVMQVQGSQLTNKYAEGYSGKRYYGGCEYVDIAEQLAIERAKKLFGADYANVQPHSGSQANQAVYFALLQPGDTILGMSLAHGGHLTHGANVNVSGKLFNAVQYGVNAQGLIDYEAVESLALEHRPKMVVAGFSAYSQKIDWARFRAIADQVGAYLLVDMAHVAGLVAAGVYPSPLPHAHVVTSTTHKTLRGPRGGIIVAQAPQEALVKKLQSIVFPGIQGGPLMHVIAAKAVAFKEALEPAFKVYQQQVVKNAKAMAGTLMLRGYKIVSGGTENHLMLVDMIGRDVSGKDAEGALGQVHITVNKNAVPDDPRSPFVTSGLRLGTPAVTTRGYQEQDCVDLAHWIADVLDAPADVTVIAAVREKVAAQCKKYPVYR

SEQ ID NO: 10830 - protein, 570 aa, Gibberella zeae
MSNSSLQKPIDVAEYLFKRLYEVGVRSIHGVPGDYNLVALDYLPQCNLRWVGSVNELNAAYAADGYARVTKMAALITTFGVGELSAINGVAGSYSEHIPVVHIVGCPSTISQRDQMLLHHTLGNGDFDVFANMSSQISCNVAKLNKPSEIAEQIDTALRTCWLRSRPVYIMVPTDMVQEKVEGARLDTPIDLSEPKNDPGNEDFVVDEILKAMYAAKRPVILVDSCAIRHRVVEEVHQLVDKLDLPVFVTPMGKGAVNEDHPNYGGVFAGDGSHPPRAQTIVEESDLLLTIGALKSDFNTTGFSYRTSQINSVDFHSTHCKVRYSTYPGVAMRGVLRKIIDKVDPKSMPAPSIPEVRNEVEKNNDDSETITQAWFWPRVGEYLIPNDIVVTETGTANFGIWDTRFPRNVTALSQVLWGSIGWSVGACQGAALAAKDAGKDGRTILFVGDGSFQLTAQELSTMIRHGLKPTIFVICNDGFTIERFIHGMDAVYNDINNWKYKDLVSVFGGEKTCKTFQIKTKNELNELLTNKEFNAAECLQFVELYMPREDAPRALVLTAEASARNNAKKH

SEQ ID NO: 10831 - protein, 313 aa, Amelanchier laevis
GGLGDVLGGLPPAMAANGHRVMTISPRYDQYKDAWDTEVTVELKVGDKTETVRFFHCYKRGVDRVFVDHPLFLEKVWGKTASKVYGPVAGVDFKDNQLRFSLLCQAALEAPRVLNLDSSKDFSGPYGEEVVFIANDWHTALLPCYLKAVYKPRGIYSTAKVAFCIHNIAYQGRFAFADFALLNLPDEFKSSFDFIDGNEKPVKGRKINWMKAGILESDKLLTVSPYYAEELVSAVEKGVELDNIIRKTGIFGIVNGMDVQEWNPLTDKYTTIKYDASTVADAKPLLKETLQAEVGLPVDRDIPVIGFIGRLEE

SEQ ID NO: 10832 - protein, 313 aa, Amelanchier laevis
GGLGDVLGGLPPAMAANGHRVMTISPRYDQYKDAWDTEVTVELKVGDKTETVRFFHCYKRGVDRVFVDHPLFLEKVWGKTASKVYGPVTGVDFKDNQLRFSLLCQAALEAPRVLNLDSSKDFSGPYGEEVVFIANDWHTALLPCYLKAVYKPRGIYSTAKVAFCIHNIAYQGRFAFADFALLNLPDEFKSSFDFIDGNEKPVKGRKINWMKAGILESDKLLTVSPYYAEELVSAVEKGVELDNIIRKTGIFGIVNGMDVQEWNPLTDKYTTIKYDASTVADAKPLLKETLQEEVGLPVDRDIPVIGFIGRLEE

SEQ ID NO: 10833 - protein, 220 aa, Desulfotalea psychrophila
MAEKSSLKGAIIQRDKQSYAIVPRIPAGVISPEQLRKLADVVEKHNIPIVKVTSGQRLALVGMKEEQIDEIYSDLGFEPGKATELCLHYVQACPGTTLCKFGVQDALGFGQHIEELLAGRDFPAKLKVGVSGCPFTCAEGSVRDIGITGKKSGWSLFFGGHSGRQARISDLIAEDLNDEALLALMEKCVQYYLDNSKKRERTARFIERIGIEEFKKQVLA

SEQ ID NO: 10834 - protein, 388 aa, Aspergillus nidulans
MVQFAFVSLWCLLLSYLSTKLPWLKTSIPALKNNIRPPSRDVIMTALPLAIFQLAGHILSSMATSQIPVSLVHTIKGLSPLFTVLAYRFLFRIRYAKATYLSLVPLTLGVMLACSTGFSTNFFGILCALVAALVFVSQNIFSKKLFNEAERAESDIQSAGRRKLDKLNLLYYCSGLAFILTLPIWLVTEGYPLFSDLMQDGAISLTNKAGSLDHGALFLEFVFNGVSHFAQNILAFVLLSMVSPVSYSVASLIKRVFVIVVAIVWFGNSTTPVQGFGIALTFLGLYLYDRNSHDDVADQKANADHFHFKNPILPLNTRGASKLRGSNGYAIPQGRPVDQHVLDRSFPISSNSKKDDGVGHARPRASSNTKAWLPPGTKQETTWQSSDS

SEQ ID NO: 10835 - protein, 318 aa, Oryza sativa
WRSSSGDGDADGVDALAAEVGRASRDWGFFVVVRHGVPAEAVARAAEAQRTFFALPPERRAAVARSEAAPMGYYASEHTKNVRDWKEVFDLVPRQTPPPPTTAVADGDLVFDNKWPDDLPGFREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 10836 - protein, 390 aa, Chlamydomonas reinhardtii
MTVNENGVLHMPIFEGSEKRIEVDFRLGPNVPANGLRSIPRETLDELMTLARCCIVSSRSNDKLDAYVLSESSLFVYPTKWILKTCGTTRLLNSVPRLLEVARSIGLEPRRCKYTRASFLFPENQPFPYTAFEHEVGFLDEHFGAMCANGGTAFMLGEPYQGLQWHVYLADDMLPLGPEFKPTYNFEVTMTDLGTEAAAQFFRDNNPKFVSAERTTKDTGIAELKPKAIIDDYVFEPCGYSMNGIDNTGLITIHVTPEAHQSYASVEFSGFGEDLMAPVQELLNKVVKIFAPGKVSVTMSVDKVDMDATGCWGNLTMCPAGFGLQGASSQVSPCGGKVAYYTLIEKLAAPGSPITPLHHAASFLSIVTSSDSEADNGSEPEREIVTTATA

SEQ ID NO: 10837 - protein, 274 aa, Glycine max
TREYQVLEELGRGRFGTVFRCFHRTSNKFYAAKLIEKRRLLNEDRRCIEMEAKAMSFLSPHPNILQIMDAFEDADSCSIVLELCQPHTLLDRIAAQGPLTEPHAASLLKQLLEAVAHCHAQGLAHRDIKPENILFDEGNKLKLSDFGSAEWLGEGSSMSGVVGTPYYVAPEVIMGREYDEKVDVWSSGVILYAMLAGFPPFYGESAPEIFESVLRANLRFPSLIFSSVSAPAKDLLRKMISRDPSNRISAHQALRHPWILTGALTTATISNFLT

SEQ ID NO: 10838 - protein, 239 aa, Thermus thermophilus
GRVYLVGAGPGDPELLTLKAYRLLKEAPVVLYDRLVDERVLALAPGEKVYVGKEEGESEKQEEIHRLLLRHARAHPFVVRLKGGDPMVFGRGGEEVLFLLRHGVPVEVVPGVTSLLASGLPLTHRGLAHGFAAVSGVLEGGGYPDLRPFARVPTLVVLMGVGRRVWIAKELLRLGRDPREPTLFVERASTPKERRVHARLEEVAEGKVEVRPPALWILGEVVRVFAEKEAPVDALALGG

SEQ ID NO: 10839 - protein, 527 aa, Perilla frutescens
MDACCATLKSTSHLSNVSKSAFCGEKNGFWGEKIKGSLNNCARAYQFGKKLNLEKRGRKIKPGVAYSVLTKKNINETLMIPPPLFEKRGANPKIVAAIILGGGAGKQLFPLTSKAATPAVPVGGCYRLIDIPMSNCINSGINKIFVLTQFNSASLNRHISRTYTGNGVSFGDGFVEVLAATHTAGETGNQWFQGTADAVRQFTWVFEDAKAKDIDNILILSGDHLYRMDYMDFVQNHIDRNADITLSCAPVCDSRASEYGLVKIDSRGRIILFSEKPKEADRMAMEVDTSIIGLSPEEALKSPYIASMGVYAFKTDVLLKLLRWRYPTSNDFGSEIIPSSVKEHNVQAYIFRDYWEDIGTIKSFYDANLALTDEFPKFEFYDPKTPFYTSLRFLPPTKIDNCKIKDAIISHGCFLRECVCQHSILGERSRLDSGVELKDTLMMGADYYPTESEIASLLVQGKVPMGIGRNTKISNCIIDKNARIGKDVIIKNKDGVEEADRSEEGFYIRSGITIVVEKATINDGTII

SEQ ID NO: 10840 - protein, 542 aa, Oryza sativa
MALLRCLFLLAVLLPHRNAAVVAAASPHHGPAPHDYRDALTKSILFFEGQRSGKLPPSQRVSWRGDSGLSDGSSIKARNSPLLRVSPFRRHWRRLSLSLSLSLSLSLAMVSWLDAFVSQVDLVGGYYDAGDNMKFGFPLAFSMTMLAWSVVEFGGLMKGELQHARDAVRWGSDYLLKATAHPDTVYVQVGDANRDHACWERPEDMDTPRTVYKVDPSTPGTDVAAETAAALAAASLVFRKSDPAYASRLVARAKRVFEFADKHRGTYSTRLSPYVCPYYCSYSGYQDELLWGAAWLHRATKNPTYLSYIQMNGQVLGADEQDNTFGWDNKHAGARILIAKAFLVQKVAALHEYKGHADSFICSMVPGTPTDQTQYTRGGLLFKLSDSNMQYVTSSSFLLLTYAKYLAFSKTTVSCGGAAVTPARLRAIARQQVDYLLGSNPMGMSYMVGYGAKYPRRIHHRASSLPSVAAHPARIGCSQGFTALYSGVANPNVLVGAVVGGPNLQDQFPDQRSDHEHSEPATYINAPLVGALAYLAHSYGQL

SEQ ID NO: 10841 - protein, 1625 aa, Aspergillus nidulans
MAASLCLRGSRQLALRSQLRSIHPSITRSRLLPTYRAVHSSSQQSHSARRPIYTSSVADHGVPHPRDVFQPVDTFPRRHIGPSPEAAEEMLAVLDPPVKSLDEFVKQVLPADILSKKDLAVTAPSADNGLPRSSVHGGLGETDMLKLLDKYREQIDVSGKTYIGAGYYPTIVPPVILRNILENPAWYTSYTPYQPEISQGRLESLLNFQTLTADLTGLPFANASVLDEATAAAEAMTMSLATQPLAKQKKAGKTYVVSHLCHPQTVAVMRSRAEGFGINLVIGDILADDFKIVKDQGDNLIGVLAQYPDTEGGIYDFQGLSDAIHTAGGTFSVATDLLALTVLKAPGEFGADIAFGNAQRFGVPMGYGGPHAAFFACADKYKRKVPGRVVGVSKDRLGNRALRLALQTREQHIRREKATSNICTAQALLANMSAMYAVYHGPSGLKTIAQRIMSMTAALRERLAALGYNVPAKSNVSDGAAVFDTITIEFSNSEEADAIIAAARQNSIFLRRVSATKVGISLDETAGREELKAILQVFSAHAKAEAALDQELGLASIPASLERTSAYLTHPVFNTHHSETEMLRYIRHLESKDLSLAHSMIPLGSCTMKLNATTEMIPVSWPEFSQMHPFLPADVAKGYTQMIDDLEQQLADITGMAEVTVQPNSGAQGEFAGLRVIKKYQEATGSSKRNICLIPVSAHGTNPASAAMAGMKVVTIKCDTKTGNLDLDDLKAKCEKHKDELAAIMITYPSTFGVYEPGVKKACDLVHQYGGQVYMDGANMNAQIGLCSPGEIGADVCHLNLHKTFCIPHGGGGPGVGPIGVAEHLRPYLPSHPNSEYLQSKRTEKSSPPISAAPWGSASILPITFNYINMMGSKGLTHATKITLLNANYILSRLKDHYPILYTNDNGRCAHEFILDVRKFKDTCGIEAIDIAKRLQDYGFHAPTMSWPVANTLMIEPTESENKAELDRFCDALISIRKEIAAVESGEQPRDGNVLRMAPHTQRDLLATEWDRPYTREQAAYPLPYLLEKKFWPSVTRVDDDAIGGSRRLPGTSRSQCGVRHPRCSTLSDIKASTFSGSLESHRSAARSRLGPSPDLCQDMESKITLFYGTFVDLPRTRSGEKHELAIRHGAIWVSSATGRIQGFDWSIANEAELQSLLRKKGWTGVPIIRALEQENEFFFPGFIGLFGSSTLLDWLETYTFPLESSMSNLDKARTAYNAVISRTLANGTTCASYYATIHVPATNLLASLCHTRGQRALIGRVCMDNPAFCPDYYRDESAEASIELTKETIAHIHSLPDSDKESERLVKPIITPRFAPTCSTSALTSLGQLAASHTPPLHIQTHISENPNEVSLVQSLFPEHPSYAAVYDACSLLTHRTILAHAVHLTQPEKELIASRNAKISHCPASNSALGSGLAPVRDLIDNGITVGLGTDVSGGYSPSILEAVRQACLVSRLLRHSTASTSSSGNSTQNETEGREVLSVEEALYLATRGGAAVIDMPNELGGFEVGMFWDVQLIRLGATVQETPQTGSHSDSRSVVDIFGWESWAEKVHKWVWTGNDRNVRRVWVGGAVVHDLDDGSCVGEETMLGSWFGKSLQRDWTRWAVASVGVAILGFAIGRRSLGSR

SEQ ID NO: 10842 - protein, 497 aa, Clostridium thermocellum
MVSEIVVDVGINEKRVALLEDRELVELFIERNDCERLVGNIYRGRVESVLPGMQAAFIDIGYEKNAFLYVGDAIPQKEFSEDDEEIYSDVKSYNIEEILRPGQEITVQVTKEPIGTKGPRVTTHITLPGRQMVLLPNADYIGISRRIEDEEERAKLRKIAEKIKPKNMGIIVRTVSEGKREEDFKSDLNFLVKLWAKIKQREQSGPVPRCLHKDLSVIYRAVRDIFTWNIDRFVINDRQEYNKVLELVEMISPALKMRVEYFNKNIDLFEYYQIDSMIQKALAKKVWLKCGGYIVIERTEALTVIDVNTGKYVGVNNLEDTVLRTNLDAVKEIGKQLRLRDIGGIIIIDFIDMHDPEHQKQVLEALKQVLKKDRTKTTVVGMTGLGLIEMTRKKVREGLESMMLQDCPYCEGRGKILSPESVARNVEKEISKYFTKTIANAIMVEVHPTVAEVLRGEDNDNLARIQNLFNKKVIIKPSAEVGHEEVKGSCKIKCRNI

SEQ ID NO: 10843 - protein, 542 aa, Unknown
  marine gamma proteobacterium HTCC2143
MTNKIKTDVDAIVIGSGFAGLALIHYLRDAGLSVKVFDKASDIGGTWTWNRYPGAMTDSEGYYYCLAFSKELLQKWTWSQRYPAWEETHRYMHFIADECDMWPHIQLNTAVTNAEYREDSGTWLITTADGEQCTCKYFVSGMGMISEPVIPKIKGMDTFNGPLFHSARWPEGLDYAGKRVAIIGAGATTVQMMPVLAETAGNVTVFHRTPNFILPAMQKPMTPEWEKDIKDNYDDIIEKCRNHVFGMAFDSPVGRNAVDTPEEERQKIFEENWTGSFRWVFETFDDLLADPAANDMASEFIINKMKERIEDPEIAKILAPVVGEYPLFAKRPPLDHGYLEAYSRDNVNLVDIRNREPIVEITETGIRTTENDFEFDIIILATGFRAYTGALEAVTITGVNGQTLADKWETTSKSIMGVCVSGFPNMFTVTGPQAPFANLPTSIEQNAIWIANCIKKMEGDGHSLCTPKQEAEDEWSAHVSEVHVQTLMNQGDKVNSWMMGANIENHEPRVLIYFGGADVYYQKLRESSDAGFPEVSFASIAG

SEQ ID NO: 10844 - protein, 262 aa, Streptococcus thermophilus
MKIALVQMDVAHGQPVENKKHVKEMLERALVANPDVIVLPEMWNTGYALDELDGLADKEGLESQEFLSQFAREHAVAILGGSVAIERDGKFYNTTYVYNKSGDLINIYSKVHLFGLMAEDRYMSAGAAESIFELDGVIAASVICYDIRFPEWVRTQMAQGAKVLFVVAQWPEPRVQQWEILLKARAVENQAFVVAVNRVGAGPDPDDIFSGHSMIIDPLGNVVLQAKEHEEGIFTAEINLEEVDRVRGQIPVFEDRRTDLYY

SEQ ID NO: 10845 - protein, 127 aa, Oryza sativa
  misc_feature (16)..(17): Xaa can be any naturally occurring amino acid
  misc_feature (24)..(24): Xaa can be any naturally occurring amino acid
  misc_feature (26)..(26): Xaa can be any naturally occurring amino acid
  misc_feature (31)..(32): Xaa can be any naturally occurring amino acid
  misc_feature (38)..(38): Xaa can be any naturally occurring amino acid
  misc_feature (42)..(42): Xaa can be any naturally occurring amino acid
  misc_feature (45)..(45): Xaa can be any naturally occurring amino acid
  misc_feature (47)..(47): Xaa can be any naturally occurring amino acid
  misc_feature (57)..(57): Xaa can be any naturally occurring amino acid
  misc_feature (61)..(61): Xaa can be any naturally occurring amino acid
  misc_feature (72)..(72): Xaa can be any naturally occurring amino acid
  misc_feature (90)..(91): Xaa can be any naturally occurring amino acid
SFGRGTNFFRPHGVFXXGPAPRLXVXGGFFXXLGGGLXVNRXLQXPXVPVGDPTFPXLWGXGGDPRDPAVPXAPPEFASPSAVGSGWFGXXFGKKEEEKKASPSGGKSEMLESFDTPSTPIPTFEYK

SEQ ID NO: 10846 - protein, 181 aa, Mangifera indica
KMIIKTCGTTKLLLSIPAILKLADSLSLKVQSVRYTRGSFIFPGAQPFPHRSFSEEVAVLDGYFSKFGLDSTAYVVGKPDPDNTKKWHVYSASAELGKRLDPVYTLEMCMTSLDKKRASVFYKTEASSAAQMTVESGIRKILPKSEICDFEFDPCGYSMNSIEGDAISTIHVTPEDGFSYA

SEQ ID NO: 10847 - protein, 320 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 10848 - protein, 400 aa, Unknown
  Erythrobacter sp. NAP1
MRALFVSDASAGILLILVAAAAMIAANSPMADEYRELFYGKLPWTPIEKLKDLHYWINDGLMAIFFFVVGLEVKREVVSGSLADPAARRLPMLAAAAGMGVPAIVYLLVTGGGEYFNGWAIPAATDIAFAMGVLGLLGNRVPASLRLFLLTVAIVDDIGAVLVIAVFYTQGLYTEWLVASVGVVALMVALNRMRVDYFWPYILLSVVLWYCVLNSGVHATIAGVVAALTIPLKRRDGNSMLERLEHSIAPWSAYLVVPVFGFANAGVSLEGMGPEALLAPLPIAIAAGLVVGKQIGIFSVVWLADKTGFAPRPDNASWAEIWGISILCGIGFTMSIFIGGLAFPDTPLLVEEAKIGILTGSAVSAILGYIVLRMTTSHTAEECDDQGPIPQDTHPNDPLR

SEQ ID NO: 10849 - protein, 237 aa, Triticum aestivum
  misc_feature (195)..(195): Xaa can be any naturally occurring amino acid
  misc_feature (210)..(210): Xaa can be any naturally occurring amino acid
  misc_feature (216)..(216): Xaa can be any naturally occurring amino acid
  misc_feature (220)..(220): Xaa can be any naturally occurring amino acid
  misc_feature (224)..(224): Xaa can be any naturally occurring amino acid
  misc_feature (228)..(229): Xaa can be any naturally occurring amino acid
  misc_feature (235)..(235): Xaa can be any naturally occurring amino acid
RDALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAISQGLTAPRNVLIPRTKGFVSAVSIMRDFVPAIYDTTVIIPEDSPKPTMLRILQGQSSVVHVRIKRHSMSDMPNSDEDVSKWCKDIFVAXDALLGQTYSNWSFDXENIPIXRPMXTFDXGPGXXMSPPIXGS

SEQ ID NO: 10850 - protein, 432 aa, Prochlorococcus marinus
MASSDDAKLRPLPNTAALSGVLEAFAFFRDPAFAQKRFERHGNVFETSLLGQPMVFIQGGQAIRDLLAQPNAVEGWWPESVRQLLGSHSLANRNGASHRARRRVIGQLFSASALQRYSAGIISMVQDLADELQAAKTALPLAERMRRFAFSVIATTVLGLEGTDRDELFVDFEIWTRALFSIPIALPGSSFAKALKARERLLRRLQKVLLKASNGNGGLDLLAGGLDEAGIPLTDEDMVEQLLLLLFAGYETTASSLSCLMRELLLNPQVETWLREEINGVDWPPAPEQATTAYDQVNAPKLDAVVSEVMRLTPAVGGFFRRTKCALVIDGVEVPKNRVVQVALAASNRHGAGDLEAFRPQRHLEDGCSATLLPFGGGERVCLGKPLAELEIRLMVVGLFHQLRLHLIPDQDLTLQMLPSPTPRDGLLTKVL

SEQ ID NO: 10851 - protein, 246 aa, Mesembryanthemum crystallinum
EFLARRKKISRAQTETQILRMLDHPFLPTLYCQFTSDNLSCLVMEYCPGGDLHVLRQRQPGRCFTEQAARFYLAEVLLALEYLHMLGVVYRDLKPENILVREDSHIMLSDFDLSLRCAVSPTLLVSSSMSATSKKMSGPCVDSRCVQPLCIQPSCQVTCFTPRLLASSSKLRKMKSDLEMKPLLQLVAEHTDAMLTNSFVGTHEYLAPEIYKGEGHGSAVDWWTFGISSTSFYMENSPLKEGNDRT

SEQ ID NO: 10852 - protein, 315 aa, Bacteroides fragilis
METERIKCLIIGSGPAGYTAAIYAGRANLSPVLYEGIQPGGQLTTTTDVENFPGYPQGISGPQLMEDLRTQAERFGADIRFGIATASDLGQAPYKITIDGEKVIEADSLIIATGATAKYLGLDDEKKYAGMGVSACATCDGFFYRKKVVAVVGGGDTACEEAIYLAGLASKVYLVVRKPYLRASKIMQERVRKHDKIEVLFEHNVVGLFGENGVEGMNLVKRWEEPDEERYSLPIDGFFLAIGHKPNSDIFKPYLDTDEVGYITTDGDSPRTKVPGVFAAGDVADPHYRQAITAAGSGCKAAIEAERYLSEKGLI

SEQ ID NO: 10853 - protein, 320 aa, Nostoc punctiforme
MRIARNITELVGRTPLVQLNRIPQTEGCVAEIVVKLESLNPSASVKDRIGVSMINAAEEEALITPEKTILVEPTSGNTGIALAMTAAAKGYRLILTMPETMSGERRAMLRAYGAELELTPGMEGMSGAIRRAQQIVNSTPNTYMLQQFRNPANAKVHRETTALEIWEDTDGQVDIVVAGVGTGGTITGVAEVIKARKPSSKAIAVEPANSPVLSGGQPGPHKIQGIGAGFIPQVLKLKLIDEVITITDEEAITYSRRLAKEEGLLSGISSGAALCAAIRVAQREENKERLIVMIQPSFGERYLSTPLFQDLEARLPASVG

SEQ ID NO: 10854 - protein, 478 aa, Ralstonia metallidurans
MEDSLSEVEGAAGDVSDVSEVDNFAPVTQEVDASDLCVRGVLPAGLQGTLYRIGPNPRFPQPEAHWFGGDGMVHVFAIDDGRVSYRNRWVRTPKWRDEDRAGRPLFRAFAGKLPDAPEWSGSDGGVANTNIIWHGGALLALEEAHLPTAVTPRAIDTLGYMEYGPLKGPFTAHPKTDPRTGELLFFGYNADGKLTPGVQVGAIDAQGRLTHYARLQAPYPSMIHDFMATPGHLLIPVLPLTGSLARVERGGPGYAWEPEKPAMIGVLPRGGGADDVRWFEGPACYVFHVMNAWEEGEGGQRILADVMVYDEPPLFPHADGSPGDPARQQAYLTRWTFDLASDIRRFTAERLDDTAGEFPRIDDRVSGFRYRHGWFAASHPEYGEGALNGIMHLDMQDGTRDAYWLPRGDITSEPVFAPGGGAHGGEGDGWLLAVVWRAAAQCSELLVFDARHVARGPLATVELPQRVPFGFHGNWVAG

SEQ ID NO: 10855 - protein, 572 aa, Mesembryanthemum crystallinum
SFDGNGNTDDEDDFYDDDDDDGRPDSVDDKVRKKEMRKGIDLATTLERIEKNFVITDPRLPDNPIIFASDSFLELTEFSRAEILARNRRFLQGPETDPATVAKIRDAIDNETDVTVQLINYTKTGKKFWNVFHLQPMRDQKGEVQYFIGVQLDGSEHVEPVQNSIPVASVMDSEKQVKETATNVDVAVRELPDANKKPEDLWANHSKVVQPKPHRKECSSWKAIEKIKESGEQIGLKHFRPVKPLGAGDTGSVHLVELCGTGEYFAMKAMDKNVMLNRNKVHRACAEREILDMLDHPFLPALYASFQTNTHICLITEYCPGGELFLLLDRQPTKVLKEDAVRFYAAEVIIALEYLHCQGIIYRDLKPENILLQSNGHVSLTDFDLSCLTSCKPQLLIPEIRDKKKQQKAQHQQTPIFMAEPMRASNSFVGTEEYIAPEIIAGAGIQGAVDWWALGILLYEMLYGFTPFRGKTRQKTFSNVLRKDLKFPATKQVSLDASQLIYQLLQKDPKDRLGACEGANEIKRHPFFRGANWALVRCMKPPVLDAPPLLGDPEKEANIVDPDMLDLQTNVF

SEQ ID NO: 10856 - protein, 473 aa, Tropheryma whipplei
MNMKVIDELSSEDLLLSEIDKTVKSFSDGDIVVGTVVRVYRDEVLVDVGYKTEGVIPVKELSLRADVDPNELLEVGSTVEALVFQKEDSQGRLILSKKRAQYEKAWSDLEKIKDSDLTVTGKVIEIVRGGLIVDIGLRGFLPASLIDIRRVRDLSSYLGMEIEAKVLELDRQRNNVVLSRRVLLEQNQSEARTSLFGNLHKGQVRKGTVSSIVSFGAFVDLGGIDGLVHISEISWKHVTQPSEVLKVGEEVTVEILEVDSERHRVSLSLRATQEDPWQVFAHDHAIGQIMPGVVTKVMNFGVFVRLAEDVEGLAHVSELLDSSLESTEDVFSPGDEVFVKIVDIDIDSRRISLSLKQATAALTLDSKGFDPALYGMLAEYDDDGNYKYPEGFDPEANQWKEGFEEEKARWEQGYAVARDVWHAHTVFVSEFQKKLEALSVSNAPEALPSAESVSAIDSDTTNSPESAKGSEQD

SEQ ID NO: 10857 - protein, 97 aa, Datura arborea
ATYKVKLVTPDGPVEFDCPDDVYILDQAEEEGHELPYSCRAGSCSSCAGKVTAGTVDQSDGNFLDDDQMADGFVLTCVAYPQSDVTIETHKEEELTG

SEQ ID NO: 10858 - protein, 583 aa, Alnus glutinosa
MEESKKSCFISDRVDYKGDPADRNTTGGWVPAALIVGIEVSERLSTMGIIVNLVTYLKGTMHQSSTTSSNSTSNVAGTSFLLCLLGGILADSFLGRYWTIAIFSVIHALGTCMLAISAALPELRPSECNLHHDFPLKCEEPSSFQMGILYTALYSMALGVGGIKSSVSGFGTEQFDQNDEKEMSEMAHFFNRFYLIISFGTLLAVTVLVYVQDQVGRSWGYGICSASMFLSIVAFLVGTKRYRYRECTGSPIIQILQVIVAAIRKRKAELPTDLSFLYDKASDKESTISHTDKYSCLDKGAIITGMDRGADGLTISNPWGLCTVTEVEEVKMLIRILPIMASTIIFWTIRAQLLSFSVQQAATMERTIENFPIPPASFNGFFVGSTIITLIMYDRLLPFLRQSSNGVQGFTNLQKIGIAIFLSILGMAAASFAEMKRLEVVRANRGSTSTSSTLPITAFYLLPQFVLVGIGDGFMYTGQLDFFITESPKGMKAISTGLFLTTNALGFFGSSILVTIITKVTGEEVGHGWLLSRINDSRLDFFYALLAVLGFINLVFYLVLASWYKPSPVEDAHQKINGKEEKV

SEQ ID NO: 10859 - protein, 97 aa, Hordeum vulgare
ATYKVKLVTPEGEVELEVPDDVYILDQAEEEGIDLPYSCRAGSCSSCAGKLVSGEIDQSDQSFLDDDQMEEGWVLTCAAYPKSDVVIETHKEEELTA

SEQ ID NO: 10860 - protein, 316 aa, Zea mays
MEPGPDGPAGGQGTSAPAEAGPSPSSSSAAAAASSSSRKQAEQQAPPQQQAGAQQRQQQAARAQHQEAPAPQAAQAQPQPLAQQPPPPPPPAGLSRYESQKRRDWNTFLQYLRNHKPPLTLARCSGAHVIEFLRYLDQFGKTKVHTEGCAHFGQPNPPAPCACPLRQAWGSLDALIGRLRAAYEESGGRPESNPFAAKAVRIYLRDVREAQAKARGIPYEKRKRKRGSAAAAPPVAPPPVVTAETAGTTSGTVCDEEEEPSPSAGDEPQKQTTTPTSASAPPTSTSSASASSSSAPAATTSTSSTRKEEEGSAPSS

SEQ ID NO: 10861 - protein, 97 aa, Lycium chinense
ATYKVKLVTPDGPVEFDCPDDVYILDQAEEEGHELPYSCRAGSCSSCAGKVSAGTVDQSDGNFLDDDQIADGFVLTCVAYPQSDVTIETHKEEALTG

SEQ ID NO: 10862 - protein, 276 aa, Solanum lycopersicum
TLKNDFQICEEIGRGRFGTVYRCFSPATGESYACKSIDKNLLIDSTDRECLDKEPKILQLLSGNPNILHLYKVYEDDDFLHMVTDFCPNSDLYERVSSGSLSESAAAAILTQLVSAISYCHHMGVAHRDIKPDNVLFDSENRLKLADFGSAEWFAGCEGRLMSGVVGTPYYVAPEVLMGKEYNEKVDVWSAGVILYIMLSGVPPFYGETPTETFQAVLRGNLRFPTRNFRSVSPEAKDLLRKMICKDVSRRFSAEQVLRHPWVINGGETRSMADLN

SEQ ID NO: 10863 - protein, 346 aa, Unknown
  Mycobacterium sp. MCS
MNGATSFTSVPTVDISGLQSDDRAEHERVAADLGAAARDVGFFYISGSGIDESLFDRMLAATKEFFALPLEEKMRTYIGLSRCHRGYVPVGEEGVEQDTPDFKEAFDTALDLPGDDPDYLAGNPMLGPNAWPDLPGFAESVTAYYTAVLEVGQRLLWAFAIALGEDPDVFTRHATKTPSQLRLVHYPHNPDAEDRMGIGAHTDYECFTLLKPTAPGLEVLNGAGEWIDVPPVPGTFVVNIGDMLELWTNGAFVATSHRVRKVKEERYSFPLFFNVDYHTEVKPLPQFAPRDDRPRPALRAGEHLFAQTAQSFAYLRRRLDSGELVLPEGSLAPGQFGQQALQGTTS

SEQ ID NO: 10864 - protein, 279 aa, Solanum lycopersicum
MFQTLKNDFQICEEIGRGRFGTVYRCFSPATGESYACKSIDKNLLIDSTDRECLDKEPKILQLLSGNPNILHLYKVYEDDDFLHMVTDFCPNSDLYERVSSGSLSESAAAAILTQLVSAISYCHHMGVAHRDIKPDNVLFDSENRLKLADFGSAEWFAGCEGRMMSGVVGTPYYVAPEVLMGKEYNEKVDVWSAGVILYIMLSGVPPFYGETPTETFQAVLRGNLRFPTRNFRSVSPEAKDLLRKMICKDVSRRFSAEQVLRHPWVINGGETRSMADLN

SEQ ID NO: 10865 - protein, 546 aa, Desulfotalea psychrophila
MEQTVIEYVLSRLKDLGVKDVFGVPGDYAFPINDAVCNDKELRWIGNCNELNAAYAADGYARIHGLAALSTAYGVGELSAINGIAGAYAEHLPIFHLVGMPASRVQAAHRLVHHTLGNGEFDLFYKMTEPVVCARAIMTPDNCVAETERLIAAAFYHRRPVYMAFPGDYADMPVVGQAEAVVVATSEVGTLAAAVEAICHAVSVSKRACILPGIMATRFGLRDQAAAVVEASGLPFATMFMDKCVLNEAHPSYIGIYNGELMNEQVRAFVEGSDCLLAIGMMLTDFNSGSFTANIDPAASINIMPHRVRVGTAIYHNIEMKDVLVMLAEKLPRKYGLGPRVEGLGEPVGGEDDKITVDYLYPRWEQMLKADDILVAETGTCSMGLGFAKMPNGSLFLNQSLWGSIGWATPAALGAALAAPDRRTILITGEGSHQFTAQEISQFHRYGLKPIIFVLSNDGYLIERLLCRDPDIYYNDLAQWHYKDLPEVLGCDGWFSARVTTCGELDEAIRKAEACGSGAYIEVVTDKYEASELAQRLADSIATLYK

SEQ ID NO: 10866 - protein, 434 aa, Solibacter usitatus
MSFGGSRVATSTLPVSISLENEKNPWLAAAARFEEAAKRLKLDDGMRKVLGTPSKELTVHIPVQLDDGRIEVFTGYRVQHSVARGPAKGGIRFAPDVTLDEVRALASWMTWKCAVVNIPFGGGKGGVICDPHILSDTELEKLTRRYTAEIIDFIGPERDVPAPDVNTNEKVMAWMMDTYSMHARHTVTAIVTGKPMALGGSRGRPEATGRGCMMVTQRALNRMGKRPEDTSVVIQGFGNVGGMAAKLMSAVGFKIIAIVEYDGAAYNPNGLDIAALQLHRKETGSITGFSGGEDMDKTEAMFLECDVLIPAATENVITSQNAHRVRCRILCEGANGPTTPLADDILAEKKVFVIPDILANAGGVTVSYFEWVQDRQGFFWNEQLVNERLQEIMDESFDAIVAYAEAHQVNNRIAAYMVALDRVAQAIKLRGIYA

SEQ ID NO: 10867 - protein, 157 aa, Methanococcus maripaludis
MKNIKTTVFGMGCFWGAEEVFRKINGVVSTEVGFMGGTIKNPTYGQVCRGKSGHIEVVKIDYDPEIISYDELLDLFWNNHNPTTPNKQGWDVGEQYSSYIFYFDDEQKLIAEKSLEKMQENTDLKIVTIIEKAGSFYPAEEYHQKYFMKKNNSILNF

SEQ ID NO: 10868 - protein, 499 aa, Solanum tuberosum
MSVTVSSPAVRSFHVSRSPHKTIYRPRVIMSAVRSSDSLGVAPILTKLQKDCATPLPVLRHVADAMADDMRAGLAVDGGSDLKMILSYVDTLPTGNEKGLFYALDLGGTNFRVLRVQLGGKEERVVATEFEQVSIPPELMFATSEELFDFIASALGKFAQKEGGNFELQQGRTREIGFTFSFPVKQTSIRTGILIKWTKGFAVSGTAGKDVVACLNEAMERRGMDMQVSALVNDTVGTLAGARYWDDDAMVAVILGTGTNACYVERVDAIPKLTKRMSKSPITIVNTEWGAFSNGLPLTEFDREMDAESINPGEQIFEKTISGMYLGEIVRRVLVKMSKVGGLFGGSYVPEKLVTPFVLRTPDICAMQQDTSRDLEAVESVLYDVAGVKSDLSARKTVVDICDTIAKRGGRLAGAGIVGILQKMEEDSKGLIFGKRAVVAMDGGLYEHYPQYRGYLQEAVTELLGSEISKNVVIEHSKDGSGIGAALLAAANSKYEHDY

SEQ ID NO: 10869 - protein, 564 aa, Alteromonadales bacterium
MKRMLINATQQEEMRVALVDGQRLYDLDIESPGHEQKKANIYKGKITRIEPSLEAAFVDYGADRHGFLPLKEIARTYFPAGYTFNGRPNIRDVIKEGQEVIIQVDKEERGQKGAALTTFISVAGSYLVLMPNNPRAGGISRRIEGDERTELKEALSRLELPKGMGLIVRTAGVGKSFEELNYDLKALLVHWEAIRQAADSAKAPFLIHQESNVIFRAIRDYLRRDIGEILIDKPRVFEEAKAHIERFRPDFMSRVKLYQGDTPLFTHYQIESQIESAFQREVRLPSGGSIVIDPTEALTSIDINSSKATKGGDIEETALNTNLEAADEIARQLRLRDLGGLIVIDFIDMTPPRHQREVENRLKDAARPDRARVQIGKISRFGLLEMSRQRLRPSLGEASQGVCPRCSGQGTVRSNESIALSILRLIEEEAIKDNTSQVNAQVPVAVAAYLLNEQRRSVHRIEKHHKCDVVIIPNQHMETPHYEVMRLRKDETLETVSYEQVVAPEPEAFEMSKSPAAPVREEPMLKGVVMPSSPAPQAAPAPAAKPAAVAAKEEAGLLLHLLLV

SEQ ID NO: 10870 - protein, 788 aa, Magnaporthe grisea
MNCWFRLKDGGFPTTSNEVRYILDSPEMRPIGCLARRAAIVRWPVANRLGSSAHRRPTLSTRCVSNTSSASSQSVARLLEWKPTTDAQNVIVDGYVRSVRSMKTASFVSLGDGSCIAPLQAIVPVDQADGLSVGAAVRLTGSWVSSPGRGQTHELRVQEVQVVGPSDAKTFPLQKKYHTPEFLRTIPHIRHRTPFNSTLLRLRSEVIRSMSHFFFTRDFVQTHPPVVTSSDCEGAGEVFEVLPASDGQISTEGVQKSTQPFFDSQKYLTVSAQLHLEALAQSVGNVWTLSPTFRAEKSDTPRHLSEFYMMEAEMSFVESMDTVMDLVEDLLRFATKELSSTKLFEDLQHRSKEGADDLTTPEEVRSRWNGLMADSWPRITYSDAIRLLESESQDRPDMFNFKPIWGHGLQAEHEKYIARVVGGGKPVFVTHYPRDLKAFYMLQSASATGKAGTSASFSAGTSRSDPEATTLRETVDCFDLLVPDLCEIAGGSMREHRLQPLLGVMQSRGMVPQVSDVGSSSLASRGDGDSDPVSNTTDAQHAGALDWYVDLRRWGCPPHGGFGIGFDRLLCYLSGVQSIRDIVAFPRWYGRDARYASQLPSDPRLAMDLDFEPADTSQLLGRVMAASVTWIRHSALGTSYPGLLEVEGHKSLRPGDGSIHGLCFLRDAQNSHTSNVKVLRLFLGRSPVCASDQRRGSRRLSKYKPSDLLPTLYDGATICCQRSCSRTGEIWGLLAAYHILGDAKRGQGASLNEWISDMNTIMNKSYQFKAHRCQKAVIPFPYDTRTRS

SEQ ID NO: 10871 - protein, 435 aa, Unknown
  Synechococcus sp. CC9605
MSSVPEPSAALLQRAVAVRRAAVDLGQTDDGQRALALQAMADALTERAATILAANREDLERSAGEGLAPALMARLKLDDTKLAAAIDGVRKVASLSDPLGCRQLHRELDQGLVLERVSVPLGVVGVIFEARPDAVMQIASLAIRSGNGALLKGGSEARCTNEAVMDALQAGLAASPVSADALALLTTRQESLALLRLDGLVDLIIPRGSNELVRFIQDNTRIPVLGHADGVCHLYVDAAADIAKAVRVAVDSKSQYPAACNAIETLLVHRSIAQPFLAAALPAFAAAGVKLRGDAESVALGVAEAATEEDWSTEYLDLILAVKLVDDLEAATDHIRSYGSRHTEVILTEDAQTADRFLAAVDSAGVYHNCSSRFADGFRYGFGAEVGISTQTLPPRGPVGLEGLVTYRYRLRGEGHITADYANGSCVFTHIDRPL

SEQ ID NO: 10872 - protein, 597 aa, Bacteroides fragilis
MENLKNVAPIEDFNWDAYENGESFAGASHEELEKAYDGTLNKVNDREVVDGTVIAMNKREVVVNIGYKSDGIIPLNEFRYNPDLKVGDTVEVYIENQEDKKGQLVLSHRKARATRSWDRVNAALENEEIIKGYIKCRTKGGMIVDVFGIEAFLPGSQIDVKPIRDYDVFVGKTMEFKVVKINQEFKNVVVSHKALIEAELEQQKKEIIGKLEKGQVLEGTVKNITSYGVFIDLGGVDGLIHITDLSWGRVSDPKEVVELDQKLNVVILDFDDEKKRIALGLKQLTPHPWDALDPNLQVGDKVKGKVVVMADYGAFIEIAPGVEGLIHVSEMSWSQHLRSAQDFMKVGDEVEAVVLTLDREERKMSLGIKQLKQDPWETIEEKYPVGSKHTAKVRNFTNFGVFVEIEEGVDGLIHISDLSWTKKVKHPSEFTQIGADIEVQVLEIDKENRRLSLGHKQLEENPWDVFETVFTVGSVHEGTIIEMLDKGAVVALPYGVEGFATPKHLVKEDGSQAQMDEKLEFKVIEFNKDAKRIILSHSRIFEDVAKAEERAEKKAASNAKKSSKREETPAIQNQAASTTLGDIDALAALKEQLEGKK

SEQ ID NO: 10873 - protein, 196 aa, Glycine max
MSASRAPPAANPPDQIMHSMKRQLPFSSMKPPFVAAGDYHRHDAAEAIVVKTPLLKRKSEVADFEADSGDRMTAGFTEAANSPFQTPVSGKTGKGGKSSRLTKGNRVGTQTPGSNIGSPAGSNLTPAGPCRYDSSLGLLTKKFINLIKQAEDGILDLNKAADTLEVQKMRIYDITNVLEGIGLIEKRLQDRIQWKG

SEQ ID NO: 10874 - protein, 349 aa, Oryza sativa
MEGGGARNGSTTGAARTGGSGGDAAGGGGGGSAGNGKPLPPCCVKARAAAPESEAKCHATVVSGWFTEPRSRGGKTSKVQYYNNPMWPGEAHSLKVEKILYQGKSPYQEVLVFESSTYGKVLVLDGIVQLTDKDECAYQEMITHLPLCSIPSPKKVLVIGGGDGGVLREICRHGSVESIDICEIDQLVIDVCKDFFPDLSVGFKDPRVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEYY

SEQ ID NO: 10875 - protein, 555 aa, Zea mays
MMSPASERSLIIQSDDDDDARSGHDVEEPEQDSDSSSSSSSCATPRRGPSSPPYIQQWPQSYRQSIDILSSVQSPNLSFLGTPTLSRLSNSFLAITDSFRSKAPETISSFIKPLLGPTPSDEQQRQHEGTRKSSEYLVPSRRSSLQQIPEDQKPPVGGHGASHDQNCSYTQGVMNGINVLCGVGILSTPYAIKQGGWIGLAILCTFALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDVGFENEGTALNAPGIPIAIGLYGYCYSGHGVFPNIYSSLKNRNQFPSILFTCIGLSTFLYAGAAVMGYKMFGEATESQFTLNLPDNSVISKIAVWTTVANPITKYALTIIPLAMSLEELLPPNQQKYSTIIMLRSSLVISTLLIALSVPFFGLVMALVGSLFAMLVTYILPCTCFLAILKTKVGWHQIAACSFIIVVRVCCAYVGTYSSLSKIIQNYA

SEQ ID NO: 10876 - protein, 177 aa, Arabidopsis thaliana
MSREIEPLIVGRVIGDVLEMFNPSVTMRVTFNSNTIVSNGHELAPSLLLSKPRVEIGGQDLRSFFTLIMMDPDAPSPSNPYMREYLHWMVTDIPGTTDASFGREIVRYETPKPVAGIHRYVFALFKQRGRQAVKAAPETRECFNTNAFSSYFGLSQPVAAVYFNAQRETAPRRRPSY

SEQ ID NO: 10877 - protein, 306 aa, Chlorobium tepidum
MGRAMGDSFTFIFNPAADKGRAADKTALIERSLAHFEVASLETTRFAGHAAEIARAAAGEGSTLIACGGDGTLNEVVNAVAGQPVKVGVLPVGSANDFLKTFNPSAKEHEVRIRGFAGATSRKVDLGKVEFGGGESRYFVNSIGIGFTGRIASTVKSVKWLRGELSYAWALVSVLLGYSAVKMHITLDTVEGKIELDEPVFAFSVSNGRVEGGKFRIAPEADPFDGLLDVCILKAVSKWRVPGYVLKYLKGSQIHDPNVIYCKARSVEVFLSVSEAMHMDGEVIEKVGGAIAITAEPLAVEMLYEP

SEQ ID NO: 10878 - protein, 97 aa, Physalis alkekengi
ATYKVKLITPDGPVVFDCPDNEYILDAAEEQGHDLPYSCRAGSCSSCAGKVTAGTVDQSDGNFLDDDQVADGFVLTCVAYPQSDVTIETHKEEELTA

SEQ ID NO: 10879 - protein, 97 aa, Scopolia japonica
ATYKVKLVTPDGPVEFDCPDDVYILDQAEEEGHELPYSCRAGSCSSCAGKVSAGTVDQSDGNFLDDDQMADGFVLTCVAYPQSDVIIETHKEEELTG

SEQ ID NO: 10880 - protein, 97 aa, Nicotiana tabacum
ASYKVKLITPEGAVEFDCPDDVYILDQAEEMGHDLPYSCRAGSCSSCAGKVTAGNVDQSDGNFLDDDQMADGFVLTCVAYPQSDVTIETHKEEELTA

SEQ ID NO: 10881 - protein, 395 aa, Oryza sativa
  misc_feature (209)..(209): Xaa can be any naturally occurring amino acid
  misc_feature (219)..(219): Xaa can be any naturally occurring amino acid
  misc_feature (228)..(228): Xaa can be any naturally occurring amino acid
MSDKCGNCDCADKSQKKGTSYGVVIVEAEKSHLKEVAAGEVMGGLSMDQAFVQAPEHRPKASVAEADGIPVIDLSPLLAAGDGDADGVDALAAEVGRASRDWGFFVVVRHGVPAEAVARAAEAQRTFFALPQERRAAVARSEAAPMGYYASEHTKNVRDWKEVFDLVPRQTPPPPTTAVADGDLVFDNKWPDDLPGFREAMEEYGEAVXEELAFKLLEXLIARSLGLXPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 10882 - protein, 97 aa, Capsicum annuum
ASYKVKLITPDGPIEFDCPDDVYILDQAEEAGHDLPYSCRAGSCSSCAGKIAGGAVDQTDGNFLDDDQLEEGWVLTCVAYPQSDVTIETHKEAELVG

SEQ ID NO: 10883 - protein, 477 aa, Ashbya gossypii
MLAPFRPRRYSAITSPLRTITVRDLLQLQDAPKQPLDVQGRVRSFRAMKNASFLDLEDGSSKNALKVVISHHGRPNPVTLKTGQSVAVRDAMWKWTPDRQQAFELACQPTDVQVIGDVTDEYPLQKKYVSLKHLRQWPLWKHRTQYLGGLLRFRSHIEATLTQILTQEGIYKVPPPVVTSGDCEGAGELFHVEANSLRASQRKYFGTNAYLTVSAQMHLEVIALALGRVWALTPCFRAEESDTSRHLSEFWMLEAELCFVQDVTQLTGFVQKLIQELARTLLQRQDELLPGMVPQEGAESRETVLARWQSLIEHPWHTVTYTEAIQVLQRQHDLSPFVHAPQWGAALQSEHEKWLAGAHFGGPVFVTDYPRECKAFYMRLNDDKKTFACFDLLFPEMGEVMGGSIREERYDALLREMTSRNMNIAELDWYLQLRRQGSAPHGGFGLGMERLISWLYGNHNVRDAIGFYRSATSTIEL

SEQ ID NO: 10884 - protein, 326 aa, Bradyrhizobium japonicum
MTAFHSVAVIGAGAWGTALAMVAARAGRSVTLWARNAEHATRIASTRDNPRLPGVRLAPDIVVTSELALAARADMLLIATPAQHLRGAVNMLASHIARPTPVVACAKGIEHGTHKFMTEVIAEAALHAQPAILSGPSFADDVARGLPTAVTLAAKEEELASSLVQALGSPTFRPYHSTDVRGVEIGGAAKNVLAIAAGIVVGRNLGASALAALTTRGFSELARLGRACGARPETLSGLSGLGDLLLSCSTAQSRNFALGIALGRGEAAPAGKLAEGAFTAPVLVELAAARNVDMPVSQAVAAILDNKLTIDAAIEGLLTRPFKAEE

SEQ ID NO: 10885 - protein, 347 aa, Lycium barbarum
  misc_feature (6)..(32): Xaa can be any naturally occurring amino acid
  misc_feature (298)..(298): Xaa can be any naturally occurring amino acid
SVAVEXXXXXXXXXXXXXXXXXXXXXXXXXXXPMFLEKVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIXVLGTGKKKFEQEIEKLEVLYPDKAKGVAKFNVPLAHTITAGADFMLVPS

SEQ ID NO: 10886 - protein, 97 aa, Solanum nigrum
ATYKVKLVTPDGPIEFDCPDDVYILDQAEEEGHELPYSCRAGSCSSCAGKVTAGTVDQSDGNFLDDDQMADGFVLTCVAYPKSDVTIETHKEEDLTG

SEQ ID NO: 10887 - protein, 556 aa, Clostridium perfringens
MSKIYDLVIIGGGPAGLSAGIYAGRAKMNTLIIEKGELGGQVNKTFDISNYPGSRNTNGPKLMSEMRAQAEDFKVKFMNGEVLEVSLEGDIKEIKTDKGLVKGRSVIIATGAAPRQLGFKGEEEFTGRGVAYCATCDGQFFEGLEVFVIGAGFAAAEEAIFLTRFASKVTVIAREPEFTCAKSIADKVLSNPKIEVKFNTEIIEAKGKDMVNYAKFKNNVTGEIFEYRAKKEDGAFGIFVFVGYAPKSELFKDILELDKQGYIITNEDMETNINGVYVAGDLRPKSLRQIVTAVSDGAIAATTAERYVKELKEKLGIEDEYLEEEENIQEEKNSDENNDLGNISRKSSLLNDGLRAQLKGILSKIENEVTLVSIVDRNNTKSIELRDLVLDISDLGEKINAKIFNKGENKEIEEKINADKYPIVALLDENENYSGIKFHGVPGGHELNSFILAIYNLGGPGQGINEGVLDEIKKLDKKTNIKVCVSLSCHLCPDVVASAQRIAKENKNIEAEMIDLANFKDIKDEFKIMSVPALIVNNKDVYFGSKKIEEILEIIK

SEQ ID NO: 10888 - protein, 402 aa, Arabidopsis thaliana
  misc_feature (128)..(128): Xaa can be any naturally occurring amino acid
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATAXTASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 10889 - protein, 1372 aa, Coccidioides immitis
MERRRHSLHGSDSSTPTDFYPLHPPFVLPGQEDFEVDIRDADDQHDTPLVTSSGATVSQVSSGYRNSPVLAPPAIYPQWTPEIPRHSRSGSAGASAATFERHTPSDMSDRELRPQRPSGPARTPSNTYAPPRRPPQFSTHSSSQLSYSAKRPSRRDPNAQYRAQEKAYVQRVRQGPPNEWLNFGSQIPGVPDIDLDLEDESPSSEPFDSDPYDVEAHLVLEDENIQPTLEELQNPKIREKLEWHSMLASVLKGDVVKQEKRRLFGTGEPKSLTDINDEIWLGIRARSCGRLEALQKKIIEHERAQVGPILEEIISFKIKGETEIGKPPVKQVEGIVAKIEKVESLYSVMRELKAHHKRADSEEFTASCDAIISWHNTTQLINTQFAILQRWVGNEELNFNLPITKPSHAADLADEGSFLDRIMKEDGLKSLQGDGNVVDGNGQTRKNSMLDGIGEVIKKAKATLIENSEAFVERHLPPYIEELLILISFPSRLIVEVIRVRLSYAKKMKDPGQQSPMLLDQMIAQFQILMKIAVEIKQRYLVISEPEPGWELPPCFEESFDTVVVDALKYYFKLLNWKLSANKNTFKEAEILEQEWDFSNEIGRQFEGGDIEVAEQFSTLTAKALQRLMLHFERELLGKPEGDAVESEKRYKQILDSVRVRQRKLFRFSRFLRERFENATEFHLKDDIVETFSEALLASGHFLVTSLDSVGQKGVSLIASPSLYGRPKDIQSILGTSFRAEDVPEDPSNPYILVIRPEKPFPWSGKRMEVDLLEHPTDVRLGKLRLVADGSQKRLQSARAELTRLTGLEFDVTVEQRANLGRVNVELNKIKKTAWKLSNTIIDSVEIIRKQNQGAGNQELIQSCFAFATEFGKRSLMYLEPTRRSMNHGKLVRLGVDWVAFVCDDCDAADRRTFKWAVAALEFAMAITHGHSILSLSDEDYQLLRAKVAGCMSTLISHFDIMGARSTLAAKAEKLQLLSGKLDLSKAMDDAEAEQAVHEQRYLRVAELEQARAELDSKRRPLGRVLEGVNEADRSLTVLSSSATNVTLRWQQGQFIGGGTSGSVYAAIDLDTSYLMAVKEIKLQEPSVIPGVAQQIRDEMAVLEVLDHPNIVSYRGIEVHRDKVYIFMEYCSGGSMATLLEHGRIEDETVIMVYALQMLEGLAYLHQAGIVHRDIKPANILLDHNGVIKYVDFGAAMIIARQGKTLAAMDQYGGNHKDATKEPHAQRKNQKSVTGTPMYMSPELVRGEVGHAGGRHGSMDIWSLGCVILEMATGLRPWAGIDNEWAIMYKIAQGNQPHLPTPDQLSELGIDFIKRCFELDPAKRPSAVELLQHEWIVTIRRQVVAEPPTPSSEVANSQTSSSTSSRQNSSMF

SEQ ID NO: 10890 - protein, 282 aa, Kluyveromyces lactis
MSDSPEYELTYKVGVAENNNSKFRKTMEDVHTYVENFASRLDWGYFAIFDGHVGSEASKWCGANLHRYLEQKILEDEARDLRDVLNDSFVHADNEINNALKGNSGCTAAVCVLRWEIPDTTVPSEDETINLQQHKRMLYTANVGDTRVVLFRNGNSIRLTYDHKASDILELQRVENAGGLIMKSRVNGMLAVTRSLGDKFFDSLVVANPFTTSVEITTSDQFLIIACDGLWDVIEDHEACEMIKDINNPNEAARVLVRYALENGTTDNVTVMVIFLDTSQEN

SEQ ID NO: 10891 - protein, 436 aa, Archaeoglobus fulgidus
MRVVVIGGGAAGMSAASRVKALQPEWEVTVFEETNFVSHAPCGIPYVVEGLSDPSHLMYYPPEFFREKRGIDLHINAKVVEAGDGFVRVIEDGQEKTYEWDKLVIATGALPKTPPFEGLELENVFTVRHPVQAAELREAVEKAENVVIVGAGYVGVEMAEAAAARGKKVTVVEFLDQPLPNLDRDVADLVKHKLEEKVNLRLGEKVEAFEGDGAVRKVVTDKGEYPADVVIVATGVKANTAIAEQIGCKIGETGAIWTDSRMQTSVENVFAAGDCAETTHMLTKKRVWIPLAPPGNKMGYVAGVNAAGGNIEFPGVLGTQLTKFFDLEIGATGLTEKAAKAEGFEVKTAVVKAKTRVHYYPGAKDTFLKVVADASTKRILGAQVLGADVAMRVNVFAAMIQGGFTTKDVFFADLGYAPPFTPIWDPIVVSARILKF

SEQ ID NO: 10892 - protein, 689 aa, Oryza sativa
  misc_feature (326)..(326): Xaa can be any naturally occurring amino acid
GGHFHAGNLATIYYEQGQLDIAIRCYNQAIICDPQFVEAYNNMGNALKDAGRVEEAINCYRSCLALQANHPQALTNLGNIYMEWNLISAAASFYKAAISVTSGLSSPLNNLAVIYKQQGNYADAITCYTEVLRVDPTAADALVNRGNTFKEIGRVNEAIQDYIQAGTIRPTMAEAHANLASAYKDSGHVETAIVSYKQALRLRPDFPEATCNLLHTLQCVCDWENRNAMFRDVEEIIRKQIKMSVLPSVQPFHAIAYPIDPMLALEISCKYAAHCSLIASRFGLPSFVHPPPVPVKAEGKHCRLRVGYVTTDFGNHPLSHLMGSVXGMHDRDNVEVFCYALSQNDGTEWRQRIQSEAEHFVDVSAMTSDMIARIINQDKIQILINLNGYTKGARNEIFALQPAPIQVSYMGFPGTTGAAYIDYLVTDEFVSPTCYSHIYSEKLVHLPHCYFVNDYKQKNRDCLDPVCPHKRSDYGLPEDKFIFACFNQLYKMDPEIFDTWCNILKRVPNSALWLLRFPAAGETRVRAPAAARGVRPDQIIFTDVAMKNEHIRRSSLADLFLDTPLCNAHTTGTDILWAGLPMITLPLEKMATRVAGSLCLATGLGEEMIVSSMKEYEDRAVDLALNPAKLQALTNKLKEVRMTCPLFDTARWVRNLERAYYKMWNLYCSGRHREPFKVIEDDNEFPYDR

SEQ ID NO: 10893 - protein, 261 aa, Xylella fastidiosa
MRTMTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 10894 - protein, 420 aa, Desulfitobacterium hafniense
MGNMDYIKEWILPQDPEVAEAIAQEEQRQRYKIELIASENFVSRAVMAAQGSVLTNKYAEGYPGKRYYGGCEYVDIVEDLARERVKKLFGAEHANVQPHSGAQANTAVYFAMLKPGDTVLGMNLSHGGHLTHGSPVNISGMYYNFVAYGVDQATERIDYDVVRQLALEHRPKLIVAGASAYPRQIDFARLREIADEAGSYFMVDMAHIAGLVAAGLHQNPVPYAHFVTTTTHKTLRGPRGGLILCQEEFAKAIDKAIFPGIQGGPLMHVIAAKAVAFGEALKPEFVEYQKRIVENAKVLSETLAEKGFRIVSGGTDNHLMLVDVRSKGLTGKEAEYILDEVGITVNKNTIPYDPASPMVTSGIRIGTPAVTSRGMDTLAMKKIAAAIDIALSEPNEAGAAKARDMVAALCAEYPLYPNLD

SEQ ID NO: 10895 - protein, 496 aa, Leuconostoc mesenteroides
MTEQNKRPYQKSRNNNGKKPYYGKNFDPRKSGAPRGNTSEGVNVRVGQNFPLTIKRLGINGEGIGYFKRKIVFVPGALPDEVAVVKVTEVEPKYIAAKVLKIREKSPDRVKPLDEFADSVGGFELEHMNYPAQLRFKKDVLVQSLEKFQPKGWSNYDIRDTIGMDHPYEYRNKAQFPVRKIGDKLSVGMYKRGSHDLVDLPVVHTQTPATMKVMRTVRELLDKLSVSIYNEDKNRGTVKTIVARVSQTTSEVQLTFITNTDGFPGDTALIEAINQALPEVTGIFQNYNPGRTSLVWGEETLKLWGKDYIEEKVLGKTFQLSPRAFMQLNHTQMSVVYNQALAALDLTHADKLVDAYAGVGTIGLSLADKAGEVRGMEIIPEAVDDANQNATLNHISNAHYEVGTAEKLFPKWQSEGWIADALVVDPPRTGLDTALRREILRTQPEKFVYISCNASTLARDLVDLSKAYQVDYIQSIDMFPQTARWEGVVKLTKRQK

SEQ ID NO: 10896 - protein, 282 aa, Brucella suis
MIAKSKVALPVMEPGHVWLVGAGPGDPGLLTLHAVNALQQADVIVYDALVDDSCLSLKNATATLEYAGKRGGKPSPRQRDISLRLVELARQGKKVLRLKGGDPFVFGRGAEEALTLVEYHVPFRIVPGVTAGVGGLAYAGIAATHRDINQAVTFLTGHDATGAMPDGVDWAGIARSSPVIVMYMAMKHIGLIAGRLIEAGRSPDEPVAFVCNASLPDQTVLETTLGRAAIEVEAAGLQPPAIVVVGEVVRLRAGLDWIGAMAGKSLVSDPLGKRTQQGVQSA

SEQ ID NO: 10897 - protein, 542 aa, Ipomoea nil
MAFGLSSLLQNSDLFTSDHASVVSMNLFVALLCACIVLGHLLEENRWVNESITALIIGLCTGVVILLLSGGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSRVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQMPSGHSSMTTSEPSSPKHFTVPLLDNQPDSESDMITGPEVARPTALRMLLRTPTHTVHRYWRKFDDSFMRPVFGGRGFVPFVAGSPVEQSPR

SEQ ID NO: 10898 - protein, 362 aa, Haemophilus influenzae
MQPTLFIDRDGTLIDEPKTDFQIDSLEKLKLEPKVIPALLRLKAKYRFVIVSNQDGLGTDAFPQTDFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQVWLDEAGVNEIKTGVGFFDHMLDQIATHGGFRMNVQCKGDLWIDEHHTVEDTALALGQALKQAVGDKRGIARFGFVLPMDECKAECALDLSGRPWIKFNACFKRDKVGDFSTELTEHFFQSLAFSMLATLHLNVTGNNDHHKIESLFKAFGRTLRQAIRIEGNEMPSSKGVL

SEQ ID NO: 10899 - protein, 179 aa, Haemophilus influenzae
MKKHHVDVLISENDVHARIAELGAQITKFYQEKQIDNLVVVGLLRGSFMFMADIVRQINLPVEIEFMTTSSYGTGMTTNHDVRITKDLDGDIKGKHVLIVEDIIDTGYTLEKVRDILNLREPASLTICTLLDKPSRREVEVPVEWVGFEIPDEFVVGYGIDYAQRHRNLGYIGKVVLEE

SEQ ID NO: 10900 - protein, 172 aa, Oryza sativa; identical to SEQ ID NO: 379

SEQ ID NO: 10901 - protein, 225 aa, Thiobacillus denitrificans
MKRPIAAVLVRRVAAAAAFALVAAPGAAGATSLPDPAVDIPLAKTGGTATAVLAGGCFWGVEGVFEHVKGVKRVVSGYSGGEAGTARYERVSSGDTGHAEAVRVEYDPARISYGQLLKVFFSVAHDPSQRDRQGPDIGRQYRSAIFYATPEQRRVAEHYVSQLQKADAFSRPLATELVPLRAFYDAEAYHQDYLVRHPTQPYIVIHDLPKIAELKRRFPTLYEDD

SEQ ID NO: 10902 - protein, 604 aa, Coprinopsis cinerea
MSHPPAPDTTSPALSLVGTTLPEDFDPTSFDSVTVARGWFSMFQSAVANQSIPGAVMGLFIPEATGIQVWWRDMLALTWDFRTFIGHSKIRRFATDRLFGPTAQFEVDLHDLELVTAESDSALPPAFIQPEPDFAWIQLFFSFKTKSGLGSGIARIVPVGVTDANGLQDAKNWKAHTIYTNLEALAGHPEAIGLFRNQQLDHGDWELSRRKEIDCEGEAQKPVVLIVGAGHNGLAVAARLKMLGMKSLIIEQSERVGDGWRNRYGALCLHQPIWNQDLPYLPFPPNWPLYVPAAKMSNWLEHYAEIMELNVWLSSSIRDIRQDPDSQKWDVSIVRKLKGVDGTVLEETRRFHAVHHLILAIGEGNGLPEIPHIEGLHKFKDNGGVVLHSTEYKRASEYAGKRVIVVGASSSAHDICAECYRNNIGLYSENSRMQTQEIAELDKCLLARLHKAGFKTNLGVLEAGFTYIIPTGGGALYLDSGACNLIADGKIKLKSDSQIKEFTERGLIFEDGSELEGDVVVFATGHGNSRERLRHLLGDDLAARFTGLWGLDEEGEIIGAWRDVGIERLWCMRGGFVFGRFFSKHVALQIKAQEEGLFGQRYRV

SEQ ID NO: 10903 - protein, 429 aa, Coprinopsis cinerea
MSMEFPDIPSGLFPTLRVLGTTLPPEFDASAIDAKEIAREWFLEFQHASSQPDPSALVNLFLPESTGVQVWWRDMLALTWDFRTFVGRDAIRNFALDRVVGAAARSEVKMEDLRLAETTSKDALGPVFKRPSPDMAWIQFFFRFKTVSGIGSGIVRVVPVGVSSVDGLSDAGNWKAHTIYTNLEGLIEHPEAVGSLRNQEPSHGHWESNRRKEVECEGAGVEGKPTVLIVGAGQCGLALAARLKMLGLKSLIIEQNERVGDNWRNRYEALCLHDTVWMDHMPYLPFPPNWQVYTPATKLANWLEHYAEIMELNVWLSSSTQRVAQDPETKKWDVTIVRKVRRADGTTTDVVRHFSAIPHLVMATGSGSGIPEIPLIDGMDIFKAHGGTVLHSTQHKRAADHQGKKVVVVGACTSAHDICADYHYNNIGK

SEQ ID NO: 10904 - protein, 330 aa, Yarrowia lipolytica
MSLENPNTLPFNDPETSPKTALVTGASSGIGWYTTLHLYMHGWDVFLGVRNVLKGQKAIDDIKAEAQKRQLDGSIPATAKFGQLAIVEMDLLDIKSLDKVEAQLQNTEKLDLLIHNAGIMAVPRENSKDGWEVQMQTNYVAPFVLTDRLLDLLQKAPKPRIVYLSSIGHHFAMKPAPLDKRQDGFPGLYYGFVRYGYSKTAGMQLINQLAKDYPHILSMSVHPGFVMETELYRHWNSLPLVGPLFNLGFRSFGVVFGVSKEEGCYSTLVAALSPNLTAPTDSGEFLWTKGSEGNPSSLVKDEKYALKNWNWTVDQMEQKNVRIRHFQHKR

SEQ ID NO: 10905 - protein, 182 aa, Unknown
  Burkholderia sp. 383
MSTIYDIPVNAIDGAQTTLRPYEGKVLLVVNVASKCGLTPQYEGLEALYEGKRAEGLEVLAFPANNFKGQEPGTDAEIQSFCTGTFGVKFPLFSKISVIGDDKHPLYRSLTQAQPQATGDGPFRTRLEGYGIQPNPAPEVLWNFEKFLVSRTGEVVARFSPDTTADDPKLVAAIDAELAKAA

SEQ ID NO: 10906 - protein, 557 aa, Zea mays
MALSACPAQEELLQPAGRPLRKQLAAAARSINWSYSLFWSISSTQRPRVLTWTDGFYNGEVKTRKISHSVELTADQLLMQRSEQLRELYEALQSGECDRRAARPVGSLSPEDLGDTEWYYVICMTYAFLPGQGLPGRSSASNEHVWLCNAHLAGSKDFPRALLAKVPEDPDLINRATAAFREPQCPIYSEQPSSNPSADETGEAADIAVFEGLDHNAMDMETAGIAVFEGLDHNAMDMETVTAAAGRHGTGQELGEADSPSNASLEHITKGIDEFYNLCEEMDVQPLEDAWIMDGSNFEVPSSALPVDGSSAPADGSRATSFVAWTRSSQSCSGEAAAVPVIEEPQKLLKKAVAGGGAWANTNCGGGGTTVTAQENGAKNHVMLERKRREKLNEMFLVLKSLVPSIHKVDKASILAETIAYLKELQRRVQELESRRQGGSGCVSKKVCVGSNSKRKSPEFAGGAKEHPWVLPMDGTSNVTVTVSDRDVLLEVQCLWEKLLMTRVFDAIKSLHLDALSVQASALDGFMRLKIGAQFAGSGAVVPGMISQSLRKAIGKR

SEQ ID NO: 10907 - protein, 282 aa, Oryza sativa
MEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVFPSFGERYLSSVLFESIKREAENMVFEP

SEQ ID NO: 10908 - protein, 487 aa, Unknown
  Synechococcus sp. PCC 7002
MTTSFQTIGLSDARVDLLENIGFEKPTEIQSKAIPAILEGRDVVGLSQTGTGKTAAYSLPFLEKIDLEQKTVQGLILTPTRELAVQVTQSLKEFAVDRRLWVLTVCGGQSMERQIRSLQKGVHIVVGTPGRVIDLLERGKLSFEELRWAVLDEADEMLSMGFIDDVKKILRQSPKTRQTVCFSATMPPAIRDLVENFLNDPINITIKQPQVTPDRIAQEVYMIPRGWSKTKALLPILEMANPESAIIFVRTKRTASELTNELVEAGQSADEYHGDLNQNQREKLVRRFKDGKIKMIVATDIAARGLDVENLSHVINFDLPDNTESYIHRIGRTGRAGKTGTAIALVEPSDRRLLRQIERRVKQSLKVSTIPSRTEVEAQRVTRLETQVREALAGERMASFLPIVKRLGDEYDPQAIAAAVLQMMYDNNSPEWLNEDWEVPEVNTKTGLPKPTKKGGRSGRRSNYKGSGGGYKGDRSRGRRSYSSNHS

SEQ ID NO: 10909 - protein, 97 aa, Solanum lyratum
ATYKVKLITPEGPVEFNCPDDVYILDSAEENGHDLPYSCRAGACSSCAGKITAGNVDQSDNSFLDDDQVAEGFVLTCVAYPKSNVTIETHKEDDLVG

SEQ ID NO: 10910 - protein, 97 aa, Solanum lasiocarpum
ASYKVKLITPDGPIEFNCPDDVYILDRAEEEGHDLPYSCRAGACSSCAGKIVDGSVDQSDNSFLDDDQIGGGFVLTCVAYPKSNVTIETHKEEALVG

SEQ ID NO: 10911 - protein, 97 aa, Solanum abutiloides
ATYKVKLVTPDGPVEFECPDDEYILDRAEEEGHDLPYSCRAGSCSSCAGKIAAGSVDQSDGNFLDDDQIADGFVLTCVAYPQSDVTIETHKEEELTA

SEQ ID NO: 10912 - protein, 496 aa, Mycobacterium avium
MSSPAVPDHHTLIIGAGFSGIGAAIKLDKAGLPDYRVIEAGDGVGGTWHWNTYPGIAVDIPSFSYQFSFEQSRHWSRTYAPGRELKAYAEHCADKYGIRSRIRFNTKVLAAEFDDEQRLWRVQTDPGGEVTARFLISACGVLTVPNLPDIDGVDSFAGITMHTARWDHGQDLRGKRVAVIGTGASAVQVIPEIAPIVSSLTVFQRTPIWCFPKLDVPLPAPARWAMRFPGGKALQRLLSQAYVELTFPISAHYFTVIPLAKRMAALGRAYLRRQVRDPAVREQLTPRYAVGCKRPGFHNGYLATFNRDNVRLVTEPIDKITPDAVATTDGETHEIDVLILATGFKVMDPDSVPTFAVTGSGGRSLSRFWDEHRLQAYEGVTVPGFPNLFTVFGPYGYVGSSYFALIEAQTHHIVRCLKRAQRLGATRVEVSEEANDRYFAEMMRRRHRQIFWQDSCRLANSYYFDKNGDVPLRPGTTPEVYWRSRRFDLDDYRFTG

SEQ ID NO: 10913 - protein, 130 aa, Unknown
  Shewanella sp. MR-7
MSEFLEILTHGRRFKAAVKDLSVEELRDLAAKLDKILVERESMAAEEQQAIAARNAKIEEIRQQMEAVGLSIDDLGGVAVKAVGKKRAPRPAKYQIEVNGEVIQWTGQGRMPTVFKNEVNKGRSMDDFLI

SEQ ID NO: 10914 - protein, 551 aa, Archaeoglobus fulgidus
MNVVVIGGGAAGLKAASRIRRKDGDASITVVEAGKYVSLGRCGLPYYVGGLVHEVDNLRETTYGAVRDEAYFKKLKNIDVLTETVATEIDRSRKTVKIVRNGSEDELNYDYLVIATGARPAKPPIEGIEAEGVVTLTSAEEAEKIIEMWEEGAEKAVVIGAGFIGLESAEALKNLDMEVTVIEMMDRVAPAMLDREMAVLVENHLREKGVNVVTSTRVEKIVSQDDKVRAVIANGKEYPADVVVVATGIKPNSELAEKAGLKIGETGAIWVDEYMRTSDESIYAGGDCVETTCLVTGKKIIAPFGDVANKQGRVIGENITGGRAVFPGVIRTAIFKVFDFTAASAGVNEQMAKEAGLDYFTVIAPSPDRAHYYPQANYIRLKLIVEKGSWRVIGAQGVGMGEVAKRIDVLSTAIQAGMTIDQLANLDLAYAPPYSPALDPVITIANVAMNKRDGLFEGINVFELKEKLEKEDIVILDVRSEEEFKTRRIESEKVIHIPILELRERLDEIPRDKEIVVVCAIGLRSFEASRILKHAGFEKVKILEGGMAFWF

SEQ ID NO: 10915 - protein, 167 aa, Triticum aestivum
  misc_feature (6)..(6): Xaa can be any naturally occurring amino acid
  misc_feature (9)..(10): Xaa can be any naturally occurring amino acid
  misc_feature (12)..(12): Xaa can be any naturally occurring amino acid
  misc_feature (15)..(15): Xaa can be any naturally occurring amino acid
  misc_feature (19)..(20): Xaa can be any naturally occurring amino acid
  misc_feature (26)..(27): Xaa can be any naturally occurring amino acid
  misc_feature (30)..(30): Xaa can be any naturally occurring amino acid
  misc_feature (34)..(34): Xaa can be any naturally occurring amino acid
  misc_feature (37)..(37): Xaa can be any naturally occurring amino acid
  misc_feature (47)..(47): Xaa can be any naturally occurring amino acid
  misc_feature (49)..(49): Xaa can be any naturally occurring amino acid
  misc_feature (52)..(52): Xaa can be any naturally occurring amino acid
  misc_feature (58)..(58): Xaa can be any naturally occurring amino acid
  misc_feature (62)..(62): Xaa can be any naturally occurring amino acid
  misc_feature (68)..(68): Xaa can be any naturally occurring amino acid
  misc_feature (85)..(85): Xaa can be any naturally occurring amino acid
  misc_feature (89)..(89): Xaa can be any naturally occurring amino acid
  misc_feature (92)..(92): Xaa can be any naturally occurring amino acid
  misc_feature (96)..(96): Xaa can be any naturally occurring amino acid
  misc_feature (100)..(100): Xaa can be any naturally occurring amino acid
  misc_feature (108)..(108): Xaa can be any naturally occurring amino acid
  misc_feature (110)..(111): Xaa can be any naturally occurring amino acid
DQNLAXFAXXNXETXDIVXXYQNFSXXLYXLFEXYYXHFHANPQNFXHXKFXSSHSNXVHAXDQLRPXKNKASSSSQFVKKMMAXLPYXCQXQSPXPYFXLSIFRYDXKXXVYPAICKKKNENRGETPPCLIHIGDDKTQTRAGDSNLCAVYHSTQKSFSYPAICDM

SEQ ID NO: 10916 - protein, 490 aa, Haemophilus ducreyi
MTSAELLMNVTPSETRVALVEDGLLKELHIEREAKRGLVGNIYKGRVTRVLPGMQSAFVDIGLEKAAFLHASDIVSHTECVDESEKKQFVVKDIAELVREGQDIIVQVVKDPLGTKGARLTTDITLPSRYLVFMPENSHVGVSQRIESEQERNRLKALVEPHCDELGGFIIRTAAEDVSEESLRQDSIFLKRLWRKILERKAKYPARSMLYGELALAQRILRDFVGTQISAVRIDSKQTLEQVTDFLNEFMPELTESVTLYNGSHTLFDYGVEEAIQKALDKRVNLKSGGYLIIEQTEAMTTIDINTGAFVGHRNLADTIFNTNIEATQAIAHQLQLRNLGGIIIIDFIDMQQEEHRERVLEVLREALKNDRVKTNVNGFTQLGLVEMTRKRTRESLERVLCCDCPVCNGRGTVKTIETVCYEILREIVRVHYLYSSEKIRVYASKEVAEYLINEETHASLAELEAFIGKKVEIKLEPYYHQDQFDVVVM

SEQ ID NO: 10917 - protein, 335 aa, Glycine max
MADESVVESPVKRQRDDGEENGVSVSMDVEGGKDPLSNGLSSVIPGWFSEISSMWPGEAHSLKVEKILFQGKSEYQNVMVFQSSTYGKVLVLDGVIQLTERDECAYQEMITHLPLCSIPNPKKVLVIGGGDGGVIREVAHHSSVEKIDICEIDKMAVDVSKQYFPDVAVGYDDPRVTLHIGDGVAFLKEVPEGTYDAVIVDSSDPIGPAQELFEKPFFSSVAKALRPGGVVCTQAESIWLHMDIIEDIVANCRQIFKGSVNYAWTTVPTYPSGMIGFMLCSTEGPPVDFKHPVNPIDENESQKSVRPLKFYNSEIHTAAFCLPSFAKRKIGSKAN

SEQ ID NO: 10918 - protein, 99 aa, Prochlorococcus marinus
MASYKVTLISESEGLNSTIEVPDDQYILDAAEEQGVDLPYSCRAGACSTCAGKITTGTVDQSDQSFLDDDQLEAGFVLTCVAYPSSDVTINTHAEEELY

SEQ ID NO: 10919 - protein, 632 aa, Desulfotalea psychrophila
MTTVSTDVTGSTDTASSIDAAVPSAPVAPAAPVAPAAPVAPVAPVAPVAPVAPAVSFTDFNLKSDLVANLVKLGFSQPTPIQEKAIPLLLAGSDLIGQAQTGTGKTAAFGLPLLNNIDFSKKCVQALVLAPTRELAQQVGDALATYSGDDGRNVLVVYGGSSYQAQVGGLRRGARVVVGTPGRLLDLIRQGSLKLDQLKTLVLDEADEMLSMGFIDDIETILSQTPKDRQTMLFSATLSSRVMSIANRYLHSPESISISPKQMIGSSIEQRYYLINNSDKIAAITRVFEVETVESALIFARTRATVSELANELISRGFAAEGLSGDLSQEARTRVLSRFKKGQIKVLVATDVAARGLDIDDISHVFNYDLPEDPEVYVHRIGRTGRAGRSGTAISLVTLRDRWMHRRIEQYTGKKLIKGELPTVEQIEEHRNTQFLERLDVWIRRGRCRGEREIVEALVEQGMDPLDVAAAALKIVRKDETKRPIDPIKPVIEDAGGRNRKRGDRNDRGANGRGDRGGRSDSRGGRPQGRRDDRFAKGGDRGPKKKGDDVRQVSDKDMVPLTLDAGKKDGVAVNHIVASLSHFAGISSRELGKIRINETHSSIDVPKGLVDKMLSHNGSYRISKKAVNLTHQ

SEQ ID NO: 10920 - protein, 1117 aa, Oryza sativa
MAVASASALFSAKNLPHKPWEDPSFFRWRKREAHVPLRSHDTPEGALKYWHERRNVNYLNSDSAVWNDDAVRGALESAAFWSKGLPYVQTLSGYWKFLLASSPESVPEKFYDAYFNDSDWEALPVPSNWQMHGFDRPIYTNVTYPFTMNPPFVPNDNPTGCYRTVFRIPKEWKGRRILLHFEAVDSAFFAWVNGVPVGYSQDSRLPAEFEITDFCHPCDSEKENVLAVQVMRWSDGSYLEDQDHWWLSGIHRDVLLVSKPQIFITDYFFKATLDEGFRVADIEVEVEIDSQKQDREHVSTLSIEATLYDNYGPADVLTSDMSAASVANLKLKPASRPKHCYGFHGYVLGGKVENPKLWSSEHPNLYTLVVVLKDSNGKLIECESCQVGIRNVVLAHKQMLVNGCPVVIRGVNRHEHHPRVGKTNLEACMIKDLVLMRQNNINAVRNSHYPQHPRWYELCDIFGLYVIDEANIETHGFDESSHFKHPTLEPFWASAMLDRVVGMVERDKNHACIIVWSLGNESSYGPNHSAMSGWIRGKDPTRPIHYEGGGSRTSSTDIVCPMYMRVWDILKIAQDPSENRPLILCEYSHAMGNSNGNIDAYWMAIDNTVGLQGGFIWDWVDQGLLKEDADGSKNWAYGGDFGDTPNDLNFCLNGIVWPDRTIHPAVHEVKYLYQPIKITMMDNMLKIENVHFFETTEALDFSWLLQGDGCALGSGSLNVPSIAPQSTHLINMKSSPWFTIWSTCVVKEIFLSINVKLRYQTQWAKDGHILASAQICLPPKKGFVPHAIALPRSSLVSERVGDHVLISKSNAWQIKVNSISGTIDSWKVNNIELMSKGIHPCFWRTPTDNDKGGFYTKPYVSRWREASLDNISFYSSQFSLKELPDQTVEISTIYYGLPGNQPKPDETSLSDESESVLFRVQMRGRIYDSGDVILDYEVSPKNDLPPLPRVGVVFNADKSLSRAKWYGRGPFECYPDRKAAAHVGVYESGVDELHVPYIVPGECGGRADVRWVALQDADGFGLFASAYGESPPMQVSASYYGAAELDRATHNHKLVKGDDIEVHLDHKHMGLGGDDSWSPCVHEQYLLPPARYAFSVRLCPLLPSSSCHDIYHSQLPC

SEQ ID NO: 10921 - protein, 1151 aa, Eubacterium cellulosolvens
MLHIKKNGLARKILMCGLSLTMAFSGVSMMPASAEAAKNSSYDYGDALAKSLLFYQLQESGKLSEETKSRCNWRDDACVNDGQPYGIDLSGGWNDAGDNVKFNLPAAYTGMMLAWSYLNNPKAYETSGQEKWMLHDLKWVNDYFVKCNPDSKTYWYQCGDGGLDHNYWAAVETIETRMPDRECYKVDDTSAGGGSAVEAETSASLAAASMAFEKSDPKLAATYLEHARTLFDMAWKAKSDKGYTAANGFYNSWSGFWDELALSACWLYNATGEEEYLDKAKEAATHFGYEFQGNSGPIAYNWPLGWDDVHLGAEYWLAKFTGEKQYYEVLENNMDYWLGEKTANKTLQTTPNGLVVCDTWGSIRYACNEAFTMMLYGQLPKADATRAAKGEKFAESQINFALGSGGRSYQVGYDETSPRDVHHRTAHGCWRNKFSDIPEHNRHVLVGAVVGGPSSSDESTYIDTRDNYQTNEVADDYNAGFTAVAAMMYEKYGQGKKVKDPDAIEEPDGQEWVVDEAINGFDNTNKINFVELKVVVNNRTAWPAVVTDKLVLREYFDLSDIIAQGIDPKDMTVEAKYQQRPVTMKPFEYSGLEGIYYTDMDMTGDVVYPGGQSESKQEVQFRVSAPGKWDYSNSPCLMGLEGTDNSHMGTAQGCVLYSDGEIVYGQEIGENNPIPSPLPTKAPTKAPTKAPTPTPDPSKPTPTPDPNARTGEPGEVSGSQVPKALQGDMVEVFFKNEKGTNIDAHQCRIGDTVKPAEWITTNSYHEKNGWGSQVETYRFIGWRSSTTGNIYASDKIPTVTEPVSYYATFEDVNATPTPTKKPTTKPTATPKPTATVKPTTKPTTKPTATPKPTATPTKAPTQKPGKATVKIVGKNLELQGKIGVAVYADVTGVNAEDVYVVTTVNGEEISSEVEAYDDGLTVTTFVKPKELHDEITLEFRNAADDSVIKLKDGSTYLSYSVADIAKLYQNKTYSKETRELAEAIVNYGSYAQKLLKYNTSSAKVTDTLSDVTKDDVADYKAVTSGKVAGLTYMGPGLTLNADTVLDVYFRISDGYDLDDYSFTVDGKKIKPVDAGSGYCCVEIEGIKAKDLGKVYNVSVKKGSSTFTVKASVLSWSDTVLGGKTSDAATVNMAKMVYRYSEKANAYFAANE

SEQ ID NO: 10922 - protein, 413 aa, Bacillus halodurans
MSTLQSKDPKVFEAVQQELGRQRDKIELIASENFVSEAVMEAQSSVLTNKYAEGYPGRRYYGGCEYVDIVEDLARDRAKEIFGGEHVNVQPHSGAQANMAVYFTILEHGDTVLGMNLSHGGHLTHGSPVNFSGIQYNFVEYGVDKESQRIDYEEVRRLAKEHQPKMIVAGASAYPREIDFAKFREIADEVGAYLMVDMAHIAGLVAAGLHQNPVPHSHFVTTTTHKTLRGPRGGMIICNEEFAKQIDKSIFPGIQGGPLMHVIAAKAVAFGEALQPEFKSYGEAIIRNAKRLGEKLTSEGIDLVSGGTDNHLLLLDLRSLGLTGKVAEKALDDVGITTNKNTIPFDPESPFVTSGIRIGTAAVTSRGLDEEAMDEIGATIALTLKNVDNEEKMNEARERVDALTAKFPMYPNL

SEQ ID NO: 10923 - protein, 318 aa, Haemophilus influenzae
MSDIKHAKLLILGSGPAGYTAAIYAARANLKPVLVTGLQQGGQLTTTDEIENWPGDFEMTTGSGLMQRMLQHAEKFETEIVFDHINRVDLSSRPFKLFGDVQNFTCDALIIATGASARYIGLPSEENYKGRGVSACATCDGFFYRNKPVGVIGGGNTAVEEALYLANIASTVHLIHRRDSFRAEKILIDRLYKKVEEGKIVLHTDRTLDEVLGDNMGVTGLRLANTKTGEKEELKLDGLFVAIGHSPNTEIFQGQLELNNGYIVVKSGLDGNATATSVEGVFAAGDVMDHNYRQAITSAGTGCMAALDAERYLDAQEA

SEQ ID NO: 10924 - protein, 441 aa, Arabidopsis thaliana
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRWINGQPL

SEQ ID NO: 10925 - protein, 612 aa, Magnaporthe grisea
MGSISQSNDAPKQVKRGHASLQPIYTLQRTLSVIVIGAGASGLLLAYKIQRNFDDFELEVFEKNPDVTGTWYENRYPGCSCDVPAHNYTWSFDPKPDWSANYAGSKEIYNYFKSFAVKNNLEKYVRLRHKVTGARWDDGEAFWRVEVEDLATGKVLNKTCDVLLNAGGILNDWKWPDIPGLKSFSGDLVHSADWPEQGLDLAGKRVGLIGNGSSGIQILPAIKDMVGSLVTFIRSATWITPVFGEGTQQGGEHRSFSDEEKQAFARDPAAHLEFRRGFEASSNAIYAVFQAGSVEQIRMREITEQKMRDKIRDPELERILVPDWAVGCRRLTPGTGYIEALSDGKVQVVCAQVAEVTPTGVVCDDGRGEYPLDVLICATGFDTTYKPRFPLRGTSGADLARMWKDEPRAYFGIAVDHFPNYLMTLGPNSPVGNGPVLINIEAQADYIVKMMAKFQKENLRSFRMRSDAVREFNEWKDEYMKETVWADSCRSWYKGNTITGKVVGLWPGSTLHYLEAIKEPRWEDWILEREAGTNRFGYLGDGHSTIETQGLDYAYYLRNHDDSPVDPVLKKPKRTQQPDGAAVDESDRARSGFLPNGGAEDGVNGGVAVAVA

SEQ ID NO: 10926 - protein, 146 aa, Coprinopsis cinerea
MAPKPASTAGKAPVSTASKAPAKPAEGAKAAKKTSKPASGADGDKKKRKKVRKETYSSYIYKVLKQVHPDTGISNKAMAILNSFVNDIFERIATEASKLASYSKKSTISSREIQTAVRLILPGELAKHAISEGTKSVTKFSSAGAK

SEQ ID NO: 10927 - protein, 135 aa, Streptococcus thermophilus
MTVNTRKQPTQPLWVWIRRRILMKKIEAIIRSDKLEDLKNTLTGNGLTKGMTVSQVLGHGTQRGFAEFVRGQRIVPTLLAKVKVEIVVKDLAVDEVVDTIRSAVATGEVGDGKIFIVPIDDVIRIRTGERGGDAI

SEQ ID NO: 10928 - protein, 695 aa, Zea mays
  misc_feature (166)..(166): Xaa can be any naturally occurring amino acid
GDEPEGSDSQRQRKRYHRHTPRQIQQLEAMFKECPHPDENQRAALSRELGLEPRQIKFWFQNRRTQMKAQHERADNCFLRAENDKIRCENITMREALKNVICPSCGGPPVAEDFFDEQKLRMENARLKEEVNHELTTTRCLRRRRLVAGLSVSLSVYCCIFYVSEXCASFSRVTGAQLDRVSSITSKYLGRPFTQMPPVPTMSVSSLDLSVGGMPGQGLGGPSLDLDLLSGCSSGLPYHMPAPVTEMERPMMVDMATRAMDELIRLAQAGEQIWVQGMPGDAREVLDVATYDSLYAKPGGAFRPPEINVEGSRDSGLVFLSAVALVDVFMDTNKWMEFFPGIVSKAQTVDVLVNGLCGRSESLIMMYEELHIMTPVVPTRELSFLRYCKQIEQGLWAVADVSLDGQRDAHYGVPSRSRRMPSGCLIADMSNGYSKVTWVEHLEIEHMLPINVLYRNLVLSGAAFGAHRWLAALQRACERFASLATLGVPHHDVAGVTPEGKRSMMRLSQRMVSSFCASLSSSPLQRWTLLSGTTDWDVLSHGNQVQEVSRIPNGSNPGNCISLLRGLNANQNSMLILQESCADASGALVVYSPIDIPAANVVMSGEDPSGIPLLPSGFAILPDGRPGSSGAGASSSAVPLAAAPPPPGCVVTVAFQILVSNLPSSRLNAESVATVNSLIGTTVQQIKAALNCAGP

SEQ ID NO: 10929 - protein, 165 aa, Unknown
  Magnetococcus sp. MC-1
MPRSLFFELSVGNLEMSESLIATCAGCGTGNRIPTNKAGFNARCGKCGEPLNRVGPDFPVTVGELQFHDEVLHSPMPVLVDFWAPWCGPCRQMSPLLADFAREMAGRIKVVKVNTDDNRILANQFNIRSIPTLMLFDHGQLKDQVSGSMTLPALRDWINRILEIS

SEQ ID NO: 10930 - protein, 341 aa, Williopsis saturnus
AGVAKFAKYPLTFGPSPISNLNRLSQHLGSKVNVYAKREDCNSGLAFGGNTLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 10931 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIISTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 10932 - protein, 480 aa, Rhizobium leguminosarum
MMMPPRTEQLSVFPAFFRVEGLKTAVFGNGDEAFAKVRLLLNTKARIIAYADRPEADYHAFLIANRIETVRAAFSAEQVEGSALVFAATGNETDDRSIVDAARATRIPANAVDQPDYCDFFTPALVNRAPVAVAIGTEGAGPVLAQMIRAQIDQLLSPSLGRLAGLATSYRKAVEQLIPRGVSRRVFWRRFFSGAVADAVANGNLPQARHAADRLLHAMDKVAGHVWLVGAGPGAEDLLTLRAQRVMMEADVIVYDALVPQAIVDMGRRDAERLSVGKRKGCHSKSQEEINDLLVDLGRQGKRVVRLKSGDPLVYGRAGEEMAALRAADVTYEVVPGITSAFAAAADFELPLTLRGVASSLVFTTGHDLTGDVLPDWASLAVSGATIAVYMGRTVAASVAERLMQAGIPSETTVAVIENASRADRRLLHGTLADLPDLQRRDELTGPVMVIIGDAVAGANFELSEPLVRANARLEELARS

SEQ ID NO: 10933 - protein, 166 aa, Lycium chilense
IKVGDSIETVRFFHCYKRGVDRVFVDHPMFLEKVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIMGRKIN

SEQ ID NO: 10934 - protein, 210 aa, Oryza sativa
MAGRAWRLQDLHLQGSQAGPPRHRHLLQGHVHHELLHQRHHKSSSHTQRNPRREKQPSMAPKAEKKPAAKKPAEEEPAAEKAPAAGKKPKAEKRLPAGKGEKGGAGEGKKAGRKKGKKSVETYKIYIFKVLKQVHPDIGISSKAMSIMNSFINDIFEKLAAEAAKLARYNKKPTITSREIQTSVRLVLPGELAKHAVSEGTKAVTKFTSA

SEQ ID NO: 10935 - protein, 253 aa, Bacillus cereus
MAARQAADRKFDVVIAAGGDGTLNEVVNGLVGHEHRPKFGIIPVGTTNDFARAIGVPRSIEEAADIICEGKTVPLDLGRANDTYFINIAGGGRITELTYEVPSKLKTVLGQLAYYLKGIEMLPSLHPTYVEIEYDGKLLQEEITMFLITNTRSVGGFEKVAPYASINDGLFDLLVLKKGSIADLIKAATQAQRGEHINNPKVLYTQANRIKVHSPDKLMINLDGEYGGDAPMEFENIYHCLELFVPEHQEDAL

SEQ ID NO: 10936 - protein, 397 aa, Oryza sativa
  misc_feature (168)..(168): Xaa can be any naturally occurring amino acid
  misc_feature (181)..(181): Xaa can be any naturally occurring amino acid
MGTPETSREPCPDRILDDVGGAFGMGAVGGSLFHFLKGTYNSPNGERLVGGAQAVRMNAPRVGGSFAVWGGLFSAFDCTMVFMRQKEDPWNSIIAGAATGGFLSMRQGPGAAGRSALMGGMLLALIEGAGLMLNRVLATPPPLPVDDPNLPAVMGGGGGIPGIPQVPXAPPEVASSSGGGXSGWSGTCSGKKEEEKKASPSGGKSEMLESFDTPSTPIPTFEYNKKARPSMERDPCPDRILDDIGASFGMGAVGGSFFHFVKGLRNSPSGARFAGGMEGVRMNAPRVAGGFAVWCGLFSACDCALVSVRQKEDPYNSIIAGAATGGILAARQGLRAVARASLQGAVLLALVSSFGIMMNRLPDAGSMPVNKTETCKEPQMPETFDVPSTPPPSFEYK

SEQ ID NO: 10937 - protein, 358 aa, Lycium chilense
  misc_feature (107)..(107): Xaa can be any naturally occurring amino acid
YDQYKDAWDTSVAVEIKVGDSIETVRFFHCYKRGVDRVFVDHPMFLEKVWGKTASKIYGPKVGQDYVDNELRFSFLCQAALEAPRVLNLNCSKYFSGPYGEDVLFIXNDWHTALIPCYLKSMYQSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKRIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 10938 - protein, 761 aa, Unknown
  Magnetococcus sp. MC-1
MNREELLSKLALARQQGLKALDLSSLELTELPDEIGLCSNLESLDLSDNRLTTLPVALGHLDRLQLLDLRDNQLTDLPENLVKLQRLAFLRLGNNHLSKLPNVVCRLSGLRRLVLRGNRLSSLPPELGALTQLQELALHDNLLTALPETIDRLLHLETLLLPGNQLQTLPESFARLPALKRLDLARNRIMDLPPELGGLRHLAWLDLHHNSLPVPEAILDEVQEPSKIIAAYHKALASERRHLDEAKLMVLGDRGTGKSSLVARLLDGRFVADMHPTEGVSLRTWRFSDGQRRLRLNLWDFSGADHYFAAHPYFITPQGLILLVMDGAEPEPERRLARWMRIIRSLAGRQASVALICHRADRFPLELDWNEIRQRYPSIKVAVRRASSMTGEGIESVQQAITKLLDTFEPAQALYWRSWLDTKAIVEEINESHIPYRFYQALCRERGIHDGDQQEQLANRMHLLGSAVYFRNHPLAGSTDDLLDPAWLTQALYRPLGSKRIRDNGGVLERKELGQILDPGLHGSSKHALVLTWLRRFQICFPLLEEPGEEQAQAPHVERFLFPDLLPVNYTSVGMSRETLDFSYHYDHLPPALMGRLLVRFYPFLHSRTCWRDGLLLASEGGGNRALIQMDREAGTLRMRIWGQPKMRAVFLALLRLSLERLNSIWSDFEVQEKVPLAITGAEDVGYRHLHAMQKAGLERFLPVGVTEPIAISPLLETLELPPAPPPESRPLPNKPGRVTLKQRLQQRRMQAHEPTATPTH

SEQ ID NO: 10939 - protein, 108 aa, Rhodopirellula baltica
MASEAVKEFNDDNFDSEVLKSDSPVLVDFWAPWCGPCRQIAPMIDELASENPGVKIGKVNIDDNPGAAQKFGINSIPTLLLFKNGEIADTFVGVRPKAALQDALTSVS

SEQ ID NO: 10940 - protein, 358 aa, Lycium chinense
  misc_feature (102)..(102): Xaa can be any naturally occurring amino acid
YDQYKDAWDTSVAVEIKVGDSIETVRFFHCYKRGVDRVFVDHPMFLEKVWGKTASKIYGPKVGQDYVDNELRFSFLCQAALEAPRVLNLNCSKYFSGPYGEXVLFIANDWHTALIPCYLKSMYQSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQILVLGTGKKKFEQEIEKLEVLYPDKAKGVAKFNVPLAHTITAGADFMLVPSR

SEQ ID NO: 10941 - protein, 840 aa, Oryza sativa
MAAAVAMPSGSGSDGGGGGFDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTLQNPLRDASNPSGLLTIAEETLTEFLSKATGTAVDWVPMPGMKPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLTSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNARKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAQLISSGFRVIPLNMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 10942 - protein, 326 aa, Streptomyces avermitilis
MSDKIALSTWPTPLEPMPRLAAALGLGENDLWIKRDDLIGLGGGGNKVRKLEWTVGAALAAGADTLVTTGAAQSNHARLTAAAGARLGLDVVLVFPGTPDSATHGSGNLVLDSLFGARVHWAGDGGPSTMGDVADEVCRQLRRDGARPHLIPFGGSSPLGARGYVEGGEELRSQLPDVDHVVVALGSGGTMAGLVGALGEQRVLGVHCGAVAEPAATVADLAGPLTRRSITPESLRLRTDQVGAGYGVLHEPVLEAMRTAAGTEGIVLDPVYSGRAMAGLIAAVRDGDIRPAQRTVFLHTGGLPGLFGHTETVQRSVSTLRSYEVE

SEQ ID NO: 10943 - protein, 181 aa, Gluconobacter oxydans
MTTQQSSILLGAGCFWCVEAVFSGLRGIISAEPGYAGGSVDNPSYEAVCTGRTGHAEVVKVVFDPAEIGLEDVLRVFFTTHDPTQLNRQGNDVGTQYRSVIFGDATQQETARRVRAEIESEGIWPDPIVTSIEGPAHFWPAEEKHHDYFARNPQTAYCAAVVAPKVAKARKLYRDRLKQPD

SEQ ID NO: 10944 - protein, 386 aa, Glycine max
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGTHTDVPAPDMGTGPQDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHECDPRMGAFTLAVNRVARATVLRGWEA

SEQ ID NO: 10945 - protein, 358 aa, Lycium ciliatum
  misc_feature (92)..(92): Xaa can be any naturally occurring amino acid
  misc_feature (158)..(158): Xaa can be any naturally occurring amino acid
YDQYKDAWDTSVAVEIKVGDSIETVRFFHCYKRGVDRVFVDHPMFLEKVWGKTASKIYGPKVGQDYVDNELRFSFLCQAALEAPRVLNLNCXKYFSGPYGEDVLFIANDWHTALIPCYLKSMYQSKGIYLNAKVAFCIHNIAYQGRFPFSDFSLLNLXDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKRIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 10946 - protein, 94 aa, Brassica napus
MSSSRRSRQASSSSRISDDQITDLISKLRQSIPEIRQNRRSSTVSASKVLQETCNYIRNLNKEADDLSDRLSQLLETIDPNSPQAAIIRSLINE

SEQ ID NO: 10947 - protein, 253 aa, Pseudomonas syringae
MSAKVWLVGAGPGDPELLTLKAVRALHEADVVLIDDLVNPAVLEHCPGARVIAVGKRGGCRSTPQAFIHRLMLRYVRQGKCVVRLKGGDPCIFGRGGEEAQWLQEHGVAVELVNGITAGLAGATQCGISLTLRGISRGVTLVTAHTQDDSTLNWQALAQGGTTLVVYMGVAKLAEIRESLLAGGMSGEMPVAMIENASLPWQRECRSTLNAMQQDAAAFQLKSPAILVIGAVAAYSNELLNQTLMDHAQLNAS

SEQ ID NO: 10948 - protein, 398 aa, Arabidopsis thaliana
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSSCDHMVPKKETRLKLTIRKKDHEDQPHPLHQNPTKPDSDSDKWLMSPKMRLIKKTITNNKQLTDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKRSNGGEKYNHSPPMVAKAKKCKIKEEEEKEMEAETVAGDSEISKSTTSSNSSISSNKFCFDDLTIMLSKSSAYQQVFPQDEKEAAVLLMALSYGMVHG

SEQ ID NO: 10949 - protein, 151 aa, Vibrio parahaemolyticus
MQKTTRTMPAHKHVALVAHDNCKPELLRWVKENKEKLQRHFLYATGTTGHMLSKETGLAIKSMISGPMGGDQQLGALISEGKIDVLVFFWDPLNAVPHDPDVKALLRIASVWNIPVATNRATAKFLFDSPLLEQEVDIEVPDYEAYLAERM

SEQ ID NO: 10950 - protein, 344 aa, Lycium cinereum
  misc_feature (76)..(76): Xaa can be any naturally occurring amino acid
EIKVGDSIETVRFFHCYKRGVDRVFVDHPMFLEKVWGKTASKIYGPKVGQDYVDNELRFSFLCQAALEAPRVLNLXCSKYFSGPYGEDVLFIANDWHTALIPCYLKSMYQSKGIYLNAKVAFCIHNIAYQGRFPFSDFSLLNLPDEYRSSFDFIDGYEKPIVGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 10951 - protein, 251 aa, Mesorhizobium loti
MSANLFDLSGRQALVTGSSQGIGLALAKGLAQAGASVILNGRDTAKLAATAAQIPGAQTLAFDATEHDAVRSAIDNFELSGGPIDILVNNAGMQFRTPLEDFPADAFERLLQTNVASVFHVGQAVARHMIRRGRGKIINIASVQTALARPGIAPYTATKGAVGNLTKGMATDWAKHGLQCNAIAPGYFDTPLNAALVADPAFSGWLEKRTPAGRWGKVEELVGACVFLASDASSFVNGHILYVDGGITASI

SEQ ID NO: 10952 - protein, 906 aa, Pseudomonas syringae
MNSLALHTPRITASTCCYCGVGCGVLIEHDGEHILGVSGDPKHPANFGKLCSKGSSLHLTGDIEARALYPELRLSKGLARSVTHWDTALEHAANVFAQTIREHGPDSVAFYISGQLLTEDYYAFNKLARALIGTNNIDSNSRLCMSSAVAGYKRSLGADAPPCSYEDIELSDCVMIVGSNMAYAHPILFRRLEEAKNHRPQMKLIVIDPRRTDTCELADLHLAIQPGTDVALFHGILHILMSERLIDPAFIAAHTQGYEELATLVHDYPPEHVAALCGITLEQLHTCARWVGEAPAFLSLWCMGLNQSTAGSAKNSALINLHLATGQIGKPGAGPFSLTGQPNAMGGRETGSLSNLLPGHRDAANPQHRQEVADYWGVDSLPASPGLSAIELFEQMQNGTIKALWIACTNPAQSLPDQNRIRQALETCPFVVLQEAFKTTETARYADLLLPAASWGEKEGTVTNSERRISNVRKAIQAPGEARSDWAITVDFAQRLQQRLQPDAPALFDFATPKALFDEFKGLTVGRDLDMSGIDRELIDQQGPQQWPFPRGASSGTQRLYSEGIFPTDSGRAQFLSEPYIAARELRDADYPLTLNTGRLRDQWHGMSRTGTAARLFGHVSEAVLSINPQDMLSHDLQPGDLVKLISRRGELLLPVSSEDSVAVGQAFVPMHWGDRFLKGGVNVLTQPAFDPISKQPELKHAGVRIEKAHLPWQFFALVEGNVQQRMETLRALCDTFTYLSMGLAGRGRPALVIRAASAEAPDSALLQQIDRVLGLDEGPVMAYDDPKRSIGKRVRIDDDRITAIRLAGETLARHWLQTLWLEERVEASLRRWLLAPLSSEPGKDSTQTRDKTLCNCMNVSQNAVMSAIERGLDLNQLKTQLGCGTQCGSCVPEIRRLIHTVAVTE

SEQ ID NO: 10953 - protein, 594 aa, Schizosaccharomyces pombe
MTKDAESTMTVGTYLAQRLVEIGIKNHFVVPGDYNLRLLDFLEYYPGLSEIGCCNELNCAFAAEGYARSNGIACAVVTYSVGALTAFDGIGGAYAENLPVILVSGSPNTNDLSSGHLLHHTLGTHDFEYQMEIAKKLTCAAVAIKRAEDAPVMIDHAIRQAILQHKPVYIEIPTNMANQPCPVPGPISAVISPEISDKESLEKATDIAAELISKKEKPILLAGPKLRAAGAESAFVKLAEALNCAAFIMPAAKGFYSEEHKNYAGVYWGEVSSSETTKAVYESSDLVIGAGVLFNDYSTVGWRAAPNPNILLNSDYTSVSIPGYVFSRVYMAEFLELLAKKVSKKPATLEAYNKARPQTVVPKAAEPKAALNRVEVMRQIQGLVDSNTTLYAETGDSWFNGLQMKLPAGAKFEVEMQWGHIGWSVPSAMGYAVAAPERRTIVMVGDGSFQLTGQEISQMIRHKLPVLIFLLNNRGYTIEIQIHDGPYNRIQNWDFAAFCESLNGETGKAKGLHAKTGEELTSAIKVALQNKEGPTLIECAIDTDDCTQELVDWGKAVAPPTPVLLPLITRLKRTLFGKNMLHLDYKNYLDIRNT

SEQ ID NO: 10954 - protein, 234 aa, Glycine max
MAGSSINRGERWSLNGMTALVTGGTRGIGHSIVSDLAAFGAAVHTCSRTQTELNKCLQEWQSQGFQVTGSLCDVSSPPQREKLIQEVASTFNGKLNIYLAYPLLKASEKGSIVFISSVAGVVSLGTGAVFAASKAAINQLTKNLACDWAKDNIRSNCVVPWATRTPVVEHLFKDQKFVDDIMSRTPIKRIAEPEEVSSLVNFLCLPAASFITGQVICVDGGLTVNGFQPSMRIT

SEQ ID NO: 10955 - protein, 309 aa, Prochlorococcus marinus
MTATNLKNRNSNWTISDIPNLDGKTVFITGANSGLGYYTAKALAEKNAHVVLACRTLEKANSALHKLKSLNPEGKFTPIELDLADLNKVSEIGSKISTEFEKLDLLINNAGIMHPPKTLSPQGFEIQFAVNHLAHMLLTLKFLPLIEKQKGSRIVTVTSGAQFFGKVGWNNLKAENYYNKWESYANSKLANVMFALELNEKLEQKHILSLAAHPGIAKTNLFSAQKPKPNPIEIFSLELFSPIFQSAEMGALPQLFAATSPQAKGGEHYGPKFNFRGHPKLSPASPFATNKKERKSLWEKSMEILSNFL

SEQ ID NO: 10956 - protein, 321 aa, Triticum aestivum
  misc_feature (290)..(290): Xaa can be any naturally occurring amino acid
MAIPLVLVLLPLGLLFLLSGLVVNTVQAVLFLTIRPFSKRLYRQINVFLAELLWLQLIWLVDWWAGIKVQVYADPATWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAISQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDKHIATGXFDEEIIPIGRPVKSLMVKHNQGTILCNIINF

SEQ ID NO: 10957 - protein, 727 aa, Ashbya gossypii
MDTLLASKKTQGECAEEGANSAATGSTVSAGIYGSENEQTSYEYREPAWWRKALYDLFLWIFIRVFDGFFREVRTRNGYRVPRHGPIIFVAAPHANQFVDPVVLMGQVKQTVGRRVSFLVAAKSLTRRAVGTFARCAMSIGVMRAQDNLQSAPGRIRVDPSNPRRLLGEGTRFTAFQEKGLIGLPKSLGNVDIESIQSDTELTLRKEFKMQKPEVRSLLEHGTSFKYAAKVDQSQVYHRVFEHLAHNQCIGIFPEGGSHDRTDLLPLKAGVAIMALGCMHIHPDVNVKIVPCGLNYFHPHKFRSRAVVEFGTPIEIPPHLVAKYGNPTTNKEAVKELLDTITEGLKAVTLTCSDYETLMVIQATRRLYAGHLSSKLPLPLVVEMNRRLLKGYEAFKDDPRIKRLKEDIMVYNDHLRQYNIPDHQVETARLNLSRNIGLLISRSLRLLFIGMLALPGVVMFSPVFILAKHISKKKAQEALSASTVKIKAKDVVATWKILISIGVAPALYIFWSLLFVWYLRDSYTKDRFLVSFVVAYLCSCILTYSALLAEDIGMDIFKSLRPLYLSLTTPKGLQSLQEERCVLAERIAELVNLLGPQLFPDFDTELLKKKYFATSVSLEDEEDRKTQELKRRRLLRKKKEAAAMVPSPIQATDSDEITVADDESDAVSMVNSDNSLSNIPLFSSVHRSESASSVSTMSSTFNYDFDVKQGNIGGKIIDAVRQNRKEE

SEQ ID NO: 10958 - protein, 602 aa, Zea mays
  misc_feature (177)..(177): Xaa can be any naturally occurring amino acid
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDRILAFSQDVVSGXGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVQNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 10959 - protein, 561 aa, Neisseria meningitidis
MSMENFAQLLEESFTLQEMNPGEVITAEVVAIDQNFVTVNAGLKSESLIDVAEFKNAQGEIEVKVGDFVTVTIESVENGFGETKLSREKAKRAADWIALEEAMENGDILSGIINGKVKGGLTVMISSIRAFLPGSLVDVRPVKDTSHFEGKEIEFKVIKLDKKRNNVVVSRRAVLEATLGEERKALLENLQEGSVIKGIVKNITDYGAFVDLGGIDGLLHITDLAWRRVKHPSEVLEVGQEVEAKVLKFDQEKQRVSLGMKQLGEDPWSGLTRRYPQGTRLFGKVSNLTDYGAFVEIEQGIEGLVHVSEMDWTNKNVHPSKVVQLGDEVEVMILEIDEGRRRISLGMKQCQANPWEEFAANHNKGDKISGAVKSITDFGVFVGLPGGIDGLVHLSDLSWTESGEEAVRKYKKGEEVEAVVLAIDVEKERISLGIKQLEGDPFGNFISVNDKGSLVKGSVKSVDAKGAVIALSDEVEGYLPASEFAADRVEDLTTKLKEGDEVEAVIVTVDRKNRSIKLSVKAKDAKESREALNSVNAAANANAGTTSLGDLLKAKLSGEQE

SEQ ID NO: 10960 - protein, 551 aa, Zea mays
  misc_feature (104)..(104): Xaa can be any naturally occurring amino acid
  misc_feature (126)..(126): Xaa can be any naturally occurring amino acid
  misc_feature (134)..(134): Xaa can be any naturally occurring amino acid
  misc_feature (394)..(394): Xaa can be any naturally occurring amino acid
  misc_feature (473)..(473): Xaa can be any naturally occurring amino acid
  misc_feature (482)..(482): Xaa can be any naturally occurring amino acid
PHKKLPFHYLPNSRASRGSNPGTSQEEEDDAPTMAMATALRKLSANALRRQPLSRITPLYYMASLPATEERSGITWTKQLNAPLEEVDPEIADIIEHEKARQWXKGLELIPSENFTSVSVMQAGGXSAMTNRYXEGYPGAGYYGGKWRLWIWGEVLGVETGFGRAFRFEPGKRGEGKGQPLSGSPANFHVYTALLKPHERIMALDLPHGGHLSHGYQTDTKKISATSIFFETMPYRLDESTGLIDYDQLKKSAVLFRPKLIIAGASAYARLYDYDRMRKICTKQKAILLADMAHISGLVAAGVVPSPFDYADVVTTTTHKSLRGPRGAMIFYRKGVKEINKQGKEVMYDFEDKINAAVFPGLQGGPHNHTITGLAVALKQATTPEYRAYQEQVXSNCAKFAQSLISKRGELVSGGTDNHLLLVNLKNKGIDGSRVEKASERVHIAATKNTVPGAVSPMGPGRPRMGTPTPYVXGFVEEDFAXVADFFDAAVNLALKIKAATTGGTKLKDFVATLQSDSIQVEIAKLRHDVEEFAKQFPTIGFEKETMKYKN

SEQ ID NO: 10961 - protein, 463 aa, Desulfitobacterium hafniense
MENTLIKSIYRDTPAYLNQELQISGWVRTLRVSKSFGFIEINDGSFFKGIQVVFEEDLNNFEEIAKVATGSSLIIKGLLVESPGAKQPFELKAQSIMIEGACSGDYPLQKKRHSFEYLRTIAHLRPRTNTFAAVFRVRSLVAYAIHKFFQDKGFVYIHTPIITGSDAEGAGEMFRVTTLDLDALPRTEEGRIDYAKDFFGKETNLTVSGQLNAETYCMAFRNVYTFGPTFRAENSNTARHAAEFWMIEPEIAFADLQDDMELAEEMMKYLISYVLEHAPEEMAFFNEFVDKTLFDRLDNIVNSDFGRLTYTEAIEILQKEKERFEFPVEWGADLQTEHERFLTEQIFKKPVFVVDYPKDIKAFYMRLNDDQKTVAAMDLLVPGVGEIIGGSQREERLDYLEKRMAELGLHKEDYSWYLDLRKYGGTRHAGYGLGFERVIMYLTGISNIRDVVAFPRTVKNADF

SEQ ID NO: 10962 - protein, 869 aa, Aspergillus oryzae
MAHTQPSPTGGVTPHHGHLAAHPQVNGHMPLQSQGQKGPPMSTAQKIAALNEQVWLQIGGLTELMGDLDGAMNAYEQALRHNQWSIPAMNAISCILRTKEQFPKAIEYLQNILKLDPTSGETWGSLGHCHLMMDNLQEAYTSYQQALYHLRDPKEPKLWYGIGILYDRYGSLDHAEEAFSQVMRMAPDFEKANEIYFRLGIIYKQQQKFNQSLECFKYIVTDPPRPLTEEDIWFQIGHVHEQQKDFDSAQQAYRRVLDRDPNHAKVLQQLGWLYHQQSNSYASQEKAIEYLEKSVSADNTDAQSWYLLGRCYMSQAKYPKAYEAYQQAVYRDGRNPTFWCSIGVLYYQINQYRDALDAYSRAIRLNPYISEVWYDLGTLYESCNNQISDALDAYGRAADLDPTNVHIKARLQLLQSQLSGSNQTNAPAPQPQDVHPQAYQTGVGGPPAPQWGAPAPTGGPPPQPPAPPRQIADWNRGINELQSQAQAQAQAANGFDHRDAVRAPAAIQQPSPRQEPGRGFPDAVRPPPTAARSPKTALAGPGVYAPTHALPQIANPPPAPSHERVPSGASGFPSATRGPLPPAPAGPPPAPGAPNGAPTPGGPLPPYHRPFTPPAEIRPIRDERPSSPGSTYPHQQFHHGPSVPPVQGAGSTGIAGGAPAPPSAITAAEAAAREREDRPASAMKRGREWEAESAPVKKIANEESRARLDEQLPRRVTPPNRMPSPGEMQRRSSSEVRREDQRRINESYHPSEAAHHPPTLPSIQHMPPHASGSGLPPMAEGSTPAANGPQPGPSAPVQVKEEPARGEQPPAHEPAARKMDVDENYDDDGDDDKRASTAVKGSPSASGSGNANNATNGSQTSQSKPESTA

SEQ ID NO: 10963 - protein, 477 aa, Desulfitobacterium hafniense
MTYNREYFYVTSVTLIGTEDGKLKQRRLGGKLNMTYVQEVLEQAVKRNPGEAEFHQALREVLESLEPVLEKRPDLKEAGILERIVEPERQILFRVPWVDDQGKVQVNRGFRVEYNSAIGPYKGGLRFHPSVYLGIIKFLGFEQIFKNSLTGLPIGGGKGGSDFDPKGKSEGEIMRFCQSFITELYRYLGADTDVPAGDIGVGGREVGYMFGQYKRITNRYEGVLTGKGLTFGGSLGRTEATGYGLVYFMEEALKAVGKSFSGATVVVSGSGNVAIYATQKATQLGGTVVAMSDSNGYIYDKDGINLDTVRQLKEVERKRLKDYVSIHPTAEYYEGCAGIWTIPCAIALPCATQNELDGEAAEVLVKNGCYAVGEGANMPSTPEAVDVFLQHKIIYGPGKAANAGGVAVSALEMSQNSMRYSWTFEEVDAKLKNIMVNIYHNASKAAQEFGFEGNLVAGANIAGFLKVAEAMKAQGTV

SEQ ID NO: 10964 - protein, 414 aa, Thermus thermophilus
MRLDTRFLSGFPEALSRHGPLLEEARRRLLAKRGEPGSMLGWMDLPEDTETLREVRRYREANPWVEDFVLIGIGGSALGPKALEAAFNESGVRFHYLDHVEPEPTLRLLRTLDPRKTLVNAVSKSGSTAETLAGLAVFLKWLKAHLGEDWRRHLVVTTDPKEGPLRAFAEREGLKAFAIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVGGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 10965 - protein, 566 aa, Debaryomyces hansenii
MANRRIPKSEDSLSNLPSTASSNQSGSNDFVKKLFQMLQEDTYKDVVKWTSSGDSFVVINTTEFTKEILPRHFKHSNFASFVRQLNKYDFHKVKIPNEEKQSYEYGEDAWEFKHPDFRINDRESLENIKRKSSKKSTQNYNPNVANSGSSVDSFGYQNLKDEMDNLRLENKSLKQDISVLHTKYKTLVENIVSLKSFDEKYYRSMSVLINCLVQAGIKMPPLDFPNPNALYPQKPNVAAHQHSHSHSNSSSLPQLSPPLLSPNGGTGQQGGIGVPLGSGLPAQRFDHNTISQAHTLQHQTPLQTIHSQPNNQQSTKQTPPTNDNLNSKPQSPHLMGESTSGSPLVGNLGLDAASTTAPVNSRTSSISTNRVPQPANGASTDQPQVTTTNLTNPKFHVLLVEDDNVCIQLCRKFLVKYGCQVTIATDGLNAISTVEHTKYDLVLMDIVMPNLDGATATSVIRSFDTKTPIIAMTGNIEDNDLVTYLQNGMSDILAKPFTKDDLYSILSKHLLTSTDSASVTTDEPSETMSSLQGPAQQTLVLPQEVQQQDSNGEPMPEPHSKKPRLI

SEQ ID NO: 10966 - protein, 174 aa, Populus nigra
MAKMSEPLVVGRVIGDVIDHFTANVKMTVTYQSSRKQVFNGHELFPSAVTNKPKVEVHGGDMRSFFTLVMTDPDVPGPSDPYLREHLHWIVTDIPGTTDATFGREVMNYEMPRPNIGIHRFVFLLFKQKGRQTVTTPASRDKFNTRKFAEENELGLPVAAVFFNAQRETAARKR

SEQ ID NO: 10967 - protein, 737 aa, Oscillatoria chalybea
MTDSTKTLCPYCGVGCGLEVSPPARSGKPVNRDSQGYPVWKVQGDREHPSSQGMVCVKGATIAESLHKDRLLYPMMRESLDKPFRRVSWDEALNAIVNRIQTVRFTQGAEAICMYGSGQFQTEDYYVAQKLMKGCLGTNNFDANSRLCMSSAVAAYIQSFGSDGPPCCYDDLDLTDCAFLVGTNTAECHPIIFNRLRKHHKKNNGKVKMVVVDPRRTATAEAADLHLAIKPGTDIDLFNGMAYLLMRWGKIDTIFIDECTSNFPAYCEVIRHYPPEVVARKCGITVEELETAARYWAESERVLSLWSMGINQSSEGTAKARTLINLHLMTAQIGKPGAGPFSLTGQPNAMGGREAGGLSHLLPGYRVVKNARHRSEVEKFWGLPVGRIAPERGLTVWEMILGLEMGKVGLVWIAATNPAVSMPDLERTKKALSRSPFTVYQDAYYPTETANYAHVLLPAAQWSEKTGVMTNSERRITLCQAFRDRPGEAKADWEIFAEVGRRLGFVEQFNFANSAEVYAEFTQLTKGRPCEQTGIGHQRLGADGPLQWPCPEEAGENNAARLYTDLRFHTPDGRAKFAAYHSRGLAEPPDPDFPFVLTNGRLYGHWHTLTRTGRIEKTKQMHPQPFIEIHPRDAGKLGIEDEDWVEVRSRRGMARFPAKVTKAIAPGTVFVPMHWGELWADSAEANAMTHPESCPDSLQPELKACAVQLVPITADIKATNSLLETAKSSMLSATPSV

SEQ ID NO: 10968 - protein, 173 aa, Populus nigra
MANLSDPLVVGRVIGDVIDYFTPNVKMTVTYNSNKQVYNGHELFPSAVTHKPKVEVHGGDMRSFFTLVMTDPDVPGPSDPYLREHLHWIVTDIPGTTDATFGREVVNYEMPRPNIGIHRFVYLLFRQKGRQTVSTPSSRDKFNTRKFAEENELDLPVAAVFFNAQRETAARRR

SEQ ID NO: 10969 - protein, 341 aa, Williopsis saturnus
AGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVFEGKSMQGLIALIKEDYFKPGANVLYVHLGGAPALSAYSSFFPTKTA

SEQ ID NO: 10970 - protein, 373 aa, Streptomyces hygroscopicus
MDGVRAVLLAGGEGRRMGPLGRGRLKPLVPFGGTSRLIDFSIANVHRSGLRDVLLLSQYEERRLMDDLHLVWNGRHRGFRIDFGPYDAVYRHSPGKLPEQLPERTWPLERGTADALLTKAEYVFRQGDAEASEILVLHADHVYRFDYGDMIREHRASKAALTVSYQRIERRYVHLFGMVEFDGDGLLTAFEEKPDDPTSDLVFAAFCLFDAATLRRYLEQLRGTDWQHDISRDVIPAMLAGGELIRGYEVKSYWEDIGTVDRYHRAHRGLLRADPTLALSDMPLTVAPEVPRHLVPGGPGRRASVVAADVANEGEIVSSVVYPGARIGVDAHVVDCVVLPGARVPDGTHLASAIVLEDGSVQQCEAEREEVAL

SEQ ID NO: 10971 - protein, 471 aa, Escherichia coli
TTHLVWFRQDLRLHDNLALAAACRNSSARVLALYIATPRQWATHNMSPRQAELINAQLNGLQIALAEKGIPLLFREVDDFVASVEIVKQVCAENSVTHLFYNYQYEVNERARDVEVERALRNVVCEGFDDSVILPPGAVMTGNHEMYKVFTPFKNAWLKRLREGMPECVAAPKVRSSGSIEPSPSITLNYPRQSFDTAHFPVEEKAAIAQLRQFCQNGAGEYEQQRDFPAVEGTSRLSASLATGGLSPRQCLHRLLAEQPQALDGGAGSVWLNELIWREFYRHLITYHPSLCKHRPFIAWTDRVQWQSNPAHLQAWQEGKTGYPIVDAAMRQLNSTGWMHNRLRMITASFLVKDLLIDWREGERYFMSQLIDGDLAANNGGWQWAASTGTDAAPYFRIFNPTTQGEKFDHEGEFIRQWLPELRDVPGKVVHEPWKWAQKAGVTLDYPQPIVEHKEARVQTLAAYEAARKGK

SEQ ID NO: 10972 - protein, 409 aa, Pseudomonas syringae
MTKLKLVMIGNGMAGVRTLEELLKLSEDLYHITVFGAEPHPNYNRILLSPVLAGEQNFEDIVLNDLDWYQRNGIELLLNRRVVKIDRIKRLVIADDGTQAHYDRLLIATGSRPFILPIPGNTLNGVIGYRDISHTRQMIDTAVTHKRAVVIGGGLLGLEAANGLSLRGMQVTVIHNGQTLLERQLDKTSGRMLQAALEKRGLSFRLDEQTNALLGDDQGRVTAVQFNNGDRIDADLVVMAAGIRPNTELAEQAGLPCNRGILVNDTLQTYDPRIYAIGECVSHRGIAYGLVAPLFEQARVCANHLAQLGFARYPGSVTSTKLKVTGIDLFSAGDFLGGEGTESITLSDPIGGVYKKLVIKNDVLVGACLYGDTADGNWYLQQIRDGQGIDAIRDHLMFGKPAAAQAACA

SEQ ID NO: 10973 - protein, 1205 aa, Oryza sativa
MDSSCRPPSYGPWPNMNHLHPPEFHSCCNHTYPPGYYSFRLPSPQEIPPPHLYYHGPFPQHPNAYPSYFAPPPPYPVDQTACGYDKFKSHCCGCPNHSCHGGERSNIKIEEERPEVNPDTEQRDASGSDIVRHPNYQNQAIWLPSGNMNDKENKKSMELPPQFYNGWIPVSGKWVGDVKQQDQDDQKAKQFQWPIFWMPAGYNEKRQEAKELKEVDESPKVSEEAPPSPKIKIIPLSWFENGHNDQKPSVKDESHHNERSTVKKQSAGTEHQDGREMKNIPLMPKKESEEKKPARENYKTIPVMPRKDNEENKPAGGNYRIIPVMPVKESDDKKPEASVQRDEKKASSTEKEEENGKRSNEESSKAKNSKLPPVCLRVDPLPRKKSGSGSSRSPSPPTRKDADIAKKDVKEIHMQKQDAKQSDPKKERTVSEAKEKAHDEMNKGRAYGNETVQAASVKQMQEEQFPMSLADQKVQATGVNFDAQENVGEKNLQGSDKNTEGEAKIQGEPAKDYDTTPRINFSEVDAAVCIQSAYRGYNVRRWQPLEKLRMIKNVNEQMKDLKEQLQGIEASSKQLTVKEQVAINETIMNLLLKLDTIQGLHPTVREARKSVARELISLQEKLDCLCKQSSGESIHTNGEKEKPEAMENNFQNTDPVSAIEASEKEKAAGVDEEQGLSTINSKLLMPDAVSSVVSMDTTQDADPSDHIEESNTTKEEAPNNGGKVATQCDCQGEPSMDVMGDAALLGHSTEQKQQIEESNAISMDKSCEREKDVPPVGGQEIPSGDHMEPLHDEALSENSNELQQCTTSERSSTVISPAAADNSMITMAATSVESSVSADKVSPVEGQVTEAAVEHAPVEKDQCEEPNTTIVDSGDSSVSLKNEELQDHDQAPSGSSIMSNSAEQPEEASDVNMQQQVENVDTTQDATEESDATPEIGMVDVTYANTENYVQSPLLQTTSKLQSTTGQNVLKEPEAAKQSDVSVEYESVLVGKQNESANNLTGDSAKEEPPLVGLGMEADTHESAPRELKDEPILPETERSELSCEHGDITGHEDSEMYAPPECKTDVQKESCCVDRRRADMQVPKEVECDELGDDNPKEDASVQTENMASEEASLASATPDGMKDENKVAEETTSDYVTPYSSKSDNENKLAEENQKLKEMLQNLLASGSDQMGVITELSEKVKTLERKLARKKRPKDMWQGSGS

SEQ ID NO: 10974 - protein, 214 aa, Diospyros kaki
AFGADLVLTEPTKGMGGTVKKAYELLESTPNAFMLQQFSNPANTQVHFETTGPEIWQDTNGKVDIFVMGIGSGGTVSGVGQYLKSQNPNVKIYGIEPEESNVLNGGKPGPHDITGNGVGFKPDILDMDVMEEVLMVSSEDAVNMARTLALKEGLMVGISSGANTVAALRLARRPENKGKLIVTVHPSFGERYLSSVLFQELRKEAENMQPVAVD

SEQ ID NO: 10975 - protein, 458 aa, Bacillus cereus
MSTKMTPPVEKNEFIDVVFEDLTHDGAGVAKVKGYPIFVKNGLPGEEAQIKIIKVKKNFAFGRLMKLHTESPYRKDAECPVYNQCGGCQLQHLTYEGQLQAKEKQVRDVMQRIGGLGDVPVHPVLGMKTPWVYRNKAQVPIGEREGGLVAGFYRQGTHDIINMESCLIQAEENDTLIQEVKRICEKHGISAYNEERNKGTLRHVMARYGQVTGEIMLVFITRTAELPNKKAIIEEIAAKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDANRNAALNNMTNAEFGVGEAEVVIPKWYKEGVIADTMVVDPPRKGCDEALLNTIIDMKPKRVVYVSCNPATLARDLKVLEEGGYKTQEVQPVDMFPHTTHVECVAWLKLV

SEQ ID NO: 10976 - protein, 578 aa, Debaryomyces hansenii
MTVIELNKALKPSWWKETTVYQVYPSSFQDSNGDGIGDLPGITSRLDYIKSLGVDAIWLSPCFDSPQVDMGYDISDYKKIYPAYGTMEDADELIKGVHERGLKILMDLVVNHTSDQHPWFKKSRSSIENSYRDWYIWRKPRYDSEGNRQPPNNWAAAFGGSAWTFDETTQEYYLHLFAVEQPDLNWENENVRAAVHDIMRFWLDKGADGFRMDVINFISKDQRFPDAEVKHPNAKYQDGSPYFACGPRLHEYLQGIGQILIEYDAFSVGEMPACNDPEEIIKAVNIDRHELNMIFNFELVDIDHGNEGKFTAGSWKLADAYKIINKWQTFMQENGGWNAIYLENHDQPRSVSRFAEDSPEFRKISAKMVSTFLALQQGTLFVYQGQELGLKNVPETWDISNYRDLEVLNHYNELKEDGASPEILKAAMAEYQKKSRDNARYPVQWDTSANAGFSSSTPWIDVNEDYLEWNAAEEEKDPESVLNYWRSILKIRKEWKDILIYGRFEMVTSIEDEKVLAFKRTTSDKSAIVICNFSSDAVLWTIPEEFENSKVILSNYDRSKVSGPSVELKPYEAFTLLK

SEQ ID NO: 10977 - protein, 291 aa, Rhodospirillum rubrum
MKQSFAFSRLGLALPPVEPGWVWLVGAGPGDPGLLTVLAAHALAEADVVVHDALIDGRVLGLAREEAVLIPAGKRGGRPSHSQPDISARLVDLARAGKRVVRLKGGDPFVFGRGAEEARTLVAAGVPFRIVPGVTAGVGGLAYAGIPATTRDTNATVTFVTGHAATGEVPDTFDWEALARLPVLVFYMALKTLDVIAARLMEHGRSGETPVAFVSDATTAAQRVHITTLAQAVTERDRLGIAPPALVVLGDVVPLARDLAWWSPPKQGCGGEVWPDPMQSIPGSATPLIGD

SEQ ID NO: 10978 - protein, 329 aa, Neisseria gonorrhoeae
MKITVIGAGSWGTALALHFSQHGNRVSLWTRNADQVRQMQEARENKRGLPGFSFPETLEVCADLAEALKDSGLVLIVTSVAGLRSSAELLKQYGAGHLPVLAACKGFEQDTGLLTFQVLKEVLPDNKKIGVLSGPSFAQELAKQLPCAVVLASENQEWIEELVPQLNTTVMRLYGSTDVIGVAVGGSVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 10979 - protein, 214 aa, Diospyros kaki
AFGADLILTDPTKGMGGTVKKAYELLESTPNAFMLQQFSNPANTQVHFETTGPEIWEDTCGTVDIFVMGIGSGGTVSGVGRYLKSQNPDVKIYGLEPAESNVLNGGKPGPHHITGNGVGFKPDILDMDVMEEVLMVSSEDAVSMARELALKEGLMVGISSGANTVAALRLARKPENKGKLIVTVHPSFGERYLSSILFEELKKEAENMEPVPVD

SEQ ID NO: 10980 - protein, 520 aa, Unknown
  Mycobacterium sp. MCS
MTTTEPAPPESATGRPSPRWRALLLAAVAACAACGLVYELALLTLSSTIHGGGIVATSLIVAGYVAALGAGALAVKPLLGHAAITFVAVETLLGVIGGLSAAALYVTFAFIGGSTWVLVVGTALIGGLVGAEVPLLMTLLQRGRTAGAADSGRVLANLNAADYFGALVGGLLWPFLLLPHLGMIRGAAATGVINLVAAAVVAVFLLRHIVSGRQLAVALGALSAALVLLVTLLIRADGIETTTRQRLYNDPIVAFARSPYQEIVVTRRGDDLRLYLDGGLQFSTRDEFRYTESLVHPALGQGARSVLVLGGGDGLAARELLRQNQIRDITQVELDPAVIDLARTTLREANRGALDDPRVTVVVDDAMTWLRGVDRTFDAVIVDLPDPDTPVLGRLYSTEFYALVTRALAPDGLMVVQAGSPYSTPTAFWRTVSTIESAGFAVTPYHVHVPTFGDWGFALARRGPTPPAPTVPEGVGPLRFLNQEVLDAATVFSADVARQRLEPSTLEHPRIVDDIRKGYR

SEQ ID NO: 10981 - protein, 358 aa, Lycium europaeum
  misc_feature (48)..(48): Xaa can be any naturally occurring amino acid
  misc_feature (159)..(164): Xaa can be any naturally occurring amino acid
  misc_feature (166)..(166): Xaa can be any naturally occurring amino acid
  misc_feature (168)..(170): Xaa can be any naturally occurring amino acid
  misc_feature (172)..(172): Xaa can be any naturally occurring amino acid
YDQYKDAWDTSVAVEIKVGDSIETVRFFHCYKRGVDRVFVDHPMFLEXVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPXXXXXXFXFXXXYXKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 10982 - protein, 344 aa, Ashbya gossypii
MCRRTSQRNLRMFSHHSHSGEYVAHGADTLEAVVAEALRQGFHTYCLTEHMPRLDEAYLYPEERSGAAARDLRGLAELFGRYVEHAARLRQHVDGMAVLVGMEAEACDRQHVAYAKRLLQDFGSHVQFCVGSVHHVYGIPIDFSQTLWDSALQQAGGNLKRLLADYFDWQYYMLRELQPEVVGHFDLIRLYLPRDRFWVELGTGAVSDTYLGGNWTHIALVSARIVSLWEDVQSRVVRNLEYIASYGGLVEINSAGLRKGLADPYPHRDVALLVKRYAGARFILSDDAHSVSQVGTEYVRTLEYVENVLQLEGLFYLAEASSGPTALEAKYMSLQEIKESRFWK

SEQ ID NO: 10983 - protein, 552 aa, Ashbya gossypii
MSIYINELTGADEAGRGTEEAPFKSAAFGLFAQQDGEEPKVFTYKSDEGAGGYVEISASGLKKARKGAEGLRKAAAKEVEQQRRRAEQEARDAAKKLELMSIKIEEDASLPPAVGLKVGKAHGAVGTRVKVSGWIHRLRMGKAVVFPGAERRYGGTCRPVLSKDLARAYQTSTLTLESTVTLYGTVKQLPEGKTAPGGVELDVDYYEIVSLAPSGDDSFSNRVQEGADPSLLMDMRHLMLRGESLSAVMKVRAAFLRAIRRVYEDEGLLEVTPPCMVQTQVEGGSTLFKLDYYGEEAFLTQSSQLYLETCLPALGDVFCIQESFRAEKSHTRRHLSEYTHIEAELGFVDFDQLLRHTERVITSLVRYVLEDPVAGPLVKQLNPDFVPPQMPFMRLEYKDAITWLNEHGIKNEEGEEFKFGDDIAEAAERKMTDTIGKPIFLTRFPLELKSFYMKRCADDPRVTESFDVLMPTVGEVTGGSMRIDSLDELMAGFKREGVNPEPYYWFSDQRRYGSCPHGGYGLGTERILAWLCNRYPVRDCSLYPRYTGRCKP

SEQ ID NO: 10984 - protein, 67 aa, Saccharomyces cerevisiae
MSTSHCRFYENKYPEIDDIVMVNVQQIAEMGAYVKLLEYDNIEGMILLSELSSRRIRSIQKLIRVGK

SEQ ID NO: 10985 - protein, 957 aa, Hordeum vulgare
  misc_feature (467)..(467): Xaa can be any naturally occurring amino acid
MKIPFVTKWSHRSSEPAGPSNSAAAQQQQPPPLSPSAPSRSPPVASTEAAGDEFILQEEEYQMQLALALSASASGAEGAGDPDGEQIRKAKLMSLGKGDPVTNSDLGGGYTAESLSRRYRDYNFLDYNEKVIDGFYDIFGPSAESSGHGKIPSLAELHMSIGDLGYEVIVVDYKFDNALQEMKEVAECCLLGCPDITVLVRRIAEVVADHMGGPVIDANEMITRWLSKSIEQRTSHQTSLLHIGSIEIGLSRHRALLFKILADMVGIPCKLVKGSHYTGVVDDAINIIKMDNKREFLVDVMAAPGTLIPADVFNSKGTPFNFSQTLGQNQVVESASNIEDDPVALQSEHEHYQGHMFANNDRVSDNLSSYENTMTAGSSASEPGTLGKASTLAGAPSKQKKNLQLIPDSHEIDESRNLFAEFDPFNATESGKSSLAFKGLNNRNSDFRRRRENVVPPSARSQQPLVXKNWSACNDISNNKQYNVADGSVPRRNATDNASSSQLALSTAKHYNPNVRELNDRMYAAPARNYDNRIIGTSAMAKASTGDCLDRSQVPPGLYYDKMLGTSSMNTASSSGIGKVAEKDLQNDLEKGPIYSRFDGELSKNAQGFTPERDEHKENCGSYDHRMLHPDPRKSPLDRFMDRPRQNIECVSPSQVGSSKVDLVLDEVSECEILWEDLVIDERIGIGSYGEVYHADWNGTEVAVKKFLDQEFYGDALEEFRCEVRIMRRLRHPNIVLFMGAVTRPPHLSIVSEYLPRGSLYKIIHRPNCQIDEKRRIKMALDVARGMNCLHTSVPTIVHRDLKSPNLLVDDNWTVKVCDFGLSRLKHSTFLSSKSTAGTPEWMAPEVLRNEQSNEKCDIYSFGVILWELATLRKPWHGMNQMQVVGAVGFQDRRLDIPKEVDPIVASIIRDCWQKDPNLRPSFIQLTSYLKTLQRLVIPSHQETASNHVPYEISLYR

SEQ ID NO: 10986 - protein, 243 aa, Archaeoglobus fulgidus
MGGKVYIVGAGPGNFELLTLKAYRLLQEADVILYDRLVGEEIESFLKTLGKEVVYVGKERGEKGEKRQKEINRLMKKYFEEGKKIVRLKGGDPGIFGRMAEEIEFLVENRIPFEVVPGVSSVNGAPVCSGIPLTEAENAFGFLVVSGSDSGRIRELHEKGTLVILMGGCTAKDVARNLIESGVDADRDVAVIERGSMKNQRVTITKLSELVERDFNFDSPALIVVGDVVRFARVCQNHEDRKI

SEQ ID NO: 10987 - protein, 340 aa, Streptococcus thermophilus
MKKQKIAVLGPGSWGTALAQVLNDNGHEVRIWGNIPEQIDEINEKHTNTRYFKDVILDENIKAYKELSEALDSVNAILFVVPTKVTRLVAKQVAELLDHKVVVMHASKGLEPGTHERLSTILEEEIPSEMRSEIVVVSGPSHAEETIVRDITLITAASKDLETARYVQGIFSNSYFRLYTNSDVIGVETAGALKNIIAVGAGALHGMGYGDNAKAAVITRGLAEITRLGVKLGADPLTYSGLSGVGDLIVTGTSIHSRNWRAGDALGRGEKLEDIERNMGMVIEGISTTKVAYEIAQELGVYMPITTAIYKSIYEGADIKESILNMMSNELRSENEWDKK

SEQ ID NO: 10988 - protein, 427 aa, Avena fatua
WVQNHHLQKKRARVDDELPSPGANPGYEFPAETGAPATSWPMPYQQAYGREAIYPNAAATGQYPFQQGGSTSSVVVSSQPFSPPAPVADMQAANMPWPQQYAAFPGAAPYPMPPPQPLAAAGFGVCPQPLAGVKPSASKEARKKRMARQRRLSCLQHRRSQQLNLGQIQNAMIHPQQEVPFSPRSAHSVPVSPPSPGGWCGLWPPPSVQVQGQGQLMVPNPLSTKPSSSSRQKAQKPSPDAGARPPSSGAQQGAKPGADKNLRFLLQKVLKQSDVGALGRIVLPKKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMPCAEDGGAEAGGCKGKSPHGVRRSRQEAASMNQMAVS

SEQ ID NO: 10989 - protein, 308 aa, Coccidioides immitis
MSLTNCRFYEEKYPEIDSFVMVNVKQIAEMGAYVNLLEYDNIDGMILLSELSRRRIRSIQKLIRVGRNEVVVVLRVDKEKGYIDLSKRRVSAEDVVKCEERYNKSKSVHSIMRHVAEKTRTPIETLYQQIGWPLNKKYGHANDAFKLSITNPSIWDDVTFPSQAVKDELLLHISKRLTPQPTKVRADIEVTCFSYEGIDAVKEALRTAEANNTTDNQVKVKLVSPPLYVLTSHCLDKNLGIKTLEDAIKGITEKIRASGGSCVVQMAPKAVTEEDEADLQALMEKKERENQEVSGDESVSESDDAMVE

SEQ ID NO: 10990 - protein, 426 aa, Avena fatua
WVQNHHLQKKRARVDDELPSPGANPGYEFPAETVAPATSWLMPYQQAYGREAIYPNAAATGQYPFQQGGSTSSVVVSSQPFSPPAPVADMQAANMPWPQQYAAFPGAAPYPTPPPQPLAAAGFGVCPQPLAGVKPSASKEARKKRMARQRRLSCLQHQRSQQLNLGQIQNAMIHPQQEVPFSPRSAHSVPVSPPSPGGWCGLWPPPSVQVQGQGQLMVPNPLSTKPSSSSRQKAQKPSPDAGARPPSSGAQQGAKPGADKNLRFLLQKVLKQSDVGALGRIVLPKKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMPCAEDGGAEAGGCKGKSPHGVRRSRQEAASMNQMAV

SEQ ID NO: 10991 - protein, 554 aa, Roseovarius nubinhibens
MEEFEALLNESFEMDTPEEGSVVKGKVIAVEAGQAIIDVGYKMEGRVDLKEFANPGETPEIAVGDEVEVFLRAAENARGEAVISREMARREEAWDRLEKAYADELRVDGAIFGRVKGGFTVDLGGAVAFLPGSQVDVRPVRDAGPLMGLKQPFQILKMDRRRGNIVVSRRAILEESRAEQRAEVIGNLTEGQAVDGVVKNITEYGAFVDLGGVDGLLHVTDMAWRRVNHPSEILAIGETVKVQVIKINKETHRISLGMKQLQDDPWDLVGAKYPLSSVHTGRVTNITDYGAFVELEPGVEGLVHVSEMSWTKKNVHPGKIVSTSQEVEVMVLEIDAAKRRVSLGLKQTQRNPWEVFAETHPEGTEVEGEVKNITEFGLFVGLDGDIDGMVHLSDLSWDERGEDAIQNYRKGDMVHAVVSEVDVEKERISLSIKAVGGDKFAEAVGGVKRGSIITVEVTAIEDGGIEVEYEGMKSFIRRSDLSRDRAEQRPERFSVGNKVDVRVTNVDSKTRRLGLSIKAREIAEEKEAVEQYGSSDSGASLGDILGAALKGGDE

SEQ ID NO: 10992 - protein, 427 aa, Avena fatua
WVQNHHLQKKRARVDDELPSPGANPGYEFPAETVAPATSWLMPYQQAYGREAIYPNAAATGQYPFQQGGSTSSVVVSSQPFSPPAPVADMQAANMPWPQQYAAFPGAAPYPMPPPQPLAAAGFGVCPQPLAGVKPSASKEARKKRMARQRRLSCLQHQRSQQLNLGQIQNAMIHPQQEVPFSPRSAHSVPVSPPSPGGWCGLWPPPSVQVQGQGQLMVPNPLSTKPNSSSRQKAQKPSPDAGARPPSSGAQQGAKPAADKNLRFLLQKVLKQSDVGALGRIVLPKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMACAEDGGGAEAGGCKGKSPHGVRRSRQEAASMNQMTVS

SEQ ID NO: 10993 - protein, 603 aa, Medicago truncatula
MSDLSSPPSDQLSTVTLSLDEVPKAEFSDRVPIQSIIRREDGGSGLAGKKARIGGWVKTGRKADKDAFAFLQLNDGTCAGNLQVIVEASLADLGQLVLTGTCVVVDGYLKLPPSGEKQNKKIELRADKVLHVGPVDPAKYPLPKLRLTPDKNLEFLRNFVHLRSRTNTISAVARIGNALAYATHTFFNKHGFLYVRTPIVTTSDCEGAGEMFQVTTLFSEAERLEKELIQNPPPTESDVEAAKLVVQEKGEVVSQLKTAEAERLEKEQIQNPPPTESDVEAAKLVAQEKEKEITAAVDELKKAKRNVSKLEERSKLQPSIPRKDGKIDYAKDFFARQAFLTVSGQLQVESYACALSSVYTFGPTFRAENSHTSRHLAEFWMVEPEIAFADLEDDMKCAEAYVKFLCQWLLDNCLEDMEFMADKGCIDRLKMVASTPFIRLTYTEAVEILEEAVKNGTEFENEVKWGIDLASEHERYLTEVKYQKKPVIVYNYPKGEDIKGKAFYMRLNDDLKTVAAMDVLVPNVGELIGGGQREERYDVIQQRLKEMDLPVEPYEWYIDLRRYGTVKHAGFGLGFERMILFATGLKNIRDVIPFPRYPGRADL

SEQ ID NO: 10994 - protein, 428 aa, Avena fatua
WVQNHHLQKKRARVDDELPSPGANPGYEFPAETGAPATSWPMPYQQAYGREAIYPNAAATGQYPFQQGGSTSSVVVSSQPFSPPAPVADMQAANMPWPQQYAAFPGAAPYPMPPPQPLAAAGFGVCSQPLAGVEPSASREARKKRMARQRRLSCLQHQRSQQLNLGQIQNAMIHPQQEVPFSPRSAHSVPVSPPSPGGWCGLWPPPSVQVQGQGQLMVPNPLSTKPNSSSRQKAQKPSPDAGARPPSSGAQQGAKPAADKNLRFLLQKVLKQSDVGALGRIVLPKKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMACAEDGGGAEAGGCKGKSPHGVRRSRQEAASMNQMTVS

SEQ ID NO: 10995 - protein, 722 aa, Oryza sativa
  misc_feature (9)..(9): Xaa can be any naturally occurring amino acid
  misc_feature (48)..(48): Xaa can be any naturally occurring amino acid
  misc_feature (372)..(372): Xaa can be any naturally occurring amino acid
  misc_feature (668)..(668): Xaa can be any naturally occurring amino acid
MSASPSSMXSGAGAGEAGVRTVVWFRRDLRVEDNPALAAAARAAGEVXVPVYVWAPEEDGPYYPGRVSRWWLSQSLKHLDASLRRLGASRLVTRRSADAVVALIELVRSIGATHLFFNHLYGSIDPEFQIDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELXATGWLHDRIRVVVSSFFVKVLQLPWRWGMKYFWDTLLDGDLESDRLGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTXGREGGVVPVWSPPAASGPSDHYAADEADITSRSYLDRHPQSHTLMNWSQLSQSL

SEQ ID NO: 10996 - protein, 385 aa, Triticum aestivum
MEGGDARNGLTGTSQTTGSGVESPAKPLPPCCVKARAAAPESEAKCHATVVSGWFTETRSRCGKASKLQYYNNPMWPGETHSLKVDKILYQGKSPYQEVLIFESLTYGKVLVLDGIVQLTDKDECAYQEMITHLPLCSIPSPKKVLVIGGGDGGVLREIARHGSVESIDICEIDQLVIDVCKDFFPDLSVGFEDPRVRLHVGDAVEFLRNSPEGTYDAIIVDSSDPIGPAQELVEKPFFETIARALRPGGVLCNQAESMWLHTHLIQDMLSICCETFKGSVHYAWASVPTYPSGAIGFLLCAKEGRPVNFLAPINPIEKIEGAMTAGRDIRFYNTEMHRAAFVLPTFAKRELEAYSCSTIGAQQEEKSAEPAKVAVAPHSEILTA

SEQ ID NO: 10997 - protein, 493 aa, Bacteroides fragilis
MEKKLKSWQGWLLFCGAMAVVFVLGLVVSSLMERRAETVSVFNNKRVEITGIEARNEVFGENYPRQYETWKETAKTDFKSEFNGNEAVDVLEQRPEMVVLWAGYAFSKDYSTPRGHMHAIEDITHSLRTGAPMDDKSGPQPSTCWTCKSPDVPRMMEAIGVDSFYNNKWGAFGSEIVNPIGCADCHEPTNMKLHISRPALREAFARQGKDIDKATPQEMRSLVCAQCHVEYYFKGDGKYLTFPWDKGFSVEDMEAYYDEADFADYTHALSKARILKAQHPDYEISQMGIHAQRGVSCADCHMPYKSEGGMKFSDHHIQSPLAMIDRTCQVCHRESEETLRNNVYDRQRKANEIRGRLEQELAKAHIEAEFAWDKGATDVQMAEALKLIRQAQWRWDFGVASHGGAFHAPQEIQRILGHGLDKALQARLAISKVLAQHGYTADVPMPDISTKEKAQEYIGLDMEKERKAKGKFLKTIVPEWLEKARANGRLAKL

SEQ ID NO: 10998 - protein, 435 aa, Zea mays
MDPCPFVRVLVGNLALRMPVAPPAAGAGAGVHPSTSPCYCKIRLGKMPVQSVPAPLVVSDGGEQTPASGALAAAFHLSKADLEWFNGKPSLFSSRGEASLKVSVYAGRKGSACGVSSGRLLGKATIALDLKGAEAKPAVLHSGWISIGKRSGKGSTAATELSLTVRAEPDPRFVFEFDGEPECSPQVLQVRGSMKQPMFTCKFGCRSNSDLRRPGMQPERDAASAKERKGWSVTVHDLKGSAVAMASMVTPFVPSPGTDRVSRSNPGAWLILRPAGDGAWEPWARLECWRERGGAGASDSLGYHFALLVPGADHAVALADSSIPSSNGGKFVIDLTAAQPLSRGGTPGCSPRGSGDLSNWPLGNYRGFVMSAAVQGEGRCSKPTVEVGVAHIGCAEDAAAFVALAAAVDLSMDACRLFSHRLRKELSHLQADLLR

SEQ ID NO: 10999 - protein, 549 aa, Chloroflexus aurantiacus
MRIMMIQPNYHAGGAEIAGNWPPSWVAYIGGALRAAGFDNLRFVDAMTEDLPDEKLRLILRHNRPDVVMATAITPMIYKAQETLKIAREELPNARLILGGIHPTFMYGQVLTEAPWIDYIVRGEGEEIIVELMQAIAYGSDQRDRVKIRGIAYLEDGKVVATPARDPIADLDKLTPDWSLYDWKRYIYVPLNVRVAVPNFARGCPFTCRFCSQWKFWRRYRARSPQKFVDEIETLVRDYNVGFFILADEEPTINRKKFTALCEELIRRQVRVYWGINTRVTDILRDEAQLPLWRAAGLVHISLGTEAAAQMNLDRFRKQTTIEQNKRAIELIKKHGMVAEAQFIMGMENETPETIEETYRYVLDWKPDMANWNMYTPWPFAELFEELGDRVEVRDYAKYNFVTPIMKPDLMDREEVLKGVLRNYARFYMRKAFLEYPFIKDPFKRRYMLGCLRAFMKTTVTRRFYDLGRVHVRGTQLEIDLGFDESRVLTPEQIAALKEHEVLHADTTFGGAAPGIDPEEIKIQAENPLNLPLEAASVNPGSESETRSA

SEQ ID NO: 11000 - protein, 353 aa, Glycine max
  misc_feature (207)..(207): Xaa can be any naturally occurring amino acid
MRLGFASWRFILCTLVVFLILQDSVARKIATTSGNEVQLKEEVSYDLQKLATEGLVLDSIIQLEGADIEKKKHVHKDDDEDEDDRVKKGMGFDKEEDEEEDKDEHKKMVGKDVHGYKPSHEDHKHMDLELNVFFTPNDLKVGKIMPVYFSKKNSSTSPKFLTREEADQIPFSCKHLPSLLKFFSIPQHSPQAKAMKYTLKQCEFEPXEGETKFCATSLESLFDFAHYLFGSNAQFKVLTTVHLTNSTALLQNYTISEVKVISVPNVIGCHPMPYPYAVFYCHSQHSDTNLYEVMVEGENGGRVQAAAICHMDTSKWDRDHVSFRVLKVQPGTSPVCHFFPPDNLVWVPLPLPP

SEQ ID NO: 11001 - protein, 523 aa, Zea mays
MAVTRVAVAAALSAAPLSSRRHRVALPSACRLLPASATCCNSRAPMSLQAAAAAPAAGAVDEETPASSPPSDASKGVENLVIIGSGPAGYTAAIYAARANLKPVVFEGCQMGGVPGGQLMTTTEVENFPGFPDGITGPDLMDRMRKQAERWGAELYQEDVEFVNVKSSPFVIRSSDREVKCHSLIIATGATAKRLRLPREDEFWSRGISACAICDGASPLFKGQVLAVVGGGDVATEEAVYLTKYARHVHLLVRKDQLRASKAMQDRVLNNPNITVHFNTEAMDVVSNDKGQMSGVHLKRRDTGEESVLTVKGLFYGIGHTPNSQLLQGQIELDSAGYILVKEGSAKTSVDGVFAAGDVQDHEWRQAITAAGSGCIAALSVERYLVANDLLVEFHQPVQEETKKDITDKDVQMGFDISHRKHKGQYALRKLYHESPRLICVLYTSPTCGPCRTLKPILSKVIDEYGEFVHLVEIDIEEDPEIAEAAGIMGTPCVQFFKNKEMLRTVSGVKRKKEYREFIEANK

SEQ ID NO: 11002 - protein, 719 aa, Elaeis guineensis
EIPYNIGFLQVATLSLQGNRLTGKIPEVIGLMQALAVLDLSENELVGTIPPILGNLSYTGKLYLHGNKLTGPIPPELGNMTKLSYLQLNDNKLVGTIPAELGKLEELFELNLANNNLEGPIPQNISLCTALNKFNVHGNRLNGSIPLQFQKLESLTYLNFSSNNFKGKVPWELGRIINLDTLDLSNNHFSGPIPDSIGDLEHLLELNLSRNNLNGPLPTEFGNLRSGQTIDISYNKLSGPIPEELGQVQTIDTLILNNNDLYGEIPVQLTNCFSLSSLNLSFNNFSGDVPLSKNFSRFPQESFLGNPMLCGNWLGSSCGQDLHGSKVTISRAAVVCITLGCITLLSMMLVAIYKSSQPKQFIKGSNRTVQGPPKLVVLRMDMAIHTYEDIMRITENLSEKYIIGYGASSTVYKCVLKNSKPIAIKRLYSQYPHNLHEFETELETIGSIRHRNLVSLHGYSLSPHGNLLFYDYMENGSLWDLLHGPSKKVKLDWDTRLKIAVGAAQGLAYLHHDCNPRIIHRDVKSSNILLDENFEAHLSDFGIAKCIPAAKTHASTYVLGTIGYIDPEYARTSRLNEKSDVYSFGIVLLELLTGKKAVDNDSNLHQLILSKADDNTVMEAVDFEVRSPAWIWGCQKAFQLAICAQRSDRPTMHEVARVLVSLLPVPSLKPGLVPQKPMDYAHYLAAGPDVKIKRTHDDNSSSDGQWFLRFGEVISKNTL

SEQ ID NO: 11003 - protein, 874 aa, Chlorella vulgaris
MTVAAAIPDSAPLDVAALKAAAANGNGAVPVTAAPSFCGPPPSEPPLEPSSEDYKLHLPVSEIHAHDAGTKDAWVPRHVDLIRLTGRHPFNCEPKPSRLFESYITPPSLHYVRNHGAVPQIQWEEHRLVVNGLVNKPLTFTMDDILRLPSVDVTCTLTCAGNRRKEENMMKQTIGFNWGPAGTGCSTWTGVRVCDLLQLCGMKSMAEGALHVCFRGPKGELPKGDDGSYGTSITWCKAMDPASDVILAYKQNGRLLTPDHGYPLRLIIPGFIGGRMIKWLQEITVTEVESQNYYHFHDNRVLPSHVDEALANKEGWWYKPDFIINDLNVQSAIGYPAHNEVVPLAGGTYAVRGYAYCGNGAKIIRSELSLDDGKSWRLADVTHSTPPNAYGKHWGWVWWSIDVSIAELLTCPEIICRAWDSSMNTQPNTFTWNVMGMMNNCVYRVKIHPRQTAEGGFALQFEHPTIAGPTVGGWMNRAEDVAAAAAVTVAPPPAPAGAKSFTMAEVEQHTTMESAWFVVDGKVYDATPFLKDHPGGADSILLVAGTDATDEFNAIHSLKAKKQLLEYYIGELAEEGQEAAAPAPATPAPAAAIGTAAPAAANGAAPAAAAPEDLVALNPRKRQSFKLVEKEALSHNTRRFRFALQSPQHRFGLPVGKHVFLYAKVDGELVMRAYTPSSSDDQLGYFELVVKIYFANQHPRFPEGGKMSQYLEGMAIGDFMEVKGPLGHVHYTGRGSYTLDGTPHSASRISMIAGGTGITPMLQVIKAVLKDPEDTTQLSLLYANVSPDDILLREELDALAAEHDNFSVWYTVDKADEGWSFSTGFINEDMVKERLFPAGDDTICCLCGPPPMIKFACLPNLEKLGYKPEQCIQF

SEQ ID NO: 11004 - protein, 541 aa, Zea mays
MGLGVVAELVRLGVLSSTSDHASVVSINLFVALLCACIVLGHLLEENRWVNESITALIIGLCTGVVILLTTKGKSSHILVFSEDLFFIYLLPPIIFNAGFQVKKKQFFRNFMTITLFGAVGTMISFFTISLGALGLISRLNIGALELGDYLALGAIFSATDSVCTLQVLSQDETPFLYSLVFGEGVVNDATSVVVFNALQNFDITHIDAEVVFHLLGNFFYLFLLSTVLGVATGLISALVIKKLYFGRHSTDREVALMMLMAYLSYMLAELFALSGILTVFFGCIVMSHYTWHNVTESSRITTKHAFATLSFLAETFLFLYVGMDALDIDKWRSVSDTPGKSLAISSILMGLVMVGRAAFVFPLSFLSNLAKKTEHEKISWKQQVVIWWAGLMRGAVSMALAYKKFTRAGHTQVRGNAIMITSTIIVVLFSTMVFGLLTKPLINLLIPHRNATSMLSDDSSPKSLHSPLLTSQLGSDLEEPTNIPRPSSIRGEFLTMTRTVHRYWRKFDDAFMRPMFGGRGFVPFVPGSPTERNPPDLSKA

SEQ ID NO: 11005 - protein, 147 aa, Triticum aestivum
  misc_feature (67)..(67): Xaa can be any naturally occurring amino acid
  misc_feature (81)..(81): Xaa can be any naturally occurring amino acid
  misc_feature (95)..(95): Xaa can be any naturally occurring amino acid
  misc_feature (100)..(100): Xaa can be any naturally occurring amino acid
  misc_feature (106)..(106): Xaa can be any naturally occurring amino acid
  misc_feature (115)..(115): Xaa can be any naturally occurring amino acid
  misc_feature (124)..(124): Xaa can be any naturally occurring amino acid
MAAALRSPASAKVSSPAAASKVRQASRVAVGGFRQHPRSRVGPVAVRASLFSPKPAAAKDARPTKVXELYVYEMNERDREXPAYLRLNAKQTENXAGRLXPFTNKXYNGTWDKRXGITAGLLLXQHFPDATATVQASTLFIRFGRAY

SEQ ID NO: 11006 - protein, 979 aa, Bacillus cereus
MNNNMVHITIDGKKYTAEPGSTILGVMNENGIEHPQICYVPEVDPIQTCDTCIVEVDGKLMRSCSTVATEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAISEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQRFIDENVNFFEDFKESLAEYTLEYAEEVTGISQETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDKGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWSYSHPSEIFAEMASLSPLFSQANYEVLEGWNSFHWGSFDGTNTPLLFQDGFNFPDKKARFAIADWVHPAEFPAEFDLHINNGRMLEHFHEGNMTNKSTGIQTKVPGVFVEISPELAKERGVKTGSLVRLVSPFGALKLRALVTDRVKANELYLPMNSTDNETAINFLTGPAVDVRTNTPAYKQTKVRMEVLEVDGENPMPKANPRNKKRHPQAGIEVHRKWARPGYMHLTDK

SEQ ID NO: 11007 - protein, 338 aa, Unknown
  Photobacterium sp. SKA34
MTKNANNTISMAVLGAGSYGTALAIALSRNGANVILWGHDPEHIAQLEIDRANEAFLPSVRFPESLIVTSNLQDAVEGSRDLLVVVPSHVFGQVLSQVKPFLRSDSRVCWATKGLEPETGRLLKDVAVDALGSDIPLAVLSGPTFAQELAAGLPTAISVASPDAEFVADLQEKIHCDKTFRVYSNNDFTGMQLGGAVKNVIAIGAGMSDGIGFGANARTALITRGLAEMCRLGAALGAQPETFMGMAGLGDLVLTCTDNQSRNRRFGLALGAGKSVEQAQQEIGQIVEGYRNTKEVWQLAKRYGVEMPISEQIYQVLYQGKDAREAAKELLAREKKYE

SEQ ID NO: 11008 - protein, 343 aa, Unknown
  Mycobacterium sp. MCS
MRIGVLTGGGDCPGLNAVIRAVVRTCDVRYGSSVVGFQDGWRGLLENRRIQLRNDARNDRLLAKGGTILGTARVHPEKLRAGLDQIKQTLDDNGIDVLIPIGGEGTLTAAHWLSEENVPVVGVPKTIDNDIDCTDVTFGHDTALTVASEAIDRLHSTAESHQRVMLVEVMGRHAGWIALNAGLASGAHMTLIPEQPFDVEEVCRLVKQRFVRGDSHFICVVAEGAKPAEGTMQLRQGGMDEFGHEKFTGVAQQLAIEVEKRVNRDVRVTVLGHVQRGGTPTPYDRVLATRFGVNAADAAHAGEYGMMVSARGQEIGRVSLADATRRLKLVPQSRYDDAAEFFG

SEQ ID NO: 11009 - protein, 249 aa, Magnaporthe grisea
MMPRQAYAPTPHSYVPNTAMSATINLDEEVKLADTRAERDLQDSLAEIFSIIVTIDELEKAFLKDAIPEADYTEICERSLKQYRSILADETVAAAFGDLEEFKAEWDLEVPRATERIRVGMPATAVQASSGPGPSNSHRQSGLQGASGNGSGGAPGGALILEATQDFITFLDALRLGLLAKDQLHPLLTDVIQSVNKVTDRDFENRGKIVQWLITLNQMKATEELTDAQARELELDINSAYQGFKNTLS

SEQ ID NO: 11010 - protein, 544 aa, Methanocaldococcus jannaschii
MRDMCSISGIIVKDNQISAKYSIDMMKILKHRGRDNSGLLLDDEVIYFNDFEDVEDLEEEMIGNLSLAHNRLAIVGRYGVQPIPNEDETIWLVCNGEIYNYIELREYLKQNHEFRTDSDNEVIIHLYEEEKLEELDGDYAFAIYDKSKNVVRLARDMFGVKPLFYVDRDKYFAFASERKALWHLLINIDGCERDLDELNSKIKTLKPNSQLIYYLDDNRFEIIEGFKKLELNYMKERSYEEAKEYLDRALKNSVLKRVRGLDKVGIICSGGVDSSLIAKLASLYCEVILYAVGTENSEDLIYAERLAKDLNLKLRKKIISEEEYEEYVFKVAKAIDEVDLMKIGVGIPIYVASEMANEDGLKVVLSGQGADELFGGYARHERIYRERGEEELKKELLKDVYNLYKVNLERDDHCTMANGVELRVPFLDEEVVEIALSIPIEYKMSELSNRPYAESNISLKSEPINGLKNTNLNIKCVRSVRKKILRDVASQYLPDYIAYRPKKAAQYGSGGEKMIYKVAKKYGFSKKRINEFLDMLKRKIVSEF

SEQ ID NO: 11011 - protein, 121 aa, Brassica napus
MASSMLSSAAVVTSPAQATMVAPFTGLKSSAAFPVTRKANNDITSIASNGGRVSCMKVNISRIIAGLSFITRNWISNMNPLIPYGIHKPKTIYRDLFPHLKGFFEGGPKKLTPTLPLGKES

SEQ ID NO: 11012 - protein, 339 aa, Ashbya gossypii
MGYNETEPAIDGDNNEQRINEDMSTLEHTSNNNGNGLEPVEAGPDSGIPAVEGGGSVSGQSPQHEPPAYELSYVVGVAENKNAKFRRTMEDVHTYVENFASRLDWGYFAIFDGHAGNQASKWCGSHLHTIIEERILQGDDRDVRDILNDSFVYVDQQINSTLEGNSGCTAAVGILRWEAPTPIPNMPINLEQHKRMLYTANVGDTRIILFRNGRSVRLTYDHKASDIIEMQRVEKAGGLIMKSRVNGMLAVTRSLGDKFFDSLVVGNPFTTSVEIPTSDQFLIIACDGLWDVVDDQEACEMIKDIEDANEAAKTLVRHALEHGTTDNVTVMVVFFDNNQ

SEQ ID NO: 11013 - protein, 229 aa, Zea mays
MLRSSFRLLYITRTNLLVRASPSSLSRLPSKFTSAKPLVSSHHQIPLSTTGAKLSRSEHSMAASSEPKSIYDFIVKDAKGNDVDLSTYKGKVLLIVNVASQCGLTNSNYTELAQLYQKYKDHGFEILAFPCNQFGNQEPGSNEEIVQFACTRFKAEYPIFDKVDVNGDSAAPIYKFLKSSKGGLFGDGIKWNFAKFLVDKDGNVVDRYAPTTSPLSIEKDLKKLLGVTA

SEQ ID NO: 11014 - protein, 325 aa, Avena fatua
WVQNHHLQKKRARVDDELPSPGANPGYEFPAETVAPATSWLMPYQQAYGREAIYPNAAATGQYPFQQGGSTSSVVVSSQPFSPPAPVADMQAANMPWPQQYAAFPGAAPYPMPPPQPLAAAGFGVCSQPLAGVEPSASKEARKKRMARQRRLSCLQHQRSQQLNLGQIQNAMIHPQQEVPFSPRSAHSVPVSPPSPGGWCGLWPPPSVQVQGQGQLMVPNPLSTKPNSSSRQKAQRPSPDAGARPPSSGAQRGAKPAADKNLRFLLQKVLKQSDVGALGRIVLPKIVSEGSGDAPAGAQDEGRHLHPHGGHRHLSGLEHAVPVLA

SEQ ID NO: 11015 - protein, 452 aa, Oryza sativa
MGAHRTRQCSLLQLQPLRTCILFLLLLLLLLPCSASSSVITHLPGFHGRLRFYLETGYVSVDEETGTELFYYFVESERSPSTDPVILWLTGGPLCSGFTALVFEVGPMNFVLAPYNGSLPRLVNNQYSWTKIASIIFLDTPVGSGFSYARDPKGYNVGDISSSLQVVTFLKKWFNDHPSYLSNHFYVGGSSYAGKGYMVGSPLTDPKYDRNSIIPYAHGVGIISDQLYEAAVANCKGDYVNPTNEICANVLNAVDNLMSELDNGDILLDKCAGRLIPKPINGVSSRALLEEYSRLSEPTARPTINCFSYRFYLLNIWMNDKATRDALKIKKLESYSTSYNYYQLSWCSGDHDLMVPFLGTQAWIRSLNFTIIDDWRAWHLDGQAAGFTVMYDNNLTFATLKGSGHAPISYKPKQGFAMGQRWLDHYITRWKLNVLTVDGETDFTVKVTGKMK

SEQ ID NO: 11016 - protein, 390 aa, Zea mays
  misc_feature (182)..(182): Xaa can be any naturally occurring amino acid
  misc_feature (262)..(262): Xaa can be any naturally occurring amino acid
  misc_feature (303)..(303): Xaa can be any naturally occurring amino acid
MALQAALLPSTLSSVPKKCSLAVAAKDTAFLSVSQKKVQAASLSVRTRVATTAPVATPGSSTAAKDGKKTVRQGVVVITGASSGLGLAAAKALAETGKWHVVMACRDFLKAAKAAKGAGMADGSYTIMHLDLASLDSVRQFVDSFRRAGMPLDSLVCNAAIYRPTARTPTFTADGYEMSVGXVNHLGHFLLARLLLDDMQKSDYPSRRLVILGSITGNTNTLAGNIPPKAGLGDLRGLAAGLRGQNGSAMIDGSESFDGAKXAYKDSKICNMLTMQELHRRYHEETGITFASLYPGCIATTGXLFREHIPLFRLLFPPFQKFVTKGFVSEAESGKRLAQVVSDPSLTKSGVYWSWNKDSASFENQLSQEASDPEKAKKLWEISEKLVGLA

SEQ ID NO: 11017 - protein, 428 aa, Avena fatua
WVQNHHLQKKRARVDDELPSPGANPGYEFPAETVAPATSWLMPYQQAYGREAIYPNAAATGQYPFQQGGSTSSVVVSSQPFSPPAPVADMQAANMPWPQQYAAFPGAAPYPMPPPQPLAAAGFGVCPQPLAGVKPSASKEARKKRMARQRRLSCLQHQRSQQLNLGQIQNAMIHPQQEVPFSPRSAHSVPVSPPSPGGWCGLWPPPSVQVQGQGQLMVPDPLSTKPSSSSRQKAQKPSPVAGARPPSSGAQQGAKPGADKNLRFLLQKVLKQSDVGALGRIVLPKKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMACAEDGGGAEAGGCKGKSPHGVRRSRQEAASMNQMTVS

SEQ ID NO: 11018 - protein, 474 aa, Ashbya gossypii
MLGQICRVTARTGGAAKAHWAGAARARQFHSSWRRLQEIRDPYETLGVAKDASASQIKKAYYKLAKQFHPDINKDEGAEKKFHDLQNAYEILSDENKRRQYDQFGAAAFSQGGAGAGGAGGFQGGFGGFSGFGDFGEFGGLNFEDLFGAAFRGGARGAGRQGGAQFVREFKGDSIQVPFKLSFRDAVFGLKDVPLRYAVYDQCGTCSGSGLKAGAQRSVCGGCHGTGTQVHVRAGFQMASTCSQCSGEGYSIRRGDRCGTCSGEGVVFNRNKEVKMDFPHGLQDGDVVKVPGQGSFPHIQVDPKTAHTMRLRRGDLLVQVQVERDPRFQIKNNYDIWYVQEIPITTAALGGTVSIPTVDGDQIRLKVIPGTQPDQVVSIPNKGVPRGLSGARGDMKVQYRIVMKKPQSKAEKFLWEALADVTGDKTARRTENIDAAMAGTAAPGVASSPDEPSTLRKLEKFISNAFKTIRGDQH

SEQ ID NO: 11019 - protein, 427 aa, Avena fatua
WVQNHHLQKKRARVDDELPSPGANPGYEFPAETGAPATSWPMPYQQAYGREAIYPNAAATGQYPFQQGGSTSSVVVSSQPFSPPAPVADMQAANMPWPQQYAAFPGAAPYPMPPPQPLAAAGFGVCSQPLAGVEPSASKEARKKRMARRRRLSCLQHQRSQQLNLGQIQNAMIHPQQEVPFSPRSAHSVPVSPPSPGGWCGLWPPPSVQVQGQGQLMVPNPLSTKPNSSSRQKAQKPSPDAGARPPSSGAQQGAKPAADKNLRFLLQKVLKQSDVGALGRIVLPKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMACAEDGGGAEAGGCKGKSPHGVRRSRQEAASMNQMTVS

SEQ ID NO: 11020 - protein, 208 aa, Triticum aestivum
  misc_feature (91)..(91): Xaa can be any naturally occurring amino acid
  misc_feature (132)..(132): Xaa can be any naturally occurring amino acid
  misc_feature (176)..(176): Xaa can be any naturally occurring amino acid
ARAVANRTDACFIRVIGSELVQKYVGEGARMVRELFQMARSKKACIIFFDEVDAIGGARFDDGAGGDNEVQRTMLEIVNQLDGFDARGNIXVLMATNRPDTLDPALLRSGRLDRKVEFGLPDLEGRTQIFKXHTRTMNCERDIRFELLARLCPNATGRDIRSVCTEPGMYPIRAPXETVTEKDFLDSVNKVIKGYQKFSATPKYMVYN

SEQ ID NO: 11021 - protein, 428 aa, Avena fatua
WVQNHHLQKKRARVDDELPSPGANPGYEFPAETGAPATSWPMPYQQAYGREAIYPNAAATGQYPFQQGGSTSSVVVSSQPFSPPAPVADMQAANMPWPQQYAAFPGAAPYPMPPPQPLAAAGFGVCSQPLAGVEPSASKEARKKRMARQRRLSCLQHQRSQQLNLGQIQNAMIHPQQEVPFSPRSAHSVPVSPPSPGGWCGLWPPPSVQVQGQGQLMVPNPLSTKPNSSSRQKAQKPSPDAGARPPSSGAQQGAKPAADKNLRFLLQKVLKQSDVGALGRIVLPKKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMACAEDGGGAEAGGCKGKSPHGVRRSRQEAASMNQMTVS

SEQ ID NO: 11022 - protein, 186 aa, Unknown
  marine gamma proteobacterium HTCC2143
MNPTIMKLHKIALLLLSIFASTVSAAKCNTLLDYETRKLRSDDTINLCEAYKGKVIVMVNTASQCGFTPQFKSLEQLHQRYKEQGLVVLGFPSDDFKQEHKDESKTADVCYVNYGVTFQMLATSHVTGKNANPVFAQLAKQTGVAPRWNFNKFIVGKDGKAIKYFPSGELPMGGDLEKNVIDALGI

SEQ ID NO: 11023 - protein, 436 aa, Avena fatua
LLKLILTWVQNHHLQKKRARVDDELPSPGANPGYEFPAETGAPATSWPMPYQQAYGREAIYPNAAATGQYPFQQGGSTRSVVVSSQPFSPPAPVADMQAANMPWPQQYAAFPGAAPYPMPPPQPLAAAGFGVCSQPLAGVEPSASKEARKKRMARQRRLSCLQHQRSQQLNLGQIQNAMIHPQQEVPFSPRSAHSVPVSPPSPGGWCGLWPPPSVQVQGQGQLMVPNPLSTKPNSSSRQKAQKPSPDAGARPLSSGAQQGAKPAADKNLRFLLQKVLKQSDVGALGRIVLPKKEAETHLPELKTRDGISIPMEDIGTSRVWSMRYRFWPNNKSRMYLLENTGDFVRSNELQEGDFIVIYSDVKSGKNLIRGVKVRPPQDLAKQKHGSLEKGSTSDAMACAEDGGGAEAGGCKGKSPHGVRRSRQEAASMNQMTVSI

SEQ ID NO: 11024 - protein, 463 aa, Arabidopsis thaliana
MEKQNIISNTSSSSSSWIRGSCVGRGCFGTVSKALSKIDGGLFAVKSIDLATCLPSQAESLENEIVILRSMKSHPNIVRFLGDDVSKEGTASFRNLHLEYSPEGDVANGGIVNETLLRRYVWCLVSALSHVHSNGIVHCDVKSKNVLVFNGGSSVKLADFGSAVEFEKSTIHVSPRGSPLWMAPEVVRREYQGPESDVWSLGCTVIEMLTGKPAWEDHGFDSLSRIGFSNDLPFIPVGLSELGRDFLEKCLKRDRSQRWSCDQLLQHPFLCQDHHDSFFTESSPRCVLDWVNSEFDEEEESDEWRPESMVSAMARISKLAITGGANWESNGWTEVRDTSEESEAKKEVLVSPRVELESYISLESSSDDSVRQPRNEESATELASAVTCEAILLVMILVVENIQIYATFYTSSIIMHILYCCSCCCYYHYQNNNKKNNFSKSTSFILSLNFLFGIACDSDRSIY

SEQ ID NO: 11025 - protein, 410 aa, Unknown
  Burkholderia sp. PS12
MATHVAIIGNGVAGFTTAQALRAEGFEGRISLIGNEPHLPYDRPSLSKAVLGGSLEHPPVLAEADWYGEARIDMLSGRSVTNLNVDARTISLDDGSTFAADAIVIATGSRARTLALPGSQLTGVVTLRTNDDVRPLCRGWTPATRLVIAGGGLIGCEVATTARKLGLAVTILESADELLVRVLGRRIGAWLRGLLTELGVRVELGTGVAGFSGDDRLEEVLASDGRRFAADNALVCIGAEPEDQLARQAGLSCDRGVIVDDHGATHAEGVFAVGDAASWPLRDGGRRSLETYMNAQRQAAAVAAAILGKHGSAPQVPVSWTEIAGHRMQMAGDIEGPGEFVLRGTLGDGAALLFRLRDGRIQAVVAVDAPRDFAMAARLVEARAAIEPARLADFSNSMRDLVRAQQGDSA

SEQ ID NO: 11026 - protein, 368 aa, Mycoplasma hyopneumoniae
MAKQDFYKILGVEKSASLTEIKKAYRNLVNIYHPDKNTKKSAEEQKQAEAKFKEIQEAYEILSDETKRKQYDKFGHAAFDQQFGGGSSGFSGFDFGDIFSSFTSGFGFGGSQEQKYSRPLKGENFQAKIYISFIESILGKEISQKLTKYDQCDNCKGSGANSSSDITTCYNCQGRGMQTEVLNIPGFGRVQNKTTCSVCLGSGKNITKNCKKCRGKTIVETKEEVTIKIPAGIQDGMFIRVAGFGGPGHKGGPSGDLHLEINVRQHKHFTRSGNDIHVNMPVSIIDVINQNTVEVPSPTGLKKVRLYDYYKSGQIVNVLRAGAPDPKNPRIIGDLKVHLIFYIPEFSPRQKDDLNQVFAQINDKTKAK

SEQ ID NO: 11027 - protein, 505 aa, Staphylococcus aureus
MTQQQNDKRTLKNKHTYQNEPLPNRKDFVVSFITGALVGSALGLYFKNKVYQKADDLKVKEQELSQKFEERKTQLEETVAYTKERVEGFLNKSKNEQAALKAQQAAIKEEASANNLSDTSQEAQEIQEAKREAQAEADKSVAVSNKESKAVALKAQQAAIKEEASANNLSDTSQEAQEIQEAKKEAQAETDKSAAVSNEEPKAVALKAQQAAIKEEASANNLSDTSQEAQEVQEAKKEAQAETDKSAAVSNEEPKAVALKAQQAAIKEEASANNLSDISQEAQEVQEAKKEAQAEKDSDTLTKDASAAKVEVSKPESQAERLANAAKQKQAKLTPGSKESQLTEALFAEKPVAKNDLKEIPQLVTKKNDVSETETVNIDNKDTVKQKEAKFENGVITRKADEKTTNNTAVDKKSGKQSKKTTPSNKRNASKASTNKTSGQKKQHNKKSSQGAKKQSSSSKSTQKNNQTSNKNSKTTNAKSSNASKTPNAKVEKAKSKIEKRTFND

SEQ ID NO: 11028 - protein, 511 aa, Fragaria grandiflora
MEFQAMTFAIPFALAAVSWLFLYYIRVSYFTNNNKSAYAKLPPVPVVPGLPVIGNLLQLKEKKPYKTFTSWAEEYGPIYSIRTGACTMVVLNSSQVAKWAMVTTYSSISNRKLSSALKILSADQCMVALSDYNDFHKMIKRYIRANLLGSRAQKRLRTNRDTLRANVLSQSKSHVKNSPLEAVNFTRVFESELFGLAVKQVYGNDIEDPIYVGGTWCYTFKKLDFSGLVVRDILDGGNRWLIDWRDFFPYLRCILNKTLETKIQRLHSRRKPVMTALINEQKKRIASGEEINCYMDFLLSEGRTLTMDQITMLVWETVIETSDTIMVTTEWAMYEIAKNPKQQDRLYQEIQKVCGSEMVSEEHLSQLPYLTAVFHETLRKHSPAALVPLRYAHEDTQLGGYYIPAGTEIAINIYGCNMNKHQWESPDEWKPERFLDPKYDPMDLYKTMAFGAGKRVCVGSLQGMLIACPTIGRLVQEFEWKLRAGEEENVDTVGLTTHKRDPMHAILKPRS

SEQ ID NO: 11029 - protein, 112 aa, Rhodobacter sphaeroides
MKLIIAAIKPFKLEEVREALTTIGVRGMMVTEIKGFGSQSGHTEIYRGAEYAVNFVPKVRLEIVVSDGLAESVVETIRTTAKTDKIGDGKIFVLDVEQAVRVRTGEINDDAL

SEQ ID NO: 11030 - protein, 296 aa, Burkholderia xenovorans
MLQHYPAEHEFNGPVIACIQMEPHVGAKRDNVTRSIRHIETAAKNGASLVILPELANTGYVFVDRDEAFSLAEELPDGQTARIFAEMARRLGIHIVAGIAERAGTRLYNSAIFTGPSGHIGVYRKLHLWNNERLFFEPGDFGIPVFDTSVGRIAIVICYDGWFPETYRLAAMQGADIVCVPTNWVPMSSQPDDRPAMATTLTMAAAHSNGMAIACANRIGTERGQPFIGQSVIVGGDGWPITGPASGDREEILYASIDLKRTRSSRALNALNHVLHDRRADVYDPMLGTGWPSSHS

SEQ ID NO: 11031 - protein, 268 aa, Aeropyrum pernix
MNIAVLQVASTREKDANLESVKRLASRVKNSPDIVLTPEYLMLDPTGLGRDAIYDAAEDLEGRWSRELSKIAESLGSCLLGHLFLKTPSGRVANAAVLYSRDGGIIGVYRKTHLFDAYGYVESSFTEPGDELWEPRKACGASIGVAICYELRFPEIFRTQSLVGGVDIFLVPAAWYRGPGKEEALSVLSRARAQENTSYVAVASNAGANFVGRSMIIHPLGYTLAQAPPWEWVLEHEIDLREIERARKSLPVLEHVKPHLYRYLMKQG

SEQ ID NO: 11032 - protein, 624 aa, Aspergillus oryzae
MAPITTAAAEKTKQEEYDDIHEDPIEDEEDEGSDLDPSQREYLEHHRKLDQFLSPLSLDEAVLYKLARRFSSVYRDLALHSEEQFLPTPVTHLPTGLETGRYLAIDVGGSNLRVAFIELLGDAANSDIGSTDASEQSTTIRRAQRQRVRRTLEKAWPIQEHLKMDNAEDLFSWIGDRIAEVVAESLTSDATKGKVPEELEMGITFSFPIMQESLSEATLMPMGKGFAITSDLNLRNILLSGYERHTRRPDDEDEPSSKRRKLFALPKLKIAAITNDAVATLASLAYAVKSLPNSRVAMGIIVGTGCNATIPMKLSSLHETKANHVKSKDSEAVETVINTEWTLAGSAPPLKELDIITKWDIELDRACARPGFQPFEYLTGGRYIGELIRLILFDYLTNVRGLASKELPANLVQEYALTTTYISDNVARARSDLELADVLNHSLPSPESSEWQWDAVCAGAFRKIARTVQKRAAGLIAAAVVGLLACANEIELKVESTENSPQPSSAASPEHNGGADVTAVTNFLSPSTSKVSTNAQRGNGPIVPVLSPTPTPADWQSGPEELVVAYTGGIIQHYPNFKNMCQQFIDRLIMRTGPQKSGKSVFLREVSDGGVIGAGVLAGMVANR

SEQ ID NO: 11033 - protein, 187 aa, Neisseria gonorrhoeae
MTDLETKRLETQAMLENADLLFDQGQCRAALQKVADEITRDLGDKYPLLLPVMGGAVVFTGQLLPLLRFPLDFDYVHVSRYGDKLEGGAFNWKRMPDAEQIRGRHVVVLDDILDEGHTMSAIQAKLLEMGAASCRAAVFANKLIDKEKPVKADYVGLDVPNRYVFGYGMDAAGCWRNLGEIYALGGK

SEQ ID NO: 11034 - protein, 216 aa, Unknown
  Acinetobacter sp. ADP1
MATRITNQKLSKSSRAWMREHLDDPFVKKAQKEGYRARAAYKLLEIQEKYRLIKPGMTVVDLGAAPGSWSQIAGKLVGSKGLVIASDILAMDTLPDVTFLQGDFREEEVFEKLLNILNGRTVDIVISDMAPNTSGNRAVDQPRQIYLCELALDFAQKVLGPDGQFVVKVFQGSGFDEFRKQVVDSFDVLKTVKPAASRARSKEVFLIGQGRKKALQ

SEQ ID NO: 11035 - protein, 236 aa, Populus alba
MIRRYWNINLKEMLETGVHFGHATRKWNPKMAPYISAKRKGIHITNLTRTARFLSEACDLVFDAASRRKQFLIVGTKNKAADPVARAAIRARCHYVNKKWLGGLLTNWSTTEMRLQKFRDLRMEQKTGGIHRLPKGDAARLKRQLFHLQTYLGGIKYMTGLPDIVIIVDQQEEYMALQECITLGIPTICLIDTNCDPDLTDISIPANDDAIASIRLILNKLVFAICEGRSSYIRNP

SEQ ID NO: 11036 - protein, 488 aa, Oceanicola granulosus
MIDKIAHRGPDEVHVTTLADAPVTMAHCRLSIIGTEDGAQPIRQAGNMLVANGEIYNHADLRAILGEAAFETASDSETILHLFRSGRSRWIDRLDGMFAFVLATKDRIIATRDPLGIKPLYVANMGGGAIFASELKAFDGVPVDGIEAIPPGHLIDSRDGWRQWYRTPQGAASAEPGFDIGRASRELRLVLEAAVAKWMVADVEVGSFLSGGLDSSIIAAIAQKVRLAQGLGPLKTFAVGTDGSPDLRAARAVAAHIGADHHEAVFTAQDVVGALPHVIYHLESADVDLVRSALPTLFAARLARAQVKAVLTGEGADELFAGYTYHHGYADDPRALADELTRSLGTMHNINLQRVDRVTMSESLEARTPFLDRDLIDFAQSIPAELKMRHTDPEARDATGPTTEKWILRKACEDLLPADLVWRKKAQFDEGSGTVDALSGALASLIDGPVNRQSEGALYERILGETYADPDRILAAAGTWEADRVLGG

SEQ ID NO: 11037 - protein, 243 aa, Lotus japonicus
LDCQKIGAPPEVVARLVAARQEFEARRRSSVSSRENSKDPELDQFMEAYYDMLVKYREELTRPIQEAMGFMRRIETQLNMLCSGPVRIFNDDKCEGVGSSEEDQDNSGGETELPEIDPRAEDRELKTHLLKKYSGYLSSLKQELSEKKKKGKLPKDARQKLLNWWELHYKWPYPSESEKVALAESTGLDQKQINNWFINQRKRHWKPSEDMQFMVMDGLHPQNATLYMDGHYMAADGHYRLGP

SEQ ID NO: 11038 - protein, 142 aa, Oceanicola granulosus
MALRYLHTMVRVKDLEENMAFYELLGLKETKRSENEGGRFTLVFMAPEGQEDCPVELTWNWDGDEGLPSDSRHFGHLAYSVDNIYETCQKLQDAGVTINRPPRDGHMAFVRSPDNVSIELLQAGERLPPQEPWASMENTGHW

SEQ ID NO: 11039 - protein, 70 aa, Unknown
  Photobacterium sp. SKA34
MTKIYDFDVKALSGEVRSFSDYEGKVLLVVNTASKCGFTPQYEALQTLYEKYRDQGLVILGFPCNQFGGQ

SEQ ID NO: 11040 - protein, 236 aa, Pisum sativum
MTKRYWNITFEEMMEAGVHFGHDTRKWNPRMAPFISAKRKGIHITNLTKTARFLSEACDLAFDAASKGKQFLIVGTKKKAADSVTRAAIRARCHYVNKKWLRGMLTNWYTTETRLGKFRDLRTEQKTGKLNSLPKRDAAMLKRQLSHFETYLGGIKYMTGLPDIVIIVDQQKEYTALQECITLGIPTICLIDTNCDPDLADMSIPANDDAIASIRLILNKLVFAICEGRSSSIRNY

SEQ ID NO: 11041 - protein, 567 aa, Glycine max
MADASSPPTDQLAAITLDEVPKANFSDRVLIRSIISRTDGGSGLAGRKARVGGWVKTGRKADKDAFAFLEINDGSCAGNLQVIVEAALGELGQLVPTGTCVVVDGHLKLPPAGTRQKIELRADKVLHVGPVDPAKYPLPKMRLTLEFLRDFVHLRSRTNTISAVARIRNALAYATHTFFNKEGFLYVHTPIVTTSDCEGAGEMFQVTTLLSEAERLEKELLQNPPPSEADVEAARVVVQEKGEVVSQLKAAKASKQEIGAAVDQLKKAKESLAKVEEWSKLKPGIPKKDDGKVDYGKDFFARQAFLTVSGQLQVESYACALSSVYTFGPTFRAENSHTSRHLAEFWMVEPEIAFAELKDDMNCAEAYVKFMCQWLLDNCLEDMEFMADKFDKGCIDRLKLVASTPFIRVTYTEAVEILEDAVKNGKKFENEVKWGIDLASEHERYLTEVKFQKPVIVYNYPKDIKAFYMRLNDDLKTVAAMDVLVPKVGELIGGSQREERYDVIQTRIKEMGLPVEPYEWYLDLRRYGTVKHAGFGLGFERMILFATGLENIRDVIPFPRYPGRADL

SEQ ID NO: 11042 - protein, 226 aa, Triticum monococcum
MTSSCSAHGQARLLPGSKLALAFKGVSYEDVEENLYNKSELLLKSNPVHKKIPVLIHNGAPVCESMIIVQYIEDVFTGTGPSLLPADPYERAVARFWVAYVDDKLVAPWRQWLKGKTEEEKSEGKKQAFAAVEVLEGALRECSKGGGFFGGDGVGLVDVALGGVLSWMKVTEVLFGEKIFDAAKTPLLAAWVDHFSGLDAAKAALPDVGRLLEFAKAREVAAAASN

SEQ ID NO: 11043 - protein, 206 aa, Zea mays
SLTGYILLGCIVAPVAPNKQISKMVEEAARLSKLFCDRNLPIFAFLDTHYPDKPEPPYPPHCIIGTGEEDFVPDLEWLEKEPNVTIKRKSCIDGYISCIEKDGSSVFADWIGKYQIKTVLVLGICTDICVLDFASSTLAARNIDRVPPLQDVVIYSGGCATYDLPVEIATNIKGALAHPQDLMHHIGLYMAKGRGAKIVDRVVIEP

SEQ ID NO: 11044 - protein, 448 aa, Pyrobaculum aerophilum
MVRVVVVGGGAAGASAAARARRLDPSAEVLLIERGSMITHAPCGMPYAIGGIVKSHEELMTYTPEEFEKERNIKVMINTEVVDVDADKKVVVVKKGGSEEKIPWDKLVIATGAKPLVPRIPGVELKGILTMRHPDEVPHLKGHIDKAKTVAIVGGGYIGVEMAEVLLELGKRFLLFEMFDQVLPAALDPDVAGIVAEEMKTRGVELHLGEKVVEFRGVEHVNKVVTEKGEYQVDEVILAVGVRPDVDLAVRAGAKLGETGAVYVNEYMETTVPDVYAAGDVAEKVHRVTGRRVWIPLAPTANKEGQVAGGNAVRNRILKFPGVVGTAVTKFYNLYIARTGLSEKDAAQLGFKTQSALIKARTKAHYMPGAETVHVKLIAEESTGRILGGQIVGKSPVVASYADILAVAVQSGYTVSDLFFSDIGYMPDTAPVWHPLIVAARVLSRGKL

SEQ ID NO: 11045 - protein, 458 aa, Caulobacter crescentus
MTGKLPKACVIGAGCSGFTTIKRLKDYGIPYDCFEMSDEVGGNWYYKNPNGLSACYESLHIDTSKWRLAFEDFPVPKDWPDFPHHAQLFQYFKDYVDHFGLRPTITFNTKVESAKRTADGLWAVTLSGGETQFYDVLFVCNGHHWDPRVPEYPGEFDGPAFHAHAYCDPFDPVDMRGKNVVVVGMGNSAMDIASELSQRPIAKNLWVSARRGVWVFPKYLNGKPADKTALPAWMPRKLGVALSRSVLKKTIGRMEDYGLPKPDHEPLEAHPSVSGEFLTRAGCGDIKFKPAIKALEGKRVRFTDDSVEDVDAIVFATGYKISFPFFDDPALLPDADHRLPLFKRMMKPEVPNLFYMGLAQPLPTLVNFAEQQAKLAAAYLAGQYALPPPAEMARITAKDEHRHTGHFYDSARHTIQVDFNVYCADLKKEIAKGEARARNAGGKLPVAARAEGQALAAE

SEQ ID NO: 11046 - protein, 436 aa, Avena fatua
LLKLILTWVQNHHLQKKRARVDDELPSPGANPGYEFPAETGAPATSWPMPYQQAYGREAIYPNAAATGQYPFQQGGSTSSVVVSSQPFSPPAPVADMQAANMPWPQQYAAFPGAAPYPMPPPQPLAAAGFGVCSQPLAGVEPSASKEARKKRMARQRRLSCLQHQRSQQLNLGQIQNAMIHPQQEVPFSPRSAHSVPVSPPSPGGWCGLWPPPSVQVQGQGQLMVPNPLSTKPNSSSRQEAQKPSPDAGARPPSSGAQQGAKPAADKNLRFLLQKVLKQSDVGALGRIVLPKKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMACAEDGGGAEAGGCKGKSPHGVRRSRQEAASMNQMTVSI

SEQ ID NO: 11047 - protein, 72 aa, Arabidopsis thaliana
  misc_feature (4)..(4): Xaa can be any naturally occurring amino acid
  misc_feature (30)..(30): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(49): Xaa can be any naturally occurring amino acid
  misc_feature (54)..(54): Xaa can be any naturally occurring amino acid
  misc_feature (56)..(56): Xaa can be any naturally occurring amino acid
MASXMLSSATMVASPAQATMVAPFNGLKSXAVFPATRKANNXITXITXXGGRVXCXQGPEKKGLYFLPVYGE

SEQ ID NO: 11048 - protein, 1011 aa, Glycine max
MRVLVLFFLFLHSLQAARISEYRALLSFKASSLTDDPTHALSSWNSSTPFCSWFGLTCDSRRHVTSLNLTSLSLSGTLSDDLSHLPFLSHLSLADNKFSGPIPASFSALSALRFLNLSNNVFNATFPSQLNRLANLEVLDLYNNNMTGELPLSVAAMPLLRHLHLGGNFFSGQIPPEYGTWQHLQYLALSGNELAGTIAPELGNLSSLRELYIGYYNTYSGGIPPEIGNLSNLVRLDAAYCGLSGEIPAELGKLQNLDTLFLQVNALSGSLTPELGSLKSLKSMDLSNNMLSGEVPASFAELKNLTLLNLFRNKLHGAIPEFVGELPALEVLQLWENNFTGSIPQNLGNNGRLTLVDLSSNKITGTLPPNMCYGNRLQTLITLGNYLFGPIPDSLGKCKSLNRIRMGENFLNGSIPKGLFGLPKLTQVELQDNLLTGQFPEDGSIATDLGQISLSNNQLSGSLPSTIGNFTSMQKLLLNGNEFTGRIPPQIGMLQQLSKIDFSHNKFSGPIAPEISKCKLLTFIDLSGNELSGEIPNKITSMRILNYLNLSRNHLDGSIPGNIASMQSLTSVDFSYNNFSGLVPGTGQFGYFNYTSFLGNPELCGPYLGPCKDGVANGPRQPHVKGPFSSSLKLLLVIGLLVCSILFAVAAIFKARALKKASEARAWKLTAFQRLDFTVDDVLDCLKEDNIIGKGGAGIVYKGAMPNGGNVAVKRLPAMSRGSSHDHGFNAEIQTLGRIRHRHIVRLLGFCSNHETNLLVYEYMPNGSLGEVLHGKKGGHLHWDTRYKIAVEAAKGLCYLHHDCSPLIVHRDVKSNNILLDSNFEAHVADFGLAKFLQDSGASECMSAIAGSYGYIAPEYAYTLKVDEKSDVYSFGVVLLELVTGRKPVGEFGDGVDIVQWVRKMTDSNKEGVLKVLDSRLPSVPLHEVMHVFYVAMLCVEEQAVERPTMREVVQILTELPKPPSSKQGDLTITESSLSSSNSLGSPTTASKEPKDNQHPPQSPPPDLLSI

SEQ ID NO: 11049 - protein, 483 aa, Caulobacter crescentus
MKVERLPPVRTSLGPTNHPYMTGPWTPQHEEVNAWDLEVLEGAIPADLDGVYLRNTENPVHDPIGRYHPFDGDGMIHQIEFKGGAATYRNRFVRTRCFEAEQEVNEGLWGGLMDGPGVSKRPGFGAHGALKDSASTDIVVHNGEAIATFYQCGEAYRLDPLTLENLGVASWAPLEGVSAHPKVDEATGELMFFNYSKAWPYMHYGVVGPDGKRKVYQGVPLPGPRLPHDMAFSSKYAILNDLPVFWDQELMARDIHAVRLHKGIPSRFALVPREGGEPRWFEAEPTYVLHWLNAYEDGDEVVLDGYFQEKPIPRPLEGAPDGHGHLMAYLDEHSFLPKLHRWRFNLKTGETTEKHLDDRVLEFGMFNQKYAGKPYRYAYSTTAKPGWFLFNGFVKHDLETGESWSIALPEGRYASEAPFAPKVGAVDEDDGYLVSFIIDENKGASECLIVDAKRFEVVCRIALPHKLSSGTHTVWAGREMLTK

SEQ ID NO: 11050 - protein, 316 aa, Neisseria meningitidis
MSQHRKLIILGSGPAGYTAAVYAARANLNPVIITGIAQGGQLMTTTEVDNWPADADGVQGPELMARFLAHAERFGTEIIFDQINAVDLQKRPFTLKGDMGEYTCDALIVATGASAKYLGLPSEEAFAGKGVSACATCDGFFYKNQDVAVVGGGNTAVEEALYLANIAKTVTLIHRRSEFRAEKIMIDKLMKRVEEGKIILKLESNLQEVLGDDRGVNGALLKNNDGSEQQIAVSGIFIAIGHKPNTDIFKGQLEMDEAGYLKTKGGTADNVGATNIEGVWAAGDVKDHTYRQAITSAASGCQAALDAERWLGSQNI

SEQ ID NO: 11051 - protein, 435 aa, Avena fatua
LLKLILTWVQNHHLQKKRARVDDELPSPGANPGYEFPAETGAPATSWPMPYQQAYGREAIYPNAAATGQYPFQQGGSTSSVVVSSQPFSPPAPVADMQAANMPWPQQYAAFPGAAPYPMPPPQPLAAAGFGVCSQPLAGVEPSASKEARKKRMARQRRLSCLQHQRSQQLNLGQIQNAMIHPQQEVPFSPRSAHSVPGSPPSPGGWCGLWPPPSVQVQGQGQLMVPNPLSTKPSSSSRQKAQKPSPDAGARPPSSGAQQGAKPGADKNLRFLLQKVLKQSDVGALGRIVLPKKEAETHLPELKTRDGISIPMEDIGTSRVWSMRYRFWPNNKRRMYLLENTGDFVRSNELQEGDFIVIYSDVKSGKYLIRGVKVRPPQDLAKQKHGSLEKGSTSDAMPCAEDGGAEAGGCKGKSPHGVRRSRQEAASMNQMAVSI

SEQ ID NO: 11052 - protein, 397 aa, Avena fatua
LLKLILTWVQNHHLQKKRARVDDELPSPGANPGYEFPAETGAPATSWPMPYQQAYGREAIYPNAAATGQYPFQQGGSTSSVVVSSQPFSPPAPVADIQAANMPWPQQYAAFPGAAPYPMPPPQPLAAAGFGACSQPLAGVEPSASKEARKKRMARQRRLSCLQHQRSQQLNLGQIQNAMIHPQQEVPFSPRSAHSVPVSPPSPGGWCGLWPPPSVQVQGQGQLMVPNPLSTKPNSSSRQKAQKPSPDAGARPPSSGAQQGAKPAADKNLRFLLQKVLKQSDVGALGRIVLPKKEAETHLPELKTRDGISIPMEDIGTSRVWSMRYRFWPNNKSRMYLLENTGDFARSNELQEGDFIVIYSDVKSGKYLIRGVKVRPPQDLAKQKHGSLEKGSTSDAM

SEQ ID NO: 11053 - protein, 520 aa, Desulfotalea psychrophila
MEEKRKDLKLGKVYLIGAGPGDPGLITVRGKQLLEKAEVVVYDYLANPKLLKLVPKSSELIYVGKKGNIHHAHSQEEINQILVDKSHEGKLIVRLKGGDPFIFGRGGEELQEIHKEGIPFEVVPGVTSASAAATYAGIPITHRDFAASVAFVTGHEDPNKKESNVDWAKLATGAGTIVVYMGIKNLPIIVDNLLKHGRDPETPVAVVRWASTPEQESVVGTIATIKDVVADAGIKAPALIIIGGVVSLRDTMDWFEKRPLFGKKIIVTRTREQASELVQELEEQGANCLECATIKISPIKEPKELDNALERLQEFHWILFTSINGVKYFFERLFSKGMDARDLKGCDIAVVGPSTADYLRKYGLNADLFPPVFTGEGLAQALLDQGVEGRNILIPRAQQAREIVPENLRGAGAQVTVAPVYVTKPIAENKKEMRAELESGTVDMVTFTSSSTVTNFIKMLQPESPEELASLLKGVRIAAIGPITAKTVTDNGLQVDVQPENYTIAGMLDAIVESYSSEKK

SEQ ID NO: 11054 - protein, 376 aa, Mannheimia succiniciproducens
MAKQDYYETLGVQKGADEKEIKRAYKRLAMKYHPDRTNGDKAAEEKFKEVNEAYEILMDKEKRAAYDQYGHAAFEQGGFGGGAGGFGGGFGGFGGFEDIFSEMFGGGASRQRVVRGEDLRYDIEITLEEAVRGTTKDIKINTLAACDHCDGSGAEKGSKVETCPTCHGHGRVRRQQGFFMTETTCPTCQGSGKKIEKPCKHCHGDGRVHKKKNLSVKIPAGVDTGNQLRLSGEGAAGENGAPAGDLYVVIHVKDHHIFERDGSNLYCEVPISFTMAALGGEIEVPTLDGRVKLKIPAETQTGKLFRMRGKGVTSTRAGYAGDLICKIIVETPVKLNEEQKELLRKFEESLEGQSKQRPKSSSFLDGVKKFFDNLGK

SEQ ID NO: 11055 - protein, 140 aa, Picea abies
VEDGSGGETDFQEVDHHAVEDRELKDHLLRRYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 11056 - protein, 575 aa, Phaeomoniella chlamydospora
MGVQHDGIAGRQPIQDMLTPDEQYCIVEEPLGHARPVRIVTIGAGASGINVARNVKEHMKNVEFQMYEKNSEIGGTWTENRYPGCGCDIPSHNYQYSWAPNPRWNQYYSSQGEILTYFQDAAEKSGLIQFIKFQHKVVEAVWNESRGVWQFKIENLATGETFQDYAHFFINASGYLNNWKWPDIAGLQDFQGDLMHSASWKPGTELYDKSVAVIGCGSSGIQLVANIQPMVKHLTTFIRQPTWVTAGFGSKYAAPGGTNFNFTEEQKREFEENPKSYLEYRKAVEHELNCRFKMLHKDTPEQAAAMEFATNEMIKRLGGPNELSDFIIPKFSVGCRRPTPGQGYLEALVAPNVSVITGTEISHATSNGLVLSDGQIINVDVIICATGFDLSFRPRFPIIGRDEVSLAESWSERPTAYLSMTPADMPNYFMFLGPNAPVGHGSAIPIIEHLTKYMLKMIYKAQTEGYKSFVPLQDAIDEFVEHADTFLERMAWASKCRSWFKNGKETGPVTALHPGSRIHWFHLLGNIRHEDWEWKTVQRNRWAFLGNGFSVREGGGRDLTWYFDQPEEGYEGLIY

SEQ ID NO: 11057 - protein, 401 aa, Rhodobacter sphaeroides
MPDIVVVGAGQAGAALVAKLRALKFEGSILLAGEEPSPPYQRPPLSKAYLLGTMEEERLWLRNRAFYAEAGIELRLGAPVTAIDRAARTVTVGGEAIPYGRLALTTGSAARHLPEAAGGGLDGVYTVRTLADVDRMRPEFRAGRRLVVIGGGYIGLEAAAVGAKLGLAVTVVEMAPRILQRVAAPETADWFRALHAAHGVRILEGVALERLTGEGRVTGALLADGTHLPADFVIAGVGIRPVTELAEAAGLALDNGIAVDALGQTSDPAIWSAGDCASFPWRGGRLRLESVQNAIDQAEAVAANMLGAGAPYLPAPWFWSDQFDTKLQIAGLNLGYDRVVTRGPEGGSVSFWYYRGVELLAVDAVNEPRAYMVGKRLIEAGRSPAPDAVADAAVPLKSLLV

SEQ ID NO: 11058 - protein, 230 aa, Chara vulgaris
MNHLYSKTNLEEMLEAGVHFGHQSHKWNPRMAPYIFSERKGVHIIDLIQTSNLLHEACDFLANAASNKKEFLLVGTKFQASDLIKSEALKSRCHYVNQRWLGGMLTNWMTIETRIQRLKNLETQEKLGAFHHLPKKDAAHLKRQLNQLQKYLGGMKYMKNLPDVVIIVDQQKEIIAVQECRVLGIPIIALVDTNCDPEIVDIPIPANDDARSSIRWILSKLTAAIRDNRF

SEQ ID NO: 11059 - protein, 554 aa, Salmonella typhimurium
MCSIFGVFDIKTDAAELRKKALELSRLMRHRGPDWSGIYACDNAILAHERLSIVDVNAGAQPLYNARKTHVLAVNGEIYNHQTLRAEYGDRYAFQTGSDCEVILALYQEKGPDFLDDLQGMFAFALYDSEKDAYLIGRDHIGIIPLYMGYDEFGNFYVASEMKALTPVCRTIKEFPAGSYLWSKDGEIRQYYQRDWFEFDAVKDNVTDKNALRQALEESVKSHLMSDVPYGVLLSGGLDSSVISAITKKFAARRVEDQERSEAWWPQLHSFAVGLEGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLQALHMYDCARANKAMSAWGVEARVPFLDKKFLDVAMRINPQDKMCGNGKMEKHVLRECFESYLPASVAWRQKEQFSDGVGYSWIDTLKEVAAKQISDQQLETARFRFPYNTPSSKEAYLYREIFEELFPVPSAAECVPGGPSVACSSAKAIEWDEAFKTMDDPSGRAVGVHQSAYQ

SEQ ID NO: 11060 - protein, 101 aa, Zea mays
PSFHTVGAPIGWETQRGPKNFFKNWDPPGFGAPPPKGLGKCWPPKGKNGEELPPPLETALGEKKASLFFFKVFGPKDPPPKKLLEWGFRVFPPNSRPPNPQ

SEQ ID NO: 11061 - protein, 358 aa, Lycium pilifolium
YDQYKDAWDTSVAVEIKVGDSIETVRFFHCYKRGVDRVFVDHPMFLEKVWGKTASKIYGPKVGQDYVDNELRFSILCQAALEAPRVLNLNCSKYFSGPYGEDVLFIANDWHTALIPCYLMSMYQSKGIYLNAKVAFCIHNIAYQGRFPFSDFSLLNLPDEYRSSFDFIDGYEKPIVGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 11062 - protein, 252 aa, Listeria monocytogenes
MNAATRAVVRKAIYEGLEVYGINYGFLGLVNGDIRKLELGSVGDLLHRGGTFLYSARYPEFATEEGQLKGIEQLKKHQIDGLVVIGGDGSYHGAEALTKRGFPTIGIPGTIDNDISGTDFTIGFDTALNTVLDALDKIRDTATSHERTFIIEVMGRDAGDIALWSGLAGGAEAIIVPEESFNMDDVVDRLNKGRERGKKHSIIVVAEGVMSGNEFAKQLAEYGDYHARVTVLGHVQRGGSPTAFDRVLASRL

SEQ ID NO: 11063 - protein, 131 aa, Unknown
  Photobacterium sp. SKA34
MSDAMKALLNLRSLRALSREYTLEQLEEALEKLTTVVQERAEAEEEEQAKENERNEKLAQYREMLLADGIDPEELLASLSKAPKAKRAARPAKYKFIDENGEEKTWTGQGRTPSALKLALENGKSLEEFEI

SEQ ID NO: 11064 - protein, 350 aa, Unknown
  Frankia sp. EAN1pec
MTSCTTESSREVGRSCRARCRCGDRSPPRSARTHTDHMASAAGPPRPVRNVTRRDALWGNAARGDTRWGDTRWGDARWGVAVDAQAGWVALVGGGPGRGDLITLRGLRLLRRADVVVVDRLAPRELLDELRPDVEIVDAGKAPHGHNLTQDEINALIVERALRGLGVVRLKGGDPFVFGRGGEEALACTAAGVPCEVVPGVTSAVAVPAMAGIPVTHRGITQDVAIVSGHLDPSHPGSTADWDALATGPGTVVVLMGVAALPRISAELIKRGRSPRTPTAVIHAGGTEHERLVTGPLGEITRLALAADVSSPAVIVIGEVVALRDQLAVGRIPDRADDGPARDDGPGQVG

SEQ ID NO: 11065 - protein, 1017 aa, Schizosaccharomyces pombe
MFRACSKLQYHGVNTSLSRHLFLAKRNLSISSACLEAKNSQKFPALDTFEPRHIGPSKTDQQYQLESLGYKDFDSFLKDVIPDSVRTPESQLMAFGSVNPNEKNPPVNYSESEFTTLANNVANQNKLIKSFIGMGYYNVKLPAAIQRNVLENPEWYTQYTPYQAEISQGRLESMMNYQTMIADLTGLSISNASLLDEGTAAGEAMVMLMANDKKKRKTFLVDKNIYPNTLSVLRTRASGFGIKIELDNITPELITKSAKHVFGIFVQYPAADGSIFDYGHLAATARSFNMHVVAATDLLALTILKSPGEWGADVAVGSTQRFGLPMGYGGPHAGFFACSEEFKRKIPGRLIGLSKDRLENPAYRLALQTREQHIRREKATSNICTAQALLANMSAFYAIYHGPNGLQEIANRIYASTSFLKSALESSGYKIVNKSHFFDTLTIEVESADKVLAKALDHGYNLRKVDDSHVGLSLDETVCDKDIQALFSIFNINKSVDQYYMEIATSEPNGNSASTVDNLSICSLPENFRRTTLYLQHPVFNRYHSETELMRYIHHLQSKDLSLAHAMTPLGSCTMKLNAVTEMMPITNPLFANIHPYVPEEQAKGYRHVIEDLQLMLTTITGFDAACFQPNSGAAGEYTGLSVIRAYQRSIGQGHRNICLIPVSAHGTNPASAAMAGFTVIPVKCLNNGYLDMQDLKEKASKHADKLAAFMVTYPSTFGIFEPDVKEALEVIHEHGGQVYFDGANMNAMVGLCKAGDIGADVCHLNLHKTFCIPHGGGGPGVGPICVKKHLADFLPSHPVVSCGGKNGITSVSSSPFGSAGILPISWAYMRMMGLAGLRDASKAALLNANYMAKRLSSHYKLVYTNKNNLCAHEFILDAREFKATAGVDATDIAKRLQDYSFHAPTLSWPIANTLMIEPTESESMYEMDRFCDALISIRQEIREIEEGLQPKDNNLLVNAPHPQKDIASEKWDRPYTRERAVYPVPLLKERKFWPSVARLDDAYGDKNLFCTCSPVV

SEQ ID NO: 11066 - protein, 229 aa, Lycium ruthenicum
  misc_feature (179)..(179): Xaa can be any naturally occurring amino acid
LNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIXVLGTGKKKFEQEIEKLEVLYPDKAKGVAKFNVPLAHTITAGADFMLVPSR

SEQ ID NO: 11067 - protein, 350 aa, Lycium schizocalyx
  misc_feature (82)..(82): Xaa can be any naturally occurring amino acid
DTSVAVEIKVGDSIETVRFFHCYKRGVDRVFVDHPMFLEKVWGKTASKIYGPKVGQDYVDNELRFSFLCQAALEAPRVLNLXCSKYFSGPYGEDVLFIANDWHTALIPCYLKSMYQSKGIYLNAKVAFCIHNIAYQGRFPFSDFSLLNLPDEYRSSFDFIDGYEKPIVGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 11068 - protein, 702 aa, Arabidopsis thaliana
MTETKLFKVSSGEVSPLGVSQVDKGINFALFSQNATSVTLCLSLSQRYITSSGKDDTDDDGMIELVLDPSVNKTGDTWHICVEDLPLNNVLYGYRVDGPGEWQQGHRFDRSILLLDPYAKLVKGHSSFGDSSQKFAQFYGTYDFESSPFDWGDDYKFPNIPEKDLVIYEMNVRAFTADESSGMDPAIGGSYLGFIEKIPHLQDLGINAVELLPVFEFDELELQRRSNPRDHMVNTWGYSTVNFFAPMSRYASGEGDPIKASKEFKEMVKALHSAGIEKYSYKFSLQVILDVVYNHTNEADDKYPYTTSFRGIDNKVYYMLDPNNQLLNFSGCGNTLNCNHPVVMELILDSLRHWVTEYHVDGFRFDLASVLCRATDGSPLSAPPLIRAIAKDSVLSRCKIIAEPWDCGGLYLVGKFPNWDRWAEWNGMYRDDVRRFIKGDSGMKGSFATRVSGSSDLYQVNQRKPYHGVNFVIAHDGFTLRDLVSYNFKHNEANGEGGNDGCNDNHSWNCGFEGETGDAHIKSLRTRQMKNFHLALMISQGTPMMLMGDEYGHTRYGNNNSYGHDTSLNNFQWKELDAKKQNHFRFFSEVIKFRHSHHVLKHENFLTQGEITWHEDNWDNSESKFLAFTLHDGIGGRDIYVAFNAHDYFVKALIPQPPPGKQWFRVADTNLESPDDFVREGVAGVADTYNVAPFSSILLQSK

SEQ ID NO: 11069 - protein, 300 aa, Triticum aestivum
AGGDLGRHPRMVLRDQPHVARRGALAQGGEGPVPRQVGLPRRAGFPVLHLREGARPGWGDPGDGEGRVRLPGDDHPPPSLLNQRSQEGPGHRGRRRRRSAGGLTALLGGADRHLRDRQDGGRCVQAVLPSSGPRVRGPSRVPAHRRRRRLLKNAPEGTYDAVIVDSSDPVGPAQELFEKPFFQSVSRALRPGGVVCTQAESIWLHMHIIEDIVTNCRQVFKGSVNYAWTTVPTYPSGVIGFMLCSTEGPSVDFQHPVFSIEEDEYSTKSKGQLKFYNSEFHTASFCLPSFARRVIEAKAN

SEQ ID NO: 11070 - protein, 300 aa, Magnaporthe grisea
MASKPGDFDAVRKDIVSLLDQPEYDDGSAGPVLVRLAWHSAGTYDKSTDTGGSNGAGMRYEAEGGDPANAGLQNARQFLEPVKARHPWITYADLRTLAGVVAVRAMGGPEIPWRAGRTDFADDSRVPPRGRLPDATQGAAHVRDIFYRMGFDDREIVALSGAHSLGRCHPANSGFEGKWVNNPTRFSNQYFRLLLSEDWREKTVAGTGLKQFVAVDEVTGDELMMLPTDLSLTSDPVFARWVKVYRDDQDLFFADFAKVFDKLMELGIKRDAEGKVINKENVEGGYVSAPKKQGKIASKL

SEQ ID NO: 11071 - protein, 154 aa, Brassica napus
MAPKAGKKPAEKKPAAAAAAEKPVEEEKVAEKAPAEKKPKAGKKLPKEAIGATDKKKKRSKKNIETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 11072 - protein, 548 aa, Alteromonadales bacterium
MSNRTQLASWQALEQSAAKMKQTHLKTLFAQDGTRFSKFSTQIPGVLFDYSKQLIDNDVFANLVSLAKECDIASWRDKMFSGEKINITEERSVLHTALRNRAHTPLIVDGENVTQAVDNELAKIKVFVEKVRSGQWLGYTGKAVKDVVSIGVGGSNLGPQMATEALKALADNTLNVHYVSNADGVQIASVLKNIDPETTLFVISSKTFTTSETMTNAKTAVAWFLKTTKDESTIAKHFVAVSTNLEKTAAFGIADENVFTMWDWVGGRFSLWSAIGLPIALYLGYDAFEEILTGAFEVDEHFKNAPLEQNIPLIMALLSVWNTSFLGYTSQAILPYDQSLHMLPAYLQQGEMESNGKHVNFAGKVVPYTTVPIIWGMTGINGQHAFYQCLHQGNVIVPADFIASVKPQINVDKHHDILLSNFFAQTEAMMSGVDAEQVTADLTAKGKSQAQIDELLNHKIHQGNRPTTSMLLDTVDAKTVGRLIALYEHKIFCQGIILDICSFDQWGVELGKGLASKIESELTDDSVNHDHDSSTSGLMAYYKQHRTQ

SEQ ID NO: 11073 - protein, 275 aa, Bacillus halodurans
MELWYTEKQTEHFGITAKIKRTLHTEKTDFQQLDVIETEEFGNMLVLDGMVMTTEKDEFVYHEMVAHVPLFTHPNPKHVLVVGGGDGGVIREVLKHPSVEKATLVEIDGKVIEYSKKYLPSIATALNDPRVDVQVDDGFLHIAKAESAYDVIMVDSTEPVGPAVKLFEKGFYQGIAKALKEDGIFVAQTDNPWFHGELIRKVYADVQEIFPITRLYTANIPTYPSGLWTFTIGSKTYDPLHVEPSRFYDIETKYFTKDLHKAAFALPRFVDDLIK

SEQ ID NO: 11074 - protein, 985 aa, Crocosphaera watsonii
MPNLDITANQPKTNDNRTYNIENTLAPTDSFINRHIGPNSQEIDKMLKVLGFSSLDKLIDATVPQGIHLSKTLILPEAQSEYGALAQLKSIASKNQIFRSYIGMGYHDCITPPVIQRNILENPGWYTAYTPYQAEIAQGRLKALLNYQTMIVELTGLEIANASLLDEGTAAAEAMSMSYGLCKNKNANAFFVDCHCHPQTIEVIKTRAYPLGIELIIADHRFFEFEQEIFGALLQYPATDGTIYDYRTFIESAHDKGALVTVAADPLSLALLTPPGEFGADIAVGSTQRFGVPLGYGGPHAAYFATREAYKRKIPGRIVGVSKDAQGNPALRLALQTREQHIRRDKATSNICTAQVLLAVIAGMYGVYHGPEGVKNIAQRIHQLTVILAKGLQKLSYTVNDEPFFDTVRVGVGDASVKAVIAAAAERKINLRLYTEGVLCISLDETTTVHDVVELWQIFAAKDELPFTVEEIAEEVNFDLPIFFQRTSEYLTDPVFNQYHSESKLLRYLHQLESKDLALNTSMIPLGSCTMKLNSAAEMMPVTWPEFGKLHPFAPLSQTEGYQILFQQLEVWLGEITGFDGISLQPNAGSQGEYAGLQVIRQYHENRGEANRNICLIPESAHGTNPASAVMCGMKVVPVKCDKEGNIDIADLQKQAEKHSENLGALMVTYPSTHGVFEEEIINICNIVHNHGGQVYMDGANMNAQVGVCRPADFGADVCHLNLHKTFCIPHGGGGPGMGPIGVKEHLIPFLPTTNLDKFTDPNSNGKVDTSIGAISAAPWGSASILVISWMYIAMMGEKGLTEATKVAILNANYMASRLADYYPILFKGASGCVAHECIIDLRPLKNQAEVGVDDIAKRLMDFGFHAPTVSWPVGGTMMVEPTESEDLAELDRFCDAMITIHQEAQAIADGTIDPANNPLKNAPHTAEMVICQEWDRPYSREKAAYPASWSKEHKFWPTVGRIDNAYGDRNLVCSCEGMDAYKED

SEQ ID NO: 11075 - protein, 513 aa, Methanococcus maripaludis
MCSISGIIAKDEEGSGSRSLLKNIQKHVINMMKILKHRGPDYSGMMFDDEVLYFENFDDITENTETISRMAMGHNRLAIVGTAVQPIPNTDESIWIICNGEIYNHVELRDELSVDHEFKTDTDSEAIIHTYEDELVDVLDGDYAYAIYDKEKNIIELRRDLMGVKPLYYIDTDEYFAFASEKKALYGLLMEINEMDYKSAFNYDISRLNPNSRLIYELDENSWYIEEDLEKVNPDYFEENDYELCKNELETTILDSVLKRVKGLERVGIIYSGGVDSTLVSKLASENCDVTLYSVGSANSEDLIYAERAAKDMGLKFRKKIILEDEFEEYVIKVAKAIDELDVMKLSVGIPIFAASEMAKEDGIKVVLSGQGADELFAGYNRYQRILNEKGEEGLKKSIISDVFDIHKVNLERDDHCTMANGVELRVPFLDKFVIDVGLSIPVEYKIEEPRKKILRDIASKYVPDYIAQRPKKAAQYGSGSEKMVYAVAKKHGYSKKEINKFFEEYLIEKIKF

SEQ ID NO: 11076 - protein, 358 aa, Xanthomonas axonopodis
MSQSKPLFPLNAWYAVAWDHEIKHVLSPRKLCNLDVVVYRTTSGAVVALEDACWHRLVPLSMGKLRGDDVVCGYHGLVYNTQGRCVHMPSQDTINPSACVRSFPVAEKHRYVWIWPGDPAKADTRLIPDLHWSHDPAWAGDGRTIHAKCDYRLVLDNLMDLTHETFVHGSSIGQDEVAEAPFDVVHGDRSVVVSRWMRNIDPPPFWASQIARHLDYRGKVDRWQIIRFEAPSTIAIDVGVAITGTGAPEGDRSQGVNGYVLNTITPETDTTCHYFWAFMRNYALHDQSLTTLTRAGVTGVFGEDEAVLEAQQRAIDAHPDHTFYNLNVDAGGMWARRVIDRLIAQEQRAQDLSLRMVG

SEQ ID NO: 11077 - protein, 417 aa, Ralstonia eutropha
MGAPEMIKQHLIDPEICIRCNTCEDTCPIDAITHDERNYVVKADVCNACNACLSPCPTGAIDNWRTMLKGQAYPIEEQLLWDELPAEIPLPAAELDAAGTDEALRADTATAAAEGGVTVQAVETSRHTSARAPWSAAHPYVNLHGVRAPMAATVAGNYRLTAEDASSDIHHIVLDFGTHFFPVLEGQAIGIVPPGTDAAGKPHYIRMYSVASPRDGERPGYNNLALTVKRVEEDHDGNPVRGVASNFLCDLAKGDTVQVVGPFGTTFLMPNHREASIMMICTGTGSAPMRAMTERMRRNMEHFGGRRMLFFGARNARELPYFGPLLKLPKDFLDIHFAFSRDAEVPRRYVQDAIREASAGVTALLSDPHGHVYICGLKGMEEGVLAAFGDVCAASGMSWPELEATMKAEGRLHIETY

SEQ ID NO: 11078 - protein, 314 aa, Bifidobacterium longum
MLADAGNTVTMWAKEQQIVEGIRDHHHNAVRLPSVEKLPDNMTATGDRAEAVKNADIVVVAIAAQFARVALVEFKGLIPDHAIVVSLMKGIERGTNKRMDEVVRESLDLPADRFAAISGPNLSKEIADRHPAATVVACTNLDNATKVAEACTTSYFKPFVTTDVIGLEMCGSLKNVTALAVGMARGAGYGENTAAMIETRGLAELTALGVAAGADPKTFFGLAGVGDLIATCGSSLSRNYTFGANLGKGLTVEEATKVSNGVAEGVPTTDAVVALGNQLDVPTPLAYQMSRVLNEGISCSEMLAGLFGHEVTGE

SEQ ID NO: 11079 - protein, 506 aa, Hordeum vulgare
MPPRRPNTGGGGGTSSSAAPAPRKVPLRSLLRAASVACGVQFGWALQLSLLTPYVQELGIPHAFASLVWLCGPLSGLLVQPLVGHLSDRITPANSPLGRRRPFIAAGAASIAFAVLTVGFSADLGRLFGDNVVPGSTRIGAIIVYLVGFWLLDVGNNATQGPCRAFLADLTENDPRRTRIANAYFSLFMALGNILGYATGAYNGWYKIFPFTITGSCGVSCANLNSAFLLDIIILAITTYISVATVQDNPTFGSDEAAPPSSHEEEAFLFELFGSFKYFTMPVWMVLIVTSLTWVGWFLFILFDTDWMGREIYRGSPEIVADTQKYHDGVRMGSFGLMLNSVVLGITSIGMEKLCRKWGAGLVWGVSNIIMALCFVAMLIITYVAQNLDYGPSGAPPTGIVAASLIVFTILGAPLSITYSIPYAMAASRVENLGLGQGLAMGILNLSIVIPQIIVSLGSGPWDQLFGGGNAPSFWVAAAASFVGGLVAILGLPRARLGPKKKTTQR

SEQ ID NO: 11080 - protein, 176 aa, Hevea brasiliensis
MASQSEPKSVYDFTVKDARGNDVDLSTYKGKVLLIVNVASQCGLTNSNYTELTQLYQKYKDQGLEILAFPCNQFGSQEPGTNEQIVEFACTRFKAEYPIFDKVDVNGNNAAPLYKFLKSSKGGIFGDNIKWNFSKFLVDKDGNVVDRYAPTTVPSQHREGCEETAGDCMSAQGRPN

SEQ ID NO: 11081 - protein, 523 aa, Hordeum vulgare
MARGGGNGEVELSVGVGGGGGGAAPRAAEPAVQISLGRLILAGMVAGGVQYGWALQLSLLTPYVQTLGLSHALTSFMWLCGPIAGLVVQPCVGLYSDKCTSRWGRRRPFILTGCVLICLAVIIVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLSLALVITLIFAKEVPYKAIAPLPTKANGQVEVEPTGPLAVFKGFKNLPPGMPSVLLVTGLTWLSWFPFILYDTDWMGREIYHGDPKGTPAEANAFQEGVRAGAFGLLLNSVVLGFSSFLIEPMCKRLGPRVVWVSSNMLVCLSMAAICIISWWATQDLHGYIQHAITASKEIKAVSLALFAFLGIPLAILYSVPFAVTAQLAANKGGGQGLCTGVLNIAIVIPQVIIAVGAGPWDELFGKGNIPAFGMASVFALIGGVVGIFLLPKISRRQFRAVSGGGH

SEQ ID NO: 11082 - protein, 694 aa, Zea mays
MGHTSSGNEVPLKYSSGKAFPLGVSQVDDGLNFAIFSQHASSVTLCLNFPERGNQDDVDIVEFALDRQRNKTGDIWHVSVEGLPASGVLYGYRINGPQGWQQGHRFDDSVILLDPYAKLVYGRKHFAVEKEKPSQLFGTYDFDSSPFDWGDNYKLPNLPETDLVIYEMNVRAFTADESSRLAPAIRGSYLGVIDKIPHLLELGVNAVELLPVFEFDELELKRFPNPRDHMVNTWGYSTINFFAPMSRYASAGGGPVAASKELKQMVKAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKEIAKDSVLSRCKIIAEPWDCGGLYLVGRFPNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 11083 - protein, 271 aa, Unknown
  Synechococcus sp. CC9605
MTLPLRTTSLDPVQIPGWRWQPFLDTAVAALSSLQPDPYPIAERFLQKEGSTGSKAKPVPVRTATWACSTEKLRQVRCACVEAGAAASVLNFVINPSSRFDLPFFGADLVTLPNGHLLALDLQPVDKTDPDHTGPVWQRLMPLFERWRAQLPDGGPIPEEAQPYFSPAFLWTRIPLGEEGDALIDRVIRPAFADYLQLYLALVEEAQPVDHERAAHLLLGQKRYTAYRAEKDPARGMLTRFYGSEWTESYIHGVLFDLEEATATSLSPQGS

SEQ ID NO: 11084 - protein, 156 aa, Glycine max
  misc_feature (52)..(52): Xaa can be any naturally occurring amino acid
  misc_feature (142)..(142): Xaa can be any naturally occurring amino acid
ANLKISCSAVTAVHRANASMIAPFTGLKSMAGCPLAKTANHITSIASNGGRXHCMHVWPPLVKMKFETISYLPDHDDAQLAKEIEYLLTIGWIPYFEFELEHGIAYREHDMSPRYYQRRYWYTLTCQFLTALIATTVSYELXQARTEYSIGYIRII

SEQ ID NO: 11085 - protein, 399 aa, Acidobacteria bacterium
MANVTKKKGVIGILTGGGDVPGLNPAIRGVTFRALREGYDVIGLRRGWGGLVDIVRDKDHDNSENFVHLSETVVNRAARTGGTFLHTSRTNPSRVAKDKVPAHLQGQFNAEKNDLTSEMLKNLEWLGIDYLIPIGGDDTLSYGVRLYQEGVKVVAIPKTMDNDVPGTDYCIGFSTCVTRTIQMVNSLRTSAGSHERFLVVEVFGRYAGFTALLPTMAGAANRCVIPEFKFNIESLAELMANDRKRNPSRYSVVLISEGAMFEGGEMVFQSESTDAFGHKKLGGIGDLIAAKLTELSPKYCGKTVNCLTQKLGYLVRGGDPDAIDSIVPMAYGNLALDLILNKIHGRLVVLKNGRYDNVPVDVVTSSKKVIKVKEHYNTERLRPHYESFEMKPLFIMTSE

SEQ ID NO: 11086 - protein, 225 aa, Oryza sativa
MGRRPVRCYRQIKNKPYPKSRYCRGVPDPKIRIFDVGQKKRSADDFPLCVHLVSWEKENVSSEALEAARIACNKYMAKHAGKDAFHLRVCAHPYHVLRINKMLSCAGADRLQTGMRGAFGKPTGTCARVRIGQVLLSVRCRDANAAHAQEALRRAKFKFPGRQRVIFSAKWGFTRFKRDEYLKLKSEGRIVPDGVNAKLLTRHGSVADRQPGRGVFPPSVAGSDA

SEQ ID NO: 11087 - protein, 494 aa, Unknown
  Dehalococcoides sp. BAV1
MKILLVNPGTEYKPRFRTYAVFPNGLLYIASVLERAGHEVRIFDNVVSELTPPDYAKDFAPEVVGFSVLTGPCIGNALVQSKEFKALLPGVKVVWGNVHATCTTEQTLNEEAIDFVVRGDGEYTFLDLIEHLEKGEENYAEIQGLAWKDREGRVIINQPRPFIHNLDELPNPAWHLIDVPKYWDITLNTSRGCPFKCSFCYNIPFHQGHRADLSVERIIAQIEHLQKNYKVKFIRFFEDNFTFNRKRMREFCQTVIERRIKIKWDTESRADMSEEDVALMAKAGCTSVGIGVETGSKRMLEYLNKGVDLDEMGRTFWRFVKHGIMPRLYIMLAVPTETVEDFTETQDMLHRMEDPPFMYMRFVPYPGTPLYNQLVQDNRIKPPESLGEWAKFSVYFATKGNLSELSDEVINQAISHWAHSYASRRVMFTLRHNPRYLLSAVKNPSEFFKAVSSLIKNSLPVVFNKNTNIKPLVLEAVPNKMPGKQEPRLISNYE

SEQ ID NO: 11088 - protein, 444 aa, Neisseria gonorrhoeae
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFTSVLTGKGLEWGGSLIRPEATGYGCVYFAQAMLQTRNDSFEGKRVLISGSGNVAQYAAEKAIQLGAKVLTVSDSDGFVLFPDIGMTEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWAREEVDSRLFGIMQSIHESCLKYGKVGDKVNYVNGANIAGFVKVADAMLAQGF

SEQ ID NO: 11089 - protein, 112 aa, Alteromonadales bacterium
MKKIEAIIKPFKLDDVREALSEVGINGMTVSEVKGFGRQKGHTELYRGAEYMVDFLPKVKLDIVLADESVDRAIEVIVKTAQTGKIGDGKIFVTEVERVVRIRTAEEDEDAI

SEQ ID NO: 11090 - protein, 356 aa, Unknown
  Photobacterium sp. SKA34
MSKEKILFIDRDGTLIVEPPVDFQVDRLDKLKFEPNVIPALLALQNAGYKLVMVTNQDGLGTDSYPQADFDAPHNMMMEIFESQGVVFSDVLICPHFDNEGCSCRKPKLGLVKEYLQQGRVDFETSAVIGDRITDLQLAENMAIRGIQYNPETMNWMQILTDLTTQPRIAEVVRTTKETDIRVKVNLDQTGGNTISTGLGFFDHMLDQIATHGGFQMTLTVDGDLHIDDHHSVEDAALALGEALKKALGDKRGIGRFGFSLPMDECLAQCALDLSGRPYLKFDAQFSRDQVGDLSTEMVPHFFRSLTDTLACTLHLSSTGNNDHHIVESLFKAFGRTLRQAIKVEGNELPSSKGVL

SEQ ID NO: 11091 - protein, 584 aa, Saccharomyces cerevisiae
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMRVGEVAHGSDNALYTSAARYEVSEVFSFTHVEVGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFFLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 11092 - protein, 522 aa, Neisseria gonorrhoeae
MKHRTFFSLCAKFGCLLALGACSPKIVDAGTATVPHTLSTLKTADNRPASVYLKKDKPTLIKFWASWCPLCLSELGQAEKWAQDAKFSSANLITVASPGFLHEKKDGEFQKWYAGLNYPKLPVVTDNGGTIAQNLNISVYPSWALIGKDGDVQRIVKGSINEAQALALIRNPNADLGSLKHSFYKPDTQKKDSAIMNTRTIYLAGGCFWGLEAYFQRIDGVVDAVSGYANGNTENPSYEDVSYRHTGHAETVKVTYDADKLSLDDILQYYFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKAAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSFNMRRTEVRSRAADSHLGHVFPDGPRDKGRLRYCINGASLKFIPLEQMDAAGYGALKGKVK

SEQ ID NO: 11093 - protein, 304 aa, Myxococcus xanthus
MDMRGVTQRLLLMGLVVLACTASASRKVLYEKESPYTLISVTEDEEGRRYLGFDASGALQSVVRPGKPLDLVLPYTQVSMVGLAYVPAPKRILIVGLGGGAMPMFLRKVVPRAHIDVVDIDPDVVTVARRYFGFREDTHLRAHVGDGRRFIEAERPAYDLIFLDAYGPDSIPEHLATQEFLAVVRAKLSPQGAVVGNVWAFPPNRHYDAMVHTWQVAFTQLYEFIVPQSSNRILVGVGYEEKVAAKTLEARAEKLERTRGVPFDLSGLVDRGYTDATERQLRGKVLKDADLPKPESVTTPAQVR

SEQ ID NO: 11094 - protein, 358 aa, Lycium shawii
  misc_feature (161)..(161): Xaa can be any naturally occurring amino acid
YDQYKDAWDTSVAVEIKVGDSIETVRFFHCYKRGVDRVFVDHPMFLERVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPDEXRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 11095 - protein, 313 aa, Sorghum bicolor
EFGTRSLPCLQQQWSLPRFAAAATSVRAIGVCYGVIGSGLPSKSDVVQLYKSNGITSMRFYFADKDLLTALRGSGISLALDVGNDKVGELASDSAAAASWVRDNVQAYYPDVDIRYVVVGNEVPGAASVLQAMQNVHAALASAGLAGNVRVSTAVKMDAIENSSPPSSGVFKDPAAMSPIVQFLAGNGAPLLANVYPYFAYEYSDGIDLNYALFQPSSTTVTDPANGLVYTNLFDAMVDAVRAALDKAGGGGGVDVVVSESGWPSADGKGATVDNARTYNQNLINHAGKGTPRKPGSMEVYVFAMFNENQKDS

SEQ ID NO: 11096 - protein, 233 aa, Oryza sativa
MAGGGDELKLLGMWASPYVLRVKLALSLKGLSYDYVEEDLMNKSDLLLSSNPVNKKVPVLIHNGKPICESQIILQYLDEAFPGAGATLLPADPHERAVARFWAAFNDDTLLAASQAASWGKTEEERAEGEKKVVEALERMEVGLRECSKGKPFFGGDTVGYLDVVLGGFLAWVRATDVMRGVKRFDPATTPLLAAWAERFVELDAAKAVMPDMDKMIEFGKVLQARASRHQLK

SEQ ID NO: 11097 - protein, 174 aa, Medicago truncatula
MARMSQEPLIVGRVIGEVLDSFTTSMKMTVSYNKKQVFNGHEFFPSTINTKPKVEIDGGDMRSFYTLVMTDPDVPGPSDPYLREHLHWIVTDIPGTTDATFGKEVVSYEIPKPNIGIHRFVFVLFKQKNRESVTASPSSRDYFNTRNFASQNDLGLPVAAVYFNAQRETAARRR

SEQ ID NO: 11098 - protein, 332 aa, Unknown
  Mycobacterium sp. MCS
MVKAAVMGSGAWGTALAKVLADAGNSVTLWARRPEVAAEINDTHRNSGYLDEVDLPKTIHATADAAEALAGACTVVFAVPAQSLRSNLEQWKGLIADDATLVSLAKGIELDTLMRMSQVIVQVTGADPARVAVVTGPNLASEIADEQPAATVVACSDSGRAVALQRALATGYLRPYTNADVVGAEIGGACKNVIALACGMAVGVGLGENTVAAIITRGLAEIMRLGIALGAKPATLAGLAGVGDLVATCTSVQSRNRTFGERLGRGGTMESALRAAGGHVAEGVTSCRSVLALAASYDVEMPLTDAVNRVCHKGLSVDEAVVLLLGRSTKPE

SEQ ID NO: 11099 - protein, 716 aa, Candida glabrata
MPAHVPEVGHKYINDYNGYTYNIHTFLYDLIVFLFNAVITTFFREIKVRGGYNVPPRGVPTILVCAPHANQFIDPTLVMITTRQLGYIRGKLRSRQACFVTAASSLKMKFVGLFGNAMGSIPVPRIQDNLKDMDSNLIIYAPDFENNPTMLKGKCLDGSNPGFTTKFTVKSLIGLPNYLSNANIAEIPDDSTIVLSAPFKNDKNGKVAELLTQGTTFKYAEKIDNTETFQSVFDHLHTKGCVGIFPEGGSHDRPSLLPIKAGVAIMALGAAAADPKMEVAVVPVGLHYFHRNKFRSRAVIEYGEPIMVNGDMGKEYKQQPRETVSRLLKKVSDALFTLTENAPDYETLMTIQAARRLFQTNNSRIPLPAVVEIQRRLLVGYKKFQSDPRIMHLQNSVKEYNNKLYSMGLKDHQVMSLKTKPYETLRCAVTLLQRIFRVTLFFFLSLPGSIMFLPIFVGSHFYSKKKQREGLKKSSVKIEGKDLIATWKLIVALLMAPSLYITYTIILMVLHQRRSKYVWWVWVPTENKVIQFIYFYMLLVLVAYSSLKTGEIGFDLFKSLRPLMISLVYPQDYIHELQTRRKELSNEVTEICNELGPQVFPDYEKFASSYLIKKDKKDESKPEKDYLSQNSTGLSGRSRSSSIYSMISNVSNSLSRVNSRGSLTDVPIFSDSRQGEWTNITSDDEQSNSKEETPTNKLSSKITDLMRSKREKEKVD

SEQ ID NO: 11100 - protein, 598 aa, Coccidioides immitis
MVASHSGNARKPARSFPRTVHPTPSFPEVSLDYDDDPPQKNAWQRLLDSFKRNPHAQVSKLGQIDTNGKLFDLEEAVANIALSPLKRKLKGRHLQMIAIGGSVGTGLFVSSGRSLAIGGPASLVIAFSLVGIMVYSTIHALGEMAVLFPVAGSFSSFSTRFLDPAWGFAMGWNYALQWLVVLPLEIVAASLTVSYWPSHISPAAWVAIFYTMVITINLFGVQGYGEAEFIFSIIKVVAIVGFIILGIVINIGGGDNGSYIGFRYWRDPGAFNHGFKGLCSCFVNAAFAFTGTELVGLAAAEASNPVKALPSAVRQVFWRITLFYIVALIIVGLLVPYTEARLLNPASQADTKASPFVIAIRDAGIQGLDSVMNVVIMLAVLSVGNSAIYGSSRTLAALAEQHQAPRFLAYIDRRGRPLFAIIVASAIGLLSFLAASSKQEEVFIWMMAISGLSSILNWASICLAHIRFRRGWALQGHSLDELAFTSQPGVVGSWIGFIFNILVLMAQFWVGVAPIIQEMDGDPTVAGVKNWFSVYLAAPIVILFYVPYKIRFKTKIVRAKDMDLKTGRRDLHLAHLIAEERAERAEWPLWKKVYRFFC

SEQ ID NO: 11101 - protein, 400 aa, Zea mays
MATGEEHVAAPAPAVEETPEKKQASTTELPAPSGWTKKLAPTRGGRGGRFEVIFVSPTGEEIKSKRQLTQYLKAHPGGPASSEFDWGTSDTPRRSARLSEKVKATESPEGEKTPKRARSSSKRGKKEEKVDAEDANEAGEDGAAAEGKGTDVEMKDAENAEDEKKDVPSAEKTEEVDDKKDAENVEMKDAAEKTEEVEDKKEEAPTVDAAENTVEGDDKKEEPPAEKTDEKEEAPAVDAAEKNEEGDDKKEEEPPAEKKTVEKEVVPAVDAAENTEQSTGGQAQPNDVAAPESENKGDGKPAESESAPLAFVDDAAPLVIVGEEKTEDSQAAESAVPSLASSEGEKKENGGATEPAAPPPADADKGAENSGQVNTAPQEPTAANCDKGQIQPGASAVRCT

SEQ ID NO: 11102 - protein, 144 aa, Gloeobacter violaceus
MRILHTMLRVRDLEASKAFYCDVLGMKLLRQKDYPDGKFTLAFVGYGSEADSAVIELTHNWERDHYDLGDAFGHIALGVEDIYRTCSELTARGGKVVRQPGPMQHGSTVIAFLEDPDGYKIELIQKSASPQTAEEVAMARAGNS

SEQ ID NO: 11103 - protein, 319 aa, Bacillus halodurans
MKRIGVLTSGGDSPGMNAAIRAVVRKAIYHGVEVYGIYQGYAGLISGDIRKMELGSVGDIIHRGGTILYTARCEEFKTLEGQKKGIEQLKKFGIEGLVVIGGDGSFAGAQKLTEHGFPTVGVPGTIDNDIPGTDFTIGFDTALNTVIDAIDKIRDTATSHDRTYVIEVMGRNAGDLALWSGLADGAETIVIPEADHDIDQIISRLQRGQERGKKHSIIVVAEGVGSGMDFGREISERTGAETRVTVLGHIQRGGSPTGFDRVLASRLGAKAVDLLLEGQAGVTVGIENNKLVHHDITEVLQRKHSIDLDMYRLSQELSI

SEQ ID NO: 11104 - protein, 357 aa, Candida glabrata
MSATALRIAPIASRTFQRRLGYLLAGVATGAAATVAYKAQKNNNYYKYNNNNNNNSGFKAGALAAAAGVVHLAHEEDKKTADYQKVYNLIAERLRDDDEYDNYIGYGPVLVRLAWHSSGTWDKNDNTGGSYGGTYRYKKESQDPSNAGLENAAKFLEPVKKQFPWISYGDLYTLGGVVGIQELQGPKIPWRSGRTDLPEDMTPDNGRLPDGDKDANYVRNFYKRLDFNDREVVALLGAHALGKTHLKNSGFEGPWGAANNIFTNEFYLNLLNEDWKLEKNDAGNLQYNSPKGYMMLPTDYALIQDSNYLKIVKEYAADQDAFFRDFSKAFAALLERGIDFPKNQPVHIFKTLDEQGL

SEQ ID NO: 11105 - protein, 356 aa, Fusarium phaseoli
MATSAPVTSRTETLAKYLKLDQKGQIMAEYVWVDAAGETRSKSRTLPEKDYKAEDLPVWNFDGSSTNQAPGDNSDVYLRPCAVYPDPFRGSPNIIVLAECWNAGGTPNKFNFRHDCVKVMDTYAEDEPWFGLEQEYTLLGPDNRPYGWPTGGFPAPQGEYYCGVGTGKVVQRDIVEAHYKACLYAGIQISGTNAEVMPAQWEYQVGPCLGIEMGDQLWVSRFFLARITEEFGAKVSLHPKPIAGDWNGAGLHSNFSTKAMREEGGMKVIEEALKKLEPHHAECIAEYGEDNELRLTGRHETGSIDSFSWGVANRGTSIRAPRETAAKGYGYFEDRRPASNADPYRVTKALLQFSLA

SEQ ID NO: 11106 - protein, 473 aa, Crocosphaera watsonii
MTKRTFGVIGLAVMGENLALNVESRGFPIAVYNRTASKTEEFMKTRAQGKDVKAAYSLEEFVKTLERPRKILVMVKAGAPVDYVIEDLKPLLEEGDMIIDGGNSLYEDTERRTRDLESTGLGFVGMGVSGGEEGALKGPSLMPGGTKAAYEELEPILTKIAAQVDDGPCVTFVGPGGAGHYVKMVHNGIEYGDMQLIAEAYDIMKNALGLSNEELHEVFKEWNTTDELNSFLIEITADIFKYVDPDSKKHLVDLILDSAGQKGTGRWTVVSSLELGVPIPTMYAAVNARVMSSYKEERESASHQLTGPAIKFDGDKKAFINKVRDALYCSKMCSYAQGMALIAKASAEYYGNQVSLPESARIWKGGCIIRAGFLDKIKKAFVDNPDLPNLLLAPEFKQSILDRQEAWREVLVLANQVGIPVPAFSASLDYFDSYRRADLPQNLTQAQRDYFGAHTYERVDKPKGEAFHTEWAA

SEQ ID NO: 11107 - protein, 75 aa, Capsicum annuum
PEDMDTPRTLYKITSNSPGSEVAAEVAAAFAAASIVFKNIDSNYSAKLLRRSQSLFAFADKYRGSYQASCPFYCS

SEQ ID NO: 11108 - protein, 384 aa, Magnaporthe grisea
MSTNDIKLPEPFASIPRETFLFGPSPIQHLERISEALGGKVNVYAKRDDCNSGLAYGGNKTRKLEYLAAEAKAQGADTLVSIGGVQSNHTRQVAAVSTKLGLKAVLVQEHWVPDWSDPVYGKVGNIQLSRLMGADVKLDPSGRRERRPYAIPAGASDHPLGGLGFARWAFEVEEQERQMGVFFDTVIVCAVTGSTMAGMVAGFKLAQKKCGSKPRRVIGIDASATVPQTKEQVLRIAQVTGRKIGLEDGVDNVTTEDVELDDRYHAGIYGVPDQQTKDAIRFGASTEAFITDPVYEGKSLAGMMDMIRKGEIKPGSNVLYAHLGGQLALNAYSDIFIVHRRQSSLGNPMANPWPKHAMHLAEYSPANTWWWSKATMCGCKKHTL

SEQ ID NO: 11109 - protein, 80 aa, Capsicum annuum
PEDMDTPRNVYKVSPQNPGSDVAAETAAALAAASIVFKDSDPSYSSTLLHTAQKVFAFADKYRGSYSDSLSSVVCPFYCS

SEQ ID NO: 11110 - protein, 430 aa, Unknown
  Acidovorax sp. JS42
MHHLILGAGPAGVIAAETLRKHAPGDRITLVGDEAEPPYSRMAIPYLLVGDIDERGTYLRKRADHFAQQRIDRLSARAAGVDVQARTVALEGGVTLGFDRLLIATGSHPVRPPIPGLDLPGVQTCWTLADARAIAARARPGARVLQMGAGFIGCIIMEALQKRGVQLSVVEMGDRMVPRMMGAVAGGMIRDWCERQGVQVFTGHKVERIDRAQGEGSGDALRVHLSGGRVLDADLVISATGVRPAIGFLAGSGVTCLQGVLTDERMQTNVPGIYAAGDCAEAFDPFTRKTVVSAIQPNAAEQARVAALNMLGLPAALAVVTQINVLDTLGLISTSFGNWQGVPGGEQVALTDAAAGKHLSLQFEGDRLIGCNSVGMTQHVGAMRGLVEGQVRLGPWKEHLRRDPTRLMEAYLACAQGQGHWSGAQDARRR

SEQ ID NO: 11111 - protein, 325 aa, Capsicum annuum
GGYYDAGDNVKFVFPMAFTATLLSWSIIDFKRNMGSELGNAVKAVKWATDFLLKATAKEGVVYVQVGDPFSDHSCWERPEDMDTLRTVYKIDQNHPGSDVAGEIAAALAAASIVFRSLDASYSNLLLDRAVKVFEFANRHRGAYSSSLHSAVCPFYCDFNGYQDELLWGAAWLHKATRRRQYREYIVKNEVILRAGDTINEFGWDNKHAGINVLISKEVLMGRAPDLKSFQVNADAFICSILPGIAHPQVQYSPGGLIVKPGVCNMQHVTSLSFLFLAYSNYLSHANHVVPCGSMSATPALLKHIAKRQVDYILGDNPQKMSYMV

SEQ ID NO: 11112 - protein, 629 aa, Novosphingobium aromaticivorans
MCGIAGIVHTEGPKPVDPDRVRRMCDAIAHRGPDGEGVWTAPGIGLGHRRLSIIDLAGSPQPMKAAEGDAVIVFNGEIYNFRDLRKELQALGAQFRTDGDTEVILQAWRQWGTACLPRLHGMFAFALYDLRQRTTLLARDRLGVKPLFTARLADGAVIFGSELKALLAHPSLRREIDPLAVEDYLAWGYVPDHRSMLKGVEKLPAGHYQLLRHDAPPAAPVQWWDVSFADRANGSAEDLGAHLLHHMRDAVTSRMVADVPLGAFLSGGVDSSSVVALMAEASATPVKTCSIGFDVAALDETAYADRIAARFATEHRKRLVSPDDFSLVDRLAGMFDEPFADASALPTFRVCELAREHVTVALSGDGADEAFAGYRRQTFQHREEQARALLPSALRKPLFGTLGRLWPKADWAPRPLRAKTTLLSLAASGEEGYARALSVTSPELRETLYTPDFKRLRGDYRAEQPLIELMRKAPARSGLDRAQYADLKFYLPGDILTKVDRTSMAVGLEAREPLLDHRLVEFGASLPERLRVRGATGKWLIKQTMRRYLPEDVLFRPKMGFVTPLAQWLRGPLAHEARALASDGLLARTGWLDAARIDALADAHVSGRADHSRLIWQLLMLRKSLQLLG

SEQ ID NO: 11113 - protein, 626 aa, Lactobacillus coryniformis
MQANLQWLDDPEVFRVNQLPAHSDHHYYHDTAEFKTGSRFIKSLNGAWRFNFAKTPAERPVDFYQPDFDATDFDTIQVPGHIELAGYGQIQYINTLYPWEGKIYRRPPYTLNQDQLTPGLFSDAADNTVGSYLKTFDLDDAFKGQRIIIQFQGVEEALYVWLNGHFIGYAEDSFTPSEFDLTPYIQDQGNVLAVRVYKRSTAAFIEDQDMFRFSGIFRDVNILAEPASHITDLDIRPVPNANLKSGELNITTKVTGEPATLALTVKDHDGRVLTSQTQTGSGSVTFDTMLFDQLHLWSPQTPYLYQLTIEVYDADHQLLEVVPYQFGFRTVELRDDKVIYVNNKRLVINGVNRHEWNAHTGRVISMADMRADIQTMLANNINADRTCHYPDQLPWYQLCDEAGIYLMAENNLESHGSWQKMGAIEPSYNVPGDNPHWLAAVIDRARSNYEWFKNHPSIIFWSLGNESYAGEDIAAMQAFYKEHDDSRLVHYEGVVYTPELKDRISDVESRMYEKPQNIVAYLEDNPTKPFLDCEYMHDMGNSLGGMQSYNDLIDKYPMYQGGFIWDFIDQALFVHDPITDQDVLRYGGDFDERHSDYEFSGDGLMFADRTPKPAMQEVKYYYGLHK

SEQ ID NO: 11114 - protein, 219 aa, Actinidia deliciosa
ETGRHVRMLTHEIRSTLDRHTILKTTLVELGRTLDLEECALWMPSRRGLDLQLSHTLNNLIPIGSSVPSNLPIVNEVFNSAEAIRIPHTCPLARIKPRMGRYVPPEVVAVRVPLLHLSNFQINDWPDTSAKSYALMVLILPMDGIRKWRDHELELVEVVADQVAVALSHAAILEESMRARDQLLEQNVALDFARQEAEMAIRARNDFLAVMNHEMRTPM

SEQ ID NO: 11115 - protein, 163 aa, Neurospora crassa
MLIPKADRKAIHEYLFREGVMVAEKNYESTHETGIRNLYVIKACQSLTSRGYVKTQFSWQYYYYTLTPEGLDYLREWLHLPAEIVPATHIKSQRSHAPPRGMLGGEERRERPFGGRGRGDREGGYRRREAGEGKEGGAPGEFAPQFRGGFGRGRAGRGEAPPS

SEQ ID NO: 11116 - protein, 432 aa, Oceanicola granulosus
MSAPTRDDDGFFTEKLAGRDPEIWGAIQKELGRQRNEIELIASENIVSAAVLEAQGSVMTNKYAEGYPGRRYYGGCQYVDIAENLAIERACELFECEFANVQPNSGSQANQGVYTALLQPGDTILGMSLDAGGHLTHGARPNQSGKWFNAVQYGVRKQDSQIDYDQIQQLATEHRPKMLIAGGSAIPRIIDFARMREIADSVGALLLVDMAHFAGLVAAGIYPSPFPHAHVATTTTHKTLRGPRGGMILTNDADISKKVNSAIFPGIQGGPLMHVIAGKAVAFGEALRPEFKTYQEQVVANARALADQLMKGGLDIVTGGTDSHLMLVDLRPKAVKGNATEKALNRAHITTNKNGIPFDPEKPTVTSGIRLGTPAGTTRGFGEEEFRQVGDWIVEVVDGLAANGEDSNGEVEAKVRAEVEALCERFPLYPTL

SEQ ID NO: 11117 - protein, 424 aa, Unknown
  Synechococcus sp. WH 7805
MTARSLPSTGAVTGLKETLDFFRDPQFAQKRFTAYGEVFETRLLNQRLVFIRGEQPIADLFAQGDALEGWWPESVRQLLGNRSLANRSGEGHKARRRVVGQLFSAAALSRYTPSIAALVEELAEELIQAKAPVQLVPCMRRFAFAVIATTVLGLDASDRQALFADFEIWTRALFSIPVAIPGTPFAKALEAKKRLLLRLQQVLAQTSTRRGGLDLLSGGLDEAGIPLTDDDLVEQLLLLLFAGYETTASSLSCLMRALLLNPEVEQWLLPELLDQSWPNLDARSCPRLDATVLEVMRLTPPVGGFFRRTKDTVQLGGVAIPPNRVIQVALSPDLGDGSCDLADIRPQRHLDGSFTATLLPFGGGERVCLGKALAELEIRLMAVGLLQRVRLELTPDQDLTLQQIPSPSPRGGLLVRASARDTSR

SEQ ID NO: 11118 - protein, 435 aa, Nicotiana tabacum
MATNTLISASSPSPTMASSLTGAASRFLPSATIAATSSSSATTRLSLSSSSPSLKCLQSSPLLSHIFRYQKRSLVGTSSSGRFSTLASPKCAASDSDQLKSAREDIKELLKNTFCHPILVRLGWHDAGTYNKNIEEWPQRGGANGSLRFEVELKHGANAGLVNALKLLQPIKDKYANVTYADLFQLASATAIEEAGGPKLPMKYGRVDVSAPEECPEEGRLPDAGPPSPASHLRDVFYRMGLNDKEIVALSGAHTLGRSRPERSGWGKPETKYTKDGPGNPGGQSWTVQWLKFDNSYFKDIKERRDEDLLVLPTDAALFEDSSFKEYAEKYAVNQDVFFKDYAEAHAKLSNLGAKFDPPEGFSIDNTPTQGQPEKFVAAKYSTGKRELSDAMKQKIRAEYEGFGGSADKPLPTNYFLNIMIVIGVLAIVTSLLGN

SEQ ID NO: 11119 - protein, 386 aa, Nicotiana tabacum
MATNTLISASSPSPTMASSLTGAASRFLPSATIAATSSSSATTRLSLSSSSPSLKCLQSSPLLSHIFRYQKRSLVGTSSSGRFSTLASPKCAASDSDQLKSAREDIKELLKNTFCHPILVRLGWHDAGTYNKNIEEWPQRGGANGSLRFEVELKHGANAGLVNALKLLQPIKDKYANVTYADLFQLASATAIEEAGGPKLPMKYGRVDVSAPEECPEEGRLPDAGPPSPASHLRDVFYRMGLNDKEIVALSGAHTLGRSRPERSGWGKPETKYTKDGPGNPGGQSWTVQWLKFDNSYFKDIKERRDEDLLVLPTDAALFEDSSFKEYAEKYAVNQDVFFKDYAEAHAKLSNLGAKFDPPEGFSIDNTPTQGQPEKFVAAKYSTGKD

SEQ ID NO: 11120 - protein, 473 aa, Salmonella typhimurium
MPTHLVWFRRDLRLQDNLALAAACRDASARVLALYISTPAQWQAHDMAPRQAAFISAQLNALQTALAEKGIPLLFHEVADFNASIETVKNVCRQHDVSHLFYNYQYEFNERQRDAAVEKTLPSVICEGFDDSVILAPGAVMTGNHEMYKVFTPFKNAWLKRLKEDIPPCVPAPKIRVSGALSTPLTPVSLNYPQQAFDAALFPVEENAVIAQLRQFCAQGADEYALRRDFPAVDGTSRLSASLATGGLSPRQCLHRLLAEQPQALDGGPGSVWLNELIWREFYRHLMTWYPALCKHQPFIRWTKRVAWQENPHYFQAWQKGETGYPIVDAAMRQLNATGWMHNRLRMITASFLVKDLLIDWRLGERYFMSQLIDGDLAANNGGWQWAASTGTDAAPYFRIFNPTTQGERFDRDGEFIRQWLPALRDIPGKAIHEPWRWAEKAGVVLDYPRPIVEHKQARIATLSAYEAARKGA

SEQ ID NO: 11121 - protein, 409 aa, Glycine max
MLCSPVYMARPELGVSSFCVVGETAAGGRRALGLVAPFIMISPLIVRSHNTRESFPRGVGGAVLYISFYPPRWGWAGFPPRVFFSLRPSPKGKKNLPRKAKRNQTESSRLSAGSNFRGMATGSEAGKPAEVVLEWPKQDKKRMLHAVYRVGDLDRTIKCYTECFGMKLLRKRDVPEEKYTNAFLGFGPEDTNFALELTYKYGVDKYDIGAGFGHFAIANEDVYKLAETIKSSSCCKITREPGPVKGGSTVIAFAQDPDGYMFELIQRGPTPEPLCQVMLRVGDLDRSIMFYEKALGMKLLRKKDVPQYKYTIAMMGYAEEDKTTVLELTYNYGVTEYNKGNAYAQVAIGTDDVYKSAEAVELVTKELGGKILRQPGPLPGLNTKITSFLDPDGWKVVLVDHADFLKELH

SEQ ID NO: 11122 - protein, 442 aa, Caulobacter crescentus
MTLSRRHLIAAAAALPAIGAAKAPTPPKGFVTVKDGRLSLDGKPYRFAGTNVWYAAWLGAPAGYGDLGRLRRELDRLKAMGVTNLRILGAGEQSPAKVAMDPTFRGPGEDYNADLLKGLDVTLAEMAQRDMKAVIYVNNFWDWSGGMPAYLNWVGDGPWFQQGDPAYPWPQYADYSARFYANQKANALFRHYVTSLVSRVSTVTGKPYRDDPTIMSWQLANEPRPGGSDAFGQSNMPAYQAWIRDTAGLIKRLDNQHLVSTGSEGTMGCMGLESCVIDAHAPPVIDYMTLHIWPNNWGWISMTDQPSTYEAGEQKCRDYVAQHIALAKRLNKPLTIEEFGLIRDGRQFTPGSPTTYRDRFYKTMLDLALADMKAGGPTAGVNFWAWNGEGRAQQPDAWFKKGDKSYVGDPPQEEQGLFGVFDADASTLAVIKAHAAAVKALG

SEQ ID NO: 11123 - protein, 331 aa, Aspergillus nidulans
MSPPAAIFEPTVAPTGIKGKVVVPETATIPGDSQTKLLDHFGGKWDNFKFAPIRESQVSRAMTRRYFQDLDRYAESDVVIVGAGSCGLSTAYVLAKARPDLKIAIIEASVSPGGGAWLGGQLFSAMVMRRPAELFLNELGVPYEEDPDMPNYVVVKHASLFTSTLLSKVLSFPNVKLFNATCVEDLVTRPGPNGNAQEVQIAGVVTNWTLVTLHHDDHSCMDPNTINAPVIISTTGHDGPFGAFSAKRLVSMTTIDKLGGMRGLDMNSAEDAIVKNTREVAKGLIIGGMELSEIDGFNRMGPTFGAMVLSGVKAAEEALRVFDDRKRECAE

SEQ ID NO: 11124 - protein, 90 aa, Glycine max
MSGRRSRSRQSSGISEDQINDLIIKLQQLLPELRNSRRSDKVSASRVLQETCNYIRNLHREVDDLSERLSELLANTDTAQAALIRSLLTQ

SEQ ID NO: 11125 - protein, 379 aa, Agrobacterium tumefaciens
MAKADFYETLGVSKTADEKELKSAFRKLAMKYHPDKNPDDADSERKFKEINEAYETLKDPQKRAAYDRFGHAAFENGGMGGGGGGFGGGGFANGGFSDIFEDIFGEMMGGGRARRSSGGRERGADLRYNMEITLEEAFTGKTAQIRVPTSITCDVCSGSGAKPGTQPKTCATCQGSGRVRAAQGFFSVERTCPTCHGRGQTISDPCGKCHGQGRVTEERSLSVNIPSGIEDGTRIRLQGEGEAGMRGGPAGDLYIFLSVRPHEFFQRDGADLYCTVPISMTTAALGGTFDVTTLDGTKSRVTVPEGTQPGKQFRLKGKGMPVLRSAQTGDLYIQIQIETPQKLSKRQRELLQEFEQLSSKENNPESTGFFARMKKFFDG

SEQ ID NO: 11126 - protein, 376 aa, Pseudomonas stutzeri
MAKRDFYEVLGVERGASEAELKKAYRRLAMKHHPDRNPGDKAAEEAFKEANEAYEVLSDPSKRAAYDQYGHAGVDPQMGAGAGGAGYGGANFSDIFGDVFSDFFSGGRGGSRGGAQRGSDLRYTLELDLEEAVRGTTVTIRVPTLVECKTCDGSGAKKGTSPVTCTTCGGIGQVRMQQGFFSVQQTCPRCHGSGKMISDPCGSCHGQGRVEEQKTLSVKVPPGVDTGDRIRLSGEGEAGTQGGPAGDLYVVVNVREHAIFQRDGKHLYCEVPISFADAALGGELEVPTLDGRVKLKIPEGTQTGKQFRLRGKGVAPVRGGAAGDLMCRVVVETPVNLSKRQREMLEEFRGTLQGDTSHSPKASGWFEGVKRFFGDV

SEQ ID NO: 11127 - protein, 394 aa, Fusobacterium nucleatum
MAKRDYYEVLGVDKNASENDIKKAYRKAAMKYHPDKFANATDAEKKDAEEKFKEINEAYQVLSDNEKKQQYDQFGHAAFEQGGAGFGGGFNAGGFDFGDIFGDNIFGGGGGFGGFEGFSGFGGSSRRSYVEPGNDLRYNLEITLEEAAKGVEKTIKYKRTGKCEHCHGTGAEDDKMKTCPTCNGQGTIKTQQRTILGVMQSQSVCPDCHGTGKVPEKKCKHCRGTGTAKETVEKKINVPAGIDDGQKLKYAGLGEASQSGGPNGDLYIVIRIKPHDIFIRQGDNLYCEVPISYSTAVLGGEVEVPTLNGKKTVKVPEGTESGKLLKVSGEGIKSLKGYGKGDIIVKFTIETPKKLTDKQKELLQKFEESLNDKNYEQKTSFMKRLKKIFKDIID

SEQ ID NO: 11128 - protein, 484 aa, Haemophilus influenzae
MSVKGDIGVIGLAVMGQNLILNMNDHGFKVVAYNRTTSKVDEFLQGAAKGTNIIGAYSLEDLAAKLEKPRKVMLMVRAGDVVDQFIEALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYEEMQAIFAEWKNTELDSYLIDITTDILGYKDASGEPLVEKILDTAGQKGTGKWTGINALDFGIPLTLITESVFARCVSSFKDQRVAANQLFGKTITPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 11129 - protein, 441 aa, Arabidopsis thaliana
MANKYFSSVLKSLLLLLHLVFLSKQHVDSASIVKFLPGFEGPLPFELETGYIGIGEEEEVQLFYYFIKSERNPKEDPLILWLTGGPGCSSISGLLFENGPLTMKLDVYNGTLPSLVSTTYSWTKTSSMIFLDQPVGTGFSYSRTQQFNKPSDSGEAKRIHEFLQKWLGKHQEFSSNPFYVAGDSYSGLVVPATVQEISKGNYECCNPPINLQGYVLGNPLTDYAIDSNSRIPFAHGMALISDELYESLKKTCKGEYTNVHPRNTQCLKFIEEFNKCTNRILQQLILDPLCETETPDCYIYRYLLTTYWANDATVREALQINKESIGEWVRCYRTIPYDNDIKSSMPYHVNNSISGYRSLIYSGDHDLEVPYLGTQAWIRSLNYSIIDDWRPWMIKNQIAGYTRTYANKMTFATIKGGGHTIEFKPEEASIMFQRWINGQPL

SEQ ID NO: 11130 - protein, 322 aa, Novosphingobium aromaticivorans
MATTHKTRMLIIGSGPAGLSAAIYGARAGMEPIVVQGLQPGGQLTITTDVENYPGFRDVIQGPWLMQEMQAQAEHVGTRMMWDTILEVSLDGSPFRAVGDSGDIYEGDVLVIATGAQAKWLGVPGEQEFSGKGVSACATCDGFFYRGKKVVVIGGGNTAVEEALYLTNHSPDVTLIHRRDSLRAEKILQDRLFAHPNVKVLWNQKVDSFVGEAGKGLTGVKLVDTVTGAESVVETDGAFVAIGHAPATELFKGKLELDESGYIVVQPGTPKTAIPGVFACGDVMDHTYRQAVTAAGTGCMAALDAERFLAELDFKAAQAVIA

SEQ ID NO: 11131 - protein, 360 aa, Penicillium citrinum
MTDPNPVTLPTPFSTIPRTPLLLGPSPIHPLPRTTADLAKNNPHPLVTIYAKRDDLNSGYAYGGNKTRKLEYLLADAQAQGCTTLVSIGGVQSNHTRQVAAVAARSGLKARLVQEHWVDWTDPGYESTGNIQLSRLMGADVRLDPSGFGIEHKNTVQRVVEEARGDGEKPYYIPAGASDHPLGGLGFARWAFEVREQEGEMGVFFDTVLVCAVTGSTFAGMIAGFKLLERLYPADAKRRVVGIDASATVEATRAQVLRIAKNTAAKIGLSEDDITEDDVMLDDRYHAGIYGVPDRQTWDAIEYAAKMEAFITDPVYEGKSFAGMMDMIRRGEIKGGNILYAHLGGQLALNAYSELGRTNE

SEQ ID NO: 11132 - protein, 99 aa, Cyanophora paradoxa
MAVYKVRLICEEQGLDTTIECPDDEYILDAAEEQGIDLPYSCRAGACSTCAGKVVEGTVDQSDQSFLDDAQLAAGYVLTCVAYPSSDCTVKTHQEESLY

SEQ ID NO: 11133 - protein, 464 aa, Arabidopsis thaliana
MSKAWKLKLLLLLQLLLLSQHDVDSASVISYLPGFEGLLPFHLETGYIGVGEGEKVQLFYYFIKSENNPEEDPLIIWLTGGPACTALSALAFEIGPLTFKTEGYNGGLPSLVSTSYSWTKVASIIFLDQPVGTGYSYSTTPLSYKPSDTGEAKQTYEFLQKWLVENPQFVSNPIYVGGDSYAGIVVPAIVQQISIGNEHGYKPQINLKGYILGNPSTDLDSDHNSKIPYAHRMGLISDELYESLKRTCQGNYVKVDPTNTKCLKLMEDYGKCVSRINEGLILIALCDLASPNPYSGEHGGRSYLQTLVQSDLSLPTPDCYMYRYLLASHWANDEDVRRELHVVKGSIGKWMRCNWDLPYEKDIKSSVPYHRNNSIIGDYRSLVYSSDHDMMVPYIGTEAWIKSLNYSITDDWRPWFVNNQVIGYTRTYANNMTFATIKGGGHTAEYKPEESFMMFQRWISGRPL

SEQ ID NO: 11134 - protein, 545 aa, Castanea sativa
MESMEVSLNREGGGNSSKGGGGGDAFIDRSKVRILVCDNDAKSLEEVSTLLLKCSYQVTSVRSARQVIDALNAEGANIDIILAELDLPLAKGMKLLKYINRDNDLRRIPVIMMSAQDEVSVVVKCLRLGAADYLVKPLRTNELLNLWTHVWRRRRMLGLAEKNILNYDFDLVASDPSDANTNSTTLFSDDTDDRSCRSTNPEMGLSVHEEDESAGAAVEPPYIELDEYRPDVPKISDRRTGQFSSGPKKSELKIGESSSAFFTYVKTSTLQKSSPGVANVEENVAQVRMGENHQACVQQVVNDPQINDSGEVWESYSQGDEFPSSNSMPDSFSIERSSTPSASMELPQQRDLKDERFSQVLSHPRNEHQLDASGLPAQTAFPYCMSGVVNQVMMPSAAQLYHKNLHDLQNHSPKAMMSQYHHLPQCPPHVNGMAPFPYYPVNICLQPGQMSASHSWPFGSPSSSEVNLSKVDRREAALIKFRQKRKERCFDKKIRYVNRKRLAERRPRVRGQFVRKVNGVNVDLNGHPTSVDSDEDDEEDEEKHA

SEQ ID NO: 11135 - protein, 1691 aa, Cryptococcus neoformans
MSIANSSSSPEDQNITGLLENHSRETGELPSPPLVEDRAAPNGMKLDGENIVSQSNGISAAQAAVTTSRTSSLTSNLNRPQSVSGAQPAVASSSRSAINSPPRRYLLISQQSPSSRTTPCRSAGTASPTSRPPTPPLPPTQSTPVTVSGLPAPLILSPVPAASSAISPTIPSIPLHASLPYPTLSLPPSATPALPNSFTLSASTILPADSSISALPSTSAAGLPVMPVFISPATSSPAGPEPSTLQSASEATKSSNQKESPRKTDSKQAPSPSSTHGLWTNTRPFHASSNLSATSGKSSAASSRSTSRTLLPSRVATSDNVAGPSKTTSVSSTHPPARAPSLSLPSEPERQVHPRSPSHEGVGKREKKSKALSSGTGQSTPSRSSLSTYDVASNRKTKSTGLNALPQKPSSAGKTSSIPQRTSTLATAMAIRPFVRSPTSPCRPSSFEASGPIQSSGGAVKAAQNQDKIHPLSTTSSISSHSRETTTKAATPSHVTISSPSPSQSTSASTTVHVTQDAQKSATTSPTREKIHPSRRKSQTSDCVVAPTTSQTAASLSYPAGTSDGTGEADKKAAGTTVHAGPSSADFGTFVVPPTTAIASTTVSPSVTPPEDAPFLKSGPTVHPLFRAASAIGGQDTLTETGAVGDVLSQGSKGRASSPRITTTGAVSHLVLPIDVGSKIKPTAAPSLFASGVTIGNVDDQAAAQPQNPAPLPSALSVLSKKNLGSSSKESSVKSAASSVSSSSTLGDSVSGLGRKSHHKSTQSIPQSPLPTTNTSNSSGIEVNSWLNPQPFGPSFAASHLNTHAKKKWKGKEREKEREKEKAREKEKAKEENEQLRRRRMADLEKISANLEKYKGRMGVESRTRSIPRADGENRKRPPSPGISASTDGEVRVVKRSKPAWAIAPENGHVAAAMEKETNDNKKTTDAIKINHQPAAFYTPQFATPTSAAKTTTTPLSVTAGLGPPVNSSSSSSTPSLLSRSINLDIPRETPEERMDDDDGNDSTGGLLVRKTGKNDAVEEQVEQVRLDLDDVSIHGSSPVGPISTFTSRFRNVSITPSQTQKILEQPGEDVPIRRSAIKINGKQKAQRSKDKSDGSESEDDVPLNWPSRKGKGKAAPEPQDNSETQRDDDGVNLGSSNGEEGSSDDHSNPVLPPFLFKDRPAHVRQPLQTLFKGGFVAKHSYQRPLVKSSAVSPVPNANRTSSEPSAKAELLPQKRKRRPKKLTREQWHHIAQNHLSDVDDLLDESSKKRLSPKSAEKLGADLSKLTSPRVFSIVSRSEPRSKGAPIEENDNEYFTDSDSHTSDIALFLQHPDPPPPPERIREAKRNFGTRTIDPWNRQKHTFRSNPALHRAIFEAYIMQSTSMEESGGDDIKVTNEVDADGGPPDFEFVYSDTMLYPDGIPPPELGLGCDCDGPCDPDSETCTCVKRQELYFYDLGLKGFAYDENGKIRENSASIWECNELCGCPPECMNRVIQRGRAKDTGIEIFKTKEKGWGIRARSFIPSGTYIGSYTGELIREAESERRGVTYTAIGRTYVFDLDGWQIRHPPKGLEKIDKRAAELAEAVKMRAKAAMRESQEDAYNAYSVDAFHYGNHSCDPNLAITQAYVKDFHPERPLLVIFTRRDIKKHEELCISYKGIPDDDVPSPEPVKKKKGNKGKKQMSKTSASAHPPEMIALNSDKGPVEVKDICRW

SEQ ID NO: 11136 - protein, 739 aa, Glycine max
MESCNCIDPQVPADDLLMKYQYISDFFIALAYFSIPLELIYFVKKSAVFPYRWVLVQFGAFIVLCGATHLINLWTFRIHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKISPNCPVARLRPYAGKYMPGAVVAVRVPLLHLSNFQIYDWPEVSTRSYALMVLMLPSDSARQWHVHELELVEVVADQVAVALSHAAILEESMRARDQLIEQNVALDLARREAETAIRARNDFLAVMNHEMRTPMHAVIALSSLLQETDLTAEQRLMVETILKSSNLLATLINDVLDLSRLEDGSLQLEAATFNLHSLFREVLNLIKPVASVKKLSLTSHVASDLPMYAIGDEKRLMQTILNVVGNAVKFSKEGCISITAFVAKPESFRDARIPDFLPVPSDNHFYLRVQVKDSGSGINPQDIPKLFTKFAQNQSLTRNPAGSGLGLAICRRFVNLMEGHIWVESEGIGKGCTVTFIVKLGIPDRSNEFKLPFVPKVPGNHGSTNFAGLKVLVMDDNGVSRTVTKGLLMHLGCDVTTASSSEECLRVVSLEHEVVFMDVCTGLDGYELAVRIHEKFTKHQDRPLIVALTGNTKKVTKENCMRVGMDGLILKPVSVDKMRGVLSELLERRVLFESV

SEQ ID NO: 11137 - protein, 386 aa, Vibrio vulnificus
MVTNNMSKRDFYEVLGVSRDASERDIKKAYKRLAMKFHPDRNQGDESAADKFKEVKEAYEILTDPQKKAAYDQYGHAAFEQGGGGFGGGFGGGGADFGDIFGDVFGDIFGGGRRGGGHARPQRGADLRYNMELSLEEAVRGVSKEIEVPTLVHCDTCEGTGAKKGTSAETCGTCHGHGQVQMRQGFFAVQQTCPTCHGKGKIIKDPCNVCHGQGRKQKTKTLNVKIPAGVDTGDRIRLSGEGEAGERGAPAGDLYVQVHVREHHIFEREGNNLYCEVPVSFAMAALGGEVEVPTLDGRVNLKVPSETQTGRMFRMRGKGVKGVRGGAIGDLIVKLVVETPVNLSSRQKELLKEFEESCCGEAATKHKPKSEGFFNGVKKFFDDLTS

SEQ ID NO: 11138 - protein, 334 aa, Agrobacterium tumefaciens
MQIGMVGLGRMGANMVRRLLKQGHDCVVFDVNPDNVAPLVKEGATGATSPDDLVAKLSPPRAVWLMLPAAITPKIARDFAARLQAGDAIIDGGNSNYRDAIDLAAEFAPRGIDFIDTGTSGGIWGLERGYSLMIGGPVAAVQRLDPIFASLAPGAGLGIAADPVTGTAPMGYLHCGPSGAGHFVKMVHNGIEYGVMAAYAEGLNILKAANAGTQHREADAETAPLAHPQYYQFDIDLPAVTEVWRHGSVIGSWLLDLTAQALKQDPNLDQYGGRVSDSGEGRWTLQAAVETGVPAPVLASALFERFSSRGEAEFAGKVLSAMRNAFGGHLEKAK

SEQ ID NO: 11139 - protein, 388 aa, Salmonella typhimurium
MKHLHRFFSSDASGGIILIIAAALAMLMANMGATSGWYHDFLETPVQLRVGALEINKNMLLWINDALMAVFFLLIGLEVKRELMQGSLASLRQAAFPVIAAIGGMIVPALLYLAFNYSDPVTREGWAIPAATDIAFALGVLALLGSRVPLALKIFLMALAIIDDLGAIVIIALFYTSDLSIVSLGVAAFAIAVLALLNLCGVRRTGVYILVGAVLWTAVLKSGVHATLAGVIVGFFIPLKEKHGRSPAKRLEHVLHPWVAYLILPLFAFANAGVSLQGVTIDGLTSMLPLGIIAGLLIGKPLGISLFCWLALRFKLAHLPQGTTYQQIMAVGILCGIGFTMSIFIASLAFGNVDPELINWAKLGILIGSLLSAVVGYSWLRARLNAPA

SEQ ID NO: 11140 - protein, 220 aa, Brassica napus
  misc_feature (204)..(204): Xaa can be any naturally occurring amino acid
  misc_feature (211)..(211): Xaa can be any naturally occurring amino acid
MSTSDQPRHHRPTRNRPPLPRPPNPSRPVAPRSKASKRVLLRVASVACGIQFGWALQLSLLTPYVQELGIPHAWASVIWLCGPLSGLFVQPLVGHSSDRCKSKYGRRRPFIVAGAVAIAISVLIIGHAADIGWAFGDREGRIKPRAIVAFVLGFWILDVANNMTQGPCRALLADLTENDNRRTRVANGYFSLFMAVGNILGYAXTGSYNGXWYKVLPLSP

SEQ ID NO: 11141 - protein, 93 aa, Unknown
  Fragaria x ananassa
WESHIWDNGKQVYLGGFDTAHSAARAYDRAAIKFRGTEADINFSVGDYDEDIKQMSNYTKEEFVQILRRQSTGFARGSSKYRGVTLHKCGHWE

SEQ ID NO: 11142 - protein, 131 aa, Bacillus thuringiensis
MKIALIAHDKKKDDMVSFAYAYKPIFEQHELFATGTTGLRIMEATGLVVTRYQSGPLGGDQEIGAMIAKNDLDMVIFFRDPLTAQPHEPDVNALLRLCDVYAIPLATNMASAEMLMHALERGDLDYRKLRK

SEQ ID NO: 11143 - protein, 394 aa, Schizosaccharomyces pombe
MADEIMENVELTTSEDVNAVSSFEEMNLKEDLLRGIYAYGYETPSAVQSRAIIQICKGRDVIAQAQSGTGKTATFSIGILQSIDLSVRDTQALILSPTRELAVQIQNVVLALGDHMNVQCHACIGGTSVGNDIKKLDYGQHVVSGTPGRVTDMIRRRNLRTRNVKMLILDEADELLNQGFKEQIYDIYRYLPPGTQVVVVSATLPQDVLEMTNKFTTNPVRILVKRDELTLEGLKQYFIAVEKEEWKFDTLCDLYDTLTITQAVIFCNSRRKVDWLTEKMREANFTVTSMHGEMPQKERDAIMQDFRQGNSRVLICTDIWARGIDVQQVSLVINYDLPANRENYIHRIGRSGRFGRKGVAINFVTNEDVRILRDIEQYYSTVIDEMPMNIGDMV

SEQ ID NO: 11144 - protein, 566 aa, Brucella suis
MSQSNPTRADFESLLAESFAEHDLAEGYVVKGRIVAIEKDMAIIDAGLKVEGRVPLKEFGAKGKDGTLKPGDEVEVYVERIENALGEAVLSREKARREESWVKLEQKFANGERVDGVIFNQVKGGFTVDLDGAVAFLPRSQVDIRPIRDVTPLMHVPQPFEILKMDKRRGNIVVSRRTVLEESRAEQRSEIVQNLEEGQVVEGVVKNITDYGAFVDLGGIDGLLHVTDMAWRRVNHPSEILTIGQTVKVQIIRINQETHRISLGMKQLESDPWDGIGAKYPIGKKITGTVTNITDYGAFVEIEPGIEGLIHVSEMSWTKKNVHPGKILSTTQEVEVVVLEVDPVKRRISLGLKQTLDNPWTTFAQKYPVGTVVEGEVKNKTEFGLFIGLDGDVDGMVHLSDLDWNRPGEQVIEEYNKGEVVKAVVLDVDVEKERISLGIKQLSGDKVGEAAASGELRKNAVVTCEVTAVTDGGLEVRLVDHDLDSFIRRSDLSRDRDEQRPERFTVGQKVDARVIAFDKKTRKLQVSIKALEIAEEKEAVAQYGSSDSGASLGDILGAALKKQEKN

SEQ ID NO: 11145 - protein, 955 aa, Porphyromonas gingivalis
MNTNKFENRHIGIAERDLSVMLRTIGVESMDQLIRETIPGDILLPEPLDLPEAMTERELLEHFMELGSKNKIFTSYIGQGWYDTVTPAPIQRNVLENPAWYTSYTPYQAEVSQGRLEALFNFQTVITELTGLPLTNCSLLDEATAGAEAARMFFDTRSRTQIKAGANVLFVDKKVFRSTIEVIRTRIIPQGMQIVVDDYKTFSFTPEVFAAIVQFPDAEGSVNDYKSFIEAAHAANAKVAVVADLLSMTILTPPGEWGADIVFGSAQRFGIPMYYGGPSAGYLATSMDYKRNIPGRIIGMSKDAYGRPAYRLALQTREQHIKREKATSNICTAQALLATMSSFYAVYHGADGLRHIAGRVHAYAGFISEKLSGLGYKLTNKDFFDTLRVELPAGVTADKVRELAEECSVNFFYPADGSILISLDETTLPSDLGVLLYIFSSVLGKEETISEDIAIDKRYFDGAFARTSNFLDYDVFNNYHTETELMRYIKRLERKDISLAHSMIPLGSCTMKLNAASELFNLSMPQFNAIHPYAPKDQTEGYNEMLESLERYLAVITGFDATSLQPNSGAAGEYTGLLTIRGYLNSIGQGHRHLVILPASAHGTNPASAIQCGYDTVTVACDERGNVDMEDFMAKTEQHKDEIAAMMITYPSTHGIFETNIIDLCHRIHECGGQVYMDGANMNAQVGLTSPGFIGADVCHLNLHKTFAIPHGGGGPGVGPICVAKHLTPFLPSHPLREDYNGLEVSAAPYGSAGVTTITYAYIRLMGYEGLRRATKIAILNSNYMANRLKDTFGIVYTGATGRIGHELILECRKIKESGIDENDIAKRLMDFGYHAPTLSFPVHGTLMIEPTESESLAELDRFIDVMNCIWEEIQEVARGEQEATDNVLKNAPHPQYEVTANDWSHPYSREKAAYPLEYLRENKFWLNVARIDNGYGDRNLVPSLCSACEVFNNQ

SEQ ID NO: 11146 - protein, 1033 aa, Alteromonadales bacterium
MNSLQHIINRRDWENPISVQVNQVKAHSPLNGFKSVDHARTNTQSQKQSLNGQWDFKLFDKPEAVDESLLSEALASDWQSIPVPSNWQLHGFDKPIYCNVKYPFAVNPPFVPSDNPTGCYRTEFTITAEQLAQRNHIIFEGVNSAFHLWCNGQWVGYSQDSRLPSEFDLSKLLVAGTNRIAVMVIRWSDGSYLEDQDMWWLSGIFRDVNLLTKPQNQIRDVFITPDLDACYRDATLHIKTAIDAPNNYQVAVQVFDGEQALCEPHIQSTNNKRVDEKGGWSDVVFQTIDIQSPKKWTAETPTLYRCVVTLLDEQGITVDVEAYNIGFRKVEMLNGQLCLNGKPLLIRGVNRHEHHPENGHTVSTADMIEDIKLMKQNNFNAVRTAHYPNHPRFYELCDELGLYVVDEANIETHGMFPMGRLASDPQWAGAFMSRYTQMVERDKNHASIIIWSLGNECGHGANHDAMYGWSKSFDPSRPVQYEGGGANTTATDIICPMYARVDTHIADDAVPKYSIKKWLSLPGETRPLILCEYAHAMGNSLGSFDDYWQAFREYPRLQGGFIWDWVDQGLSKTDKNGKHYWAYGGDFGDELNDRQFCVNGLLFPDRTPHPSLFEAKYSQQHLQFTLREQTQNQYTVDVFSDYVFRHTDNEKLVWQLIENGQCVEQGKQVINIAPQSTQTLTINTKTVFKAGAQYHVNLDVALINDSSFACAEHVLNTEQFKLINCQSLSADAFSPALANASTQGALNISETDTQLSIEGGTFKLVFNSQSGLIEQWLHNQTQVIKSPLVDNFYRAPLDNDIGVSEVDNLDPNAWEARWLRAGIGQWQRTCRSFEVVQSKVDIRIKCVFSYEFNGAVQAKTTWLYTLNNTGEISLNVDVQLNDTLPPMPRIGLSTTLNKQSDTQVNWLGLGPFENYPDRKAASRLGYYSAQHNELHTPYIFPTDNGVRSDCQLLSVNNLTVTGAFLFAASEYSQSMLTQAKHTNELVADDCLHVHIDHQHMGVGGDDSWSPSTHKEYLLEQKKYSYSLTFSAKD

SEQ ID NO: 11147 - protein, 325 aa, Scutellaria baicalensis
MACMATSFRPIFSIAALVLLLTLVPSEAQLSATFYDSTCPNAVSTIRTSIRQAVSAERRMAASLIRLHFHDCFVQGCDASILLDETSTIQSEKTAGPNAGSVRGFQVIDAAKTAVERLCPGVVSCADILTLAARDASVAVGGPSWTVRLGRRDSTTANRAQANTDLPGPTSTLTQLITRFDAKGLNAREMVALSGAHTLGQSQCGNFRARIYSNGSDIEANFASTRRRQCPQDGSGDSNLAPLDLVTPNSFDNNYYRNLVARRGLLQSDQVLLSGGETDAIVTSYSSNPATFASDFANAMIKMGEIQPLQLGQNGIIRRTCGAVN

SEQ ID NO: 11148 - protein, 326 aa, Saccharomyces cerevisiae
MSTDSTRYPIQIEKASNDPTLLLNHTCLRVKDPARAVKFYTEHFGMKLLSRKDFEEAKFSLYFLSFPKDDIPKNKNGEPDVFSAHGVLELTHNWGTEKNPDYKINNGNEEPHRGFGHICFSVSDINKTCEELESQGVKFKKRLSEGRQKDIAFALDPDGYWIELITYSREGQEYPKGSVGNKFNHTMIRIKNPTRSLEFYQNVLGMKLLRTSEHESAKFTLYFLGYGVPKTDSVFSCESVLELTHNWGTENDPNFHYHNGNSEPQGYGHICISCDDAGALCKEIEVKYGDKIQWSPKFNQGRMKNIAFLKDPDGYSIEVVPYGLIA

SEQ ID NO: 11149 - protein, 159 aa, Prochlorococcus marinus
MQVDVQNTTVFSADGSSIKLGQYSGEVILVVNVASYCGNTAQYEDLQKLHDLYSSKGLRILAFPCNDFGKQEPGSLSEIKDFCTTKYGVKFEIYEKVHAKGDTTEPYTTLNKVEPEGDVEWNFEKFLIGKDCKVIARFKPSVKPFDENLIAAIEVALDS

SEQ ID NO: 11150 - protein, 612 aa, Rhodobacter sphaeroides
MRIVFVHPNYHSGGAEIAGSWPPAWVAYLCGALKKAGYTDYHFIDAMTDYVSHEKLAEKLRELQPDIVATTAITPSIYVAEETLKVAMEVVPNALRVLGGIHATFMFRQVLEEAPWIDVIVRGEGEEVLVNLVKAYEADNFAETRRQVKGLAFLDGDEIVSTAAAPTIRDVDSIDPDWGIINWKNYIYEPLGVRVAIPNMARGCPFTCSFCSQWKFWRDYRVRDPKKVVDEIEKLVNEHGVGFFILADEEPTINRKKFIEFCEEMIARGLPDKVKWGINTRVTDVKRDKELLKFYRKAGLVHISLGTEAAAQLKLDVFNKETTVAENKEAIRLLREADIFTEAQFIVGLDNETKETLEETYRMAWDWQPDLANWSMYTPWPFTPLFQELRDQVEVFDYSKYNFVTPIMKPKALTRGELLDGVMNNYRRFYMKKALFHYPWRGTGFRRRYLLGCLKAFLKAGVGRTFYDLGKAGYWGPQSKDKVDFHFDETRKIGNAQMADWEASADRAAKAAERREALRVQGKARAEERNAAKAEAAPILTAGGGGCGGHADGSDCGCGGKKQQQVDEFHVPMACGGGRQQMAEDEFAMPMACGGGKQQMEEAEERLVRPAE

SEQ ID NO: 11151 - protein, 356 aa, Hydrogenobacter thermophilus
MPIKDYYQILGVSKDATAEEIKKAYRRLAKEYHPDISADENASEKFKEINEAYHILSDEERRKEYDRILKSGDEKSYRDFMEYIQDFLESIWQGMRRSPKPKKGGDVRLKLELTLEEAAFGCEKDIEYERWIDCPTCEGKGYVGKMEKVTCHACEGTGRRVSGIFSFPRPCSVCKGRGFIIKNQCPACSGRGRVAMHSLLRVNVPPGTDEGDVLKVPGKGHTGERGGEAGDLYLRVSLKPHPIFKKVGKDLYMEAFISFPLAVLGGTTKIKTLEGSYQEVFLQPGTECGSTKRLQGLGYPIAGGRGDLIITFRIEVPKNVNSNIRALIEKLAKELGEEGIEYQSGVITKILSLLKL

SEQ ID NO: 11152 - protein, 306 aa, Rubrobacter xylanophilus
MESTQSIGIRELLEAGVHFGHQAKRWNPKMKRYIFAERAGVHIIDLDQTLDLLERALNFIRGVAEAGQDVLFVGTKKQAQITIAEQAIRCGQPYVAERYIGGLLTNFRTIRPRIEYFKQLSREVEETPEEERSGKEWFARLREYQKLRRNFAGITEMERLPGAVYVVDPKREELLVREANRLRIPVVALTDTNCDPDVIDYVIPGNDDAIRSISLITRLIADAVIEGRGEESAAEERPVPPAVEEAQMVEEGRVPAGGEEQPGEPEAEAFEEAAGEPEDSTEEEAAEEQAASQAAPVGEGDESEER

SEQ ID NO: 11153 - protein, 241 aa, Oryza sativa
MATSGLRSCSAVGVPSLLAPSSNRSRLPVCAYATTSGRVTMSAEWMPGQPRPAHLDGSSPGDFGFDPLGLATVPENFERFKESEVYHCRWAMLAVPGVLVPEALGLGNWVQAQEWAAEPGGQATYLGNPVPWGTLPTILVIEFVAIAFAEHQRTMEKDPEKKKYPGGAFDPLGFSKDPVKFEEYKLKEIKNGRLAMLAFVAFCVQQSAYPGTGPLENLASHLSDPWHNNIGDIIIPRTIYP

SEQ ID NO: 11154 - protein, 379 aa, Acetobacter aceti
MATQLDYYAILEVSRTATADELKKSYRKLAMKYHPDRNPGDDAAEAKFKEINQAYDILKDEQKRAAYDQYGHAAFEGGGPGPGGFDFSGGFGGGGLGDIFEQMFGDMMGGRRGGRARTGNDIQTHVEITLEEAFSGVKKDVRVITLGVRTCHGTGSDDGASGVEVCPSCHGAGKVRAHEGFFVVERPCPTCHGAGKVVKNPCKFCHGEGTVEKERTVEVQIPAGVEDGTRIRLSGEGEAGGNGVPPGDLYIHVSVTEHGIFQRDGANIYCRVPFRMAQAALGTEIEVPVIDGSRTKVKIPAGTQTGATFSLRGKGFSVLRSTARGDMYIQVTVETPQNLSKRQRELLEEFEKEAGEDVKQSPEHTGFFRRVRDFFEGKE

SEQ ID NO: 11155 - protein, 250 aa, Prochlorococcus marinus
MNKIAIVGAGPGSADLLTLRALNRLQNAEVLIWTDSLISPEIAELTSKTCEKFATSSLTLEEILALLISKAQQGKRVVRLHDGDPCLYGAISEQIYALAEEGIDVEIIPGISAYQATASELKKELTIPGIVQTIVLSRSGGRTGIPEAEKLENLAKIGASLCLYLSARHVEDVQKTLLTYYPKDTPVAIGYRVTWKDQWLKIVPLNQMAAASRDKGLFRTTLYIISPALKSHDKRSKLYSDEHKHLFRKK

SEQ ID NO: 11156 - protein, 653 aa, Gloeobacter violaceus
MHNILDLDLEKAGNSKPIGISLISPSISGEDMDILEVGAHPFVGDAGALKVRFGVYLPSITFAKGYEVLVRIIHKSDQFTPEIPPQDYFLTCRDDHPYDLWEATVELTSQPHPANHFGKPGVYLYRYQLRRHGEIVTLWFTDPFARETGVGELAAFHTPDTDPPFVWSDADFRVPPLDDLVVYELQVDEFNNDFAGLIEQLDYLEGLGVNCLELMPITSVRQEFDWGYGPLHFWAPEERYGGKRGFKQLVNACHERGIAVILDSVYEHVEDNFPYARVYRDSGEPNPIIGPFGEGFFGTQIDFAQPFAREYFLECNRYWLREHHVDGFRYDYVPGMYDGPLGQGYAKLVYDTYEDSLAEAQLAARFQDPAGFSRIIQCAEHLPDPRGILRQTFSNCAWQNELLNKVENMAGQRYVDDRFAHLLDTRLIGYPDTRDAEGLAMPVAPFQYFETHDHSRLITRYGLLPPLGGTGDIQYGDRRNFFKLQPFAIALYTCQGIPMLWQGQEFAENYTLPGGGNLRISFRRDIHWEFFYDEQGRALVRLYRILAKLRRQCPALRSRESFYFNEQSRPGDGVIAYLRRTPEDADAQVAVVCLNFSDSPHQIWLPFPSTGTYREQIDAASANPTYDIDVAVAGEFHKVEIPANYGRIYLHGG

SEQ ID NO: 11157 - protein, 391 aa, Mycoplasma gallisepticum
MSSKRDYYEILEVSRSATQQDIKKAFRKLAMKYHPDRNKDSDAEEKFKEVNEAYEVLSDEEKRKLYDTYGHEGLNASGFHQGGFNPYDVFNSVFSGFDFEGGFGDVFSQFFGGGGSGFHNQEYIEEVDVNLVHEIKINFLEAANGCIKNVKYTRQVTCPDCNGSGSADGDVITCSDCNGEGFLVEQRRTLLGMFQTKKTCPSCKGEGQTIKNKCKKCKSRRMVDEVVERKVSIDSNVFYQDVVIVRGEGHIYKNLVGDLFLRVKIEPSRVFELRDNHVVVNVLVDPLVAITGGTILIPTLKEIKEINLKAGTKNGDIITIANGGINLKLDSRVYGANYNQKGDLIVVINYARPSEYSKQEITKLKEFIKPNKEVNLYETLMKKELNNKDSQ

SEQ ID NO: 11158 - protein, 335 aa, Brassica napus
  misc_feature (17)..(17): Xaa can be any naturally occurring amino acid
  misc_feature (276)..(276): Xaa can be any naturally occurring amino acid
MATDEPSLTRWSFLEFXKTFYDAKLGRKKLPEEPQESKPEDGSSSNKEEDASQVATNPSQEGNTRLTNGIREKPKKSMFPPFESAGTRALAESLSRDIIRGNPNVKWESIKGLENAKRLLKEAVVMPIKYPSYFNGLLSPWKGILLFGPPGTGKTMLAKAVATECNTTFFNISASSVVSKWRGDSEKLIRVLFDLARHHAPSTIFLDEIDAIISQRGGEGRSEHEASRRLKTELLIQMDGLQKTNELVFVLAATNLPWELDAAMLPRLEKRILVPXLPDPEARGGMFEMLLPSQPGDEPLPHDVLVEKSEGYSGSDIRILCKEAAMQPLRRTLAS

SEQ ID NO: 11159 - protein, 109 aa, Zea mays
AAAALTKGGADDAARKPLPPCCVKAKARVPETEANCHDTVVSGWFTEPRSRFGEAHSLKVEKILFQGKSPYQEILVFESSTYGNVLVLDGIVQLTDKDECAYQEMVTHL

SEQ ID NO: 11160 - protein, 434 aa, Arabidopsis thaliana
MEEVSPAIAGPFRPFSETQMDFTGIRLGKGYCNNQYSNQDSENGDLMVSLPETSSCSVSGSHGSESRKVLISRINSPNLNMKESAAADIVVVDISAGDEINGSDITSEKKMISRTESRSLFEFKSVPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKPRRKLKSKPLN

SEQ ID NO: 11161 - protein, 419 aa, Unknown
  Candidatus Desulfococcus oleovorans Hxd3
MIIDYLAQQDPEVAGAVAREVERQQHNLELIASENIASRAVMAAQGSVLTNKYAEGYPGKRYYGGCEYVDQAEQIAIDRAKTLFGAAYANVQPHSGSQANMAVYFALLSPGDTGLGMDLAHGGHLTHGSPVSFSGRLFDFKHYGVKKETGTIDYDQVADLAKTHRPKMIIAGASAYPRTLDFEKFAQIAASVEACLVVDMAHIAGLVAAGVHPSPVPHADVVTSTTHKTLRGPRGGLILSARADFGKALNKEIFPGIQGGPLMHVIAAKAVAFGEALTDGFVAYQQQVVKNARALAAHLMEQGIELVSGGTDNHMMLADLRNISVTGKAAETALERAGLTLNKNAVPFDTENPTVTSGVRIGTPVMTTRGMKEPEMAVVAGLIVNVLKNISNDTVIQATRKRVMELCEAFPIYRDNDNG

SEQ ID NO: 11162 - protein, 863 aa, Treponema pallidum
MHGGGERERSFVHPRTRCVAVRARTVLQCRPMGTVIIALDGPAGSGKSSVCRLLASRLGAQCLNTGSFYRAFTLAALRRVSELAVQACSPSPDPDAAVGCAAVPHATNLDTSYAPLTAQKKVALFDEAYWVSFARTVALSYRAGVMYVGEENVESLLRSDEVESAVSYFAAMPAIRAIMTGKIRSAVCGARVVCEGRDLTTVVFVDADLKCYLDASIEARVARRWAQGTSRLSKQELEQRMRARDAHDRARTVGGLRCAPDALYVDTSCLTIEEVCERIAREAHRRALWGGERSVENQEGKGTPLVPRQLQERYSFEAPEPGSVRMGTVVQVNAGTVFVDIGGKSEGRVPVEEFEAPPKAGDGVRVYVERVTPYGPELSKTKADRLGLKVKLRDAERDGTPVEGRIVRLTEKKSGFEVDLGAGMMAFLPISQSDCQKVDAPESLIGLTSKFYIERISQSKQHRGNDNIVINRRRYLEERARQAREEFFNSVHIEDSVSGVVKSFTSFGAFIDLGGFDGLLHVNDMSWGHVARPREFVKKGQTIELKVIRLDQAEKRINLSLKHFQPDPWLEFENKFGVNDVVKGRVTKIADFGAFIELAEGIEGLAHISEFSWVKKTSKPSDMVKIGDEVECMILGYDIQAGRVSLGLKQVTANPWEEIEARYPVGARFTRRIVKVTNAGAFIEMEEGIDGFLHVDDLSWVKRTRPADHELEVGKEIECMVIECDPQARRIRLGVKQLSDNPWQVFANAYGVGSTVEGEVSSVTDFGIFVRVPGGVEGLVRKQHLVENRDGDPGEALRKYAVGDRVKAVIVDMNVKDRKVAFSVRDYQRKVQRDELSRYMSAPRGEDEGSFTLGDLMRQTSGK

SEQ ID NO: 11163 - protein, 471 aa, Vibrio vulnificus
MAMKLVWLRRDLRSVDNTALNHAIATSQEVVACFVATPLQWRDHHMAPMQADLIARRLAVLAEELNALNIPLLYDEVDDYAQSATRVANWAEQLAVSEVVLNREYEVNERVRDEQLVNQLASSEIGVLDVEDKCVQAPGCVLNKQGDYFKVFTPFKKAWLKSFVPPQIIKTSAAQPVVLPEALQSSLWHEQAPFSYPRQSSEEWSVDSQQIRETLRHFCHEEVDRYHEQRDFPATAGTSVLSPYLAIGAISVRQCIARLYWQQSYLSNGREVWLSELIWREFYHHLIHFEPKLVKGQGFVEWEKHLLWPAKPDWFDRWCRGETGYPIVDAAMRQLNQTGWMHNRLRMIVASFLTKDLHVNWRLGEQYFMQKLVDGDFAANNGGWQWCASTGCDGQPYFRIFNPITQGEKFDPNGEFVKHWLPELVEVPSKFVHQPWNWPGHMQLDYPAPMVDHKQEREITLSLYTQAKDCL

SEQ ID NO: 11164 - protein, 535 aa, Glycine max
MGSISHVITTTLPHLPSTRSLGFPISHSNSRLLSLPPTRVAKQVGVFAELVSRSSTASFASVDFSVHDWKIQFHEDCQLRRPPPHLTDIFPNAPPIPSTFCLKMRTPIDRDFPGHYSLDEEWHGYINNNDRVLLKTIYYSSPTSAGAECIDPDCTWVEQWVHRAGPREKIYYKPEEVKAAIVTCGGLCPGLNDVIRQQIVITLEIYGVKNIVGIPFGYRGFSDKELTEVPLSRKVVQNIHLSGGSLLGVSRGGPGVSDIVDSLEKRGINMLFVLGGNGTHAGANAIHHECRKRRLKVSVIGVPKTIDNDILLMDKTFGFDTAVEEAQRAINSAYIEAHSAYHGIGVVKLMGRSSGFIAMQASLFSGQVDICLIPEVPFNLHGPHGVLSHLKYLLETKGSAVVCVAEGAGQNLLQKTNATDASGNVVFGDIGVYIQQETKKYFKEIGVHADVKYIDPTYMIRAIRANASDGILCTVLGQNAVHGAFAGYSGITVGLCNTHYVYFPIPEVISHPRLVDPNSRMWHRCLTSTGQPDFI

SEQ ID NO: 11165 - protein, 556 aa, Suaeda salsa
MGVAEEGKKHNEDNNLETKNGEKQGIVHINPKPNQGFTSKAIDWLEKIIVKLMYDSSQPQHYLSGNFAPVVDETPPAKDLIVHGHLPECLNGEFVRVGPNPKFAPVAGYHWFEGDGMIHGMHIKDGKATYVSRYVRTSRMKQEEFFGGAKFMKIGDLKGMFGLLTVSLQMLRAKLKVLDMSYGHGTANTALIYHHGKLLALSEGDKPYVVRVLEDGDLQTLGLLDYDKRLAHNFTAHPKVDPFTGEMFTFGYSHTPPYITYRVISKDGFMHDPVPITVPAPIMMHDFAITENYAIIMDLPLYFRPKDMVKEKKIIVTFDPTKKARFGLLPRYAKNESLIKWFELPNCFIFHNANAWEEGDEVVLITCRIENPDLDMVGGAAEDMVDSFTNELYEMRFNMKTGLASQRKLSASAVDFPRVNENYTGRKQRYVYGTSLGSIAKVKGIVKFDLHAEPDPSQKKLEVGGSVQGIFDLGPERFGSEAIFVPREQGTSSEEDDGYLIFFVHDENTGKSFVNVIDAKTMSADPVAVVELPSRVPYGFHAFFVTEEQLKDQVAF

SEQ ID NO: 11166 - protein, 189 aa, Arabidopsis thaliana
MLKATGTAAPAMHVVFPCFSSRPLILPLRSTKTFKPLSCFKQQGGKGMNGVHEIELKVRDYELDQFGVVNNAVYANYCQHGQHEFMETIGINCDEVSRSGEALAVSELTIKFLAPLRSGCKFVVKTRISGTSMTRIYFEQFIFKLPNQEPILEAKGMAVWLDKRYRPVCIPSYIRSNFGHFQRQHVVEY

SEQ ID NO: 11167 - protein, 182 aa, Rhizobium leguminosarum
MTGNVLDIPVKTVDGRETTLNEYKGRVLLVVNVASKCGLTVQYEGLEKLYGEKRERGFVIAAFPANDFKGQEPGTDAEILDFCTSTYDVTFPIFSKISVRGEAQHPLYRQLTKAGVKTTGDGPMRERLKSHGMTGGDEDDILWNFEKFLIGRDGKVAARFAPDVTADDSRLVSAVDKELSKG

SEQ ID NO: 11168 - protein, 438 aa, Arabidopsis thaliana
MANYISSVLKSLLLLLHLVFLIQQHVDSASIVKFLPGFEGSLPFELETGYIGIGEEEEVQLFYYFIKSERNPKEDPLLLWLSGGPGCSSISGLLFENGPLAMKLDVYNGTLPSLVPTTYSWTKTSSMIFLDQPVGTGFSYSRTQQYNKPSDSGEAKRIHEFLQKWLSKHQEFSSNPFYVAGDSYSGMVVPATVQEISKGNYQCCSPPINLQGYVLGNPITEHAIDYNYRIPFAHGMALISDELYESLKRVCKGEYVDPRDTECLKLVEEFSKCTKGVCQEVVIKPLCVTETPNCYIYRYLLTTYWVNDVNVRKALQINKESIGEWVRCYFGIPYTHDIKSSVPYHMNNSINGYRSLIYSGDHDLNVPFLATQAWVRSLNYSIIDNWRPWMIKDQIGGYTKTYANKMTFATVRGGGHTAEYKPYETYIMFHRWINGQPL

SEQ ID NO: 11169 - protein, 1188 aa, Pisum sativum
MKPLYSTNTLLLLLALFLLHLGPSHSSSSSSSSTSSSQLLYFKQSLPNPSLLHDWLPYKNPCSFTGITCNQTTVTSIDLTSIPLNTNLTVVATYLLTLDHLQVLTLKSSNITSSPISLSHTKCTSSLTTIDLSQNTISSSFSDLAFLSSCSGLKSLNLSNNQLDFDSPKWTLSSSLRLLDVSDNKISGPGFFPWILNHELEFLSLRGNKVTGETDFSGYTTLRYLDISSNNFTVSIPSFGDCSSLQHLDISANKYFGDITRTLSPCKNLLHLNLSGNQFTGPVPSLPSGSLQFLYLAENHFAGKIPARLADLCSTLVELDLSSNNLTGPVPREFGACTSVTSFDISSNKFAGELPMEVLTEMNSLKELTVAFNEFAGPLPESLSKLTGLESLDLSSNNFSGTIPRWLCGEESGNNLKGLYLQNNVFTGFIPPTLSNCSNLVALDLSFNYLTGTIPPSLGSLSKLRDLIMWLNQLHGEIPQELSNMESLENLILDFNELSGTIPSGLVNCTKLNWISLSNNRLTGEIPSWIGKLSNLAILKLSNNSFSGRIPPELGDCPSLIWLDLNTNFLTGPIPPELGKQSGKVVVNFISGKTYVYIKNDGSKECHGAGSLLEFAGINQEQLRRISTRNPCNFTRVYGGKLQPTFTLNGSMIFLDVSHNMLSGTIPKEIGEMTYLYVLHLSHNNLSGSIPQELGKMKNLNILDLSYNKLQDQIPQTLTRLSLLTEIDFSNNCLSGMIPESGQFDTFPVGKFLNNSGLCGVPLPPCGSDSGGGAGSQHRSHRRQASLAGSVAMGLLFSLFCVFGLIIIAIETRKRRKKKEAAIDGYIDNSHSGNANNSGWKLTSAREALSINLATFEKPLRKLTFADLLAATNGFHNDSLIGSGGFGDVYKAQLKDGSVVAIKKLIHVSGQGDREFTAEMETIGKIKHRNLVPLLGYCKVGEERLLVYEYMKYGSLEDVLHDPKKAGIKMNWSVRRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKRPTDSADFGDNNLVGWVKQHAKLKISDVFDKELMKEDPNLEIELLQHLKVACACLDDRPWRRPTMIQVMAKFKEIQAGSGMDSQSTIATEDEGFNAIEMVEMSIKEVPELIKH

SEQ ID NO: 11170 - protein, 879 aa, Penicillium marneffei
MFTSPTESEFSVNNDGLDSVRSWDEKKVADWLHSIRCAQYEPLFKANNFNGDNLLECDQKILQEIGIKKIGDRVRIFVAIKQLRNKALINLKKNNKDPLAALEATAYAPLSNDVYSSSNSRNPLTSKWSRQLDSIGGRSNSRPSSPLTMDDRSRAFRYASNPIDGPRMPGYFSHPSSAGSGSGRHPITPGDSSQFSHLRQNPSIDGYTIGSLPANSHVIRIIYTGGQTKAMNVKGCKNTEEIMVHVLRKLQLPEYQHRSYCFYVLDGLEPDPANCRRVTDSELMRICEGSQKSERGRLILRKIHAGEPDADELRRAAQLALDESQATHLNALSSSNARNQLKIQQLTGEPWHHIKQPISPLTSERSRHLANDEHEASPTSAGMERPSASKLRSFFGARPPSEMIIHELTSYFPSHQREDIEKTMRMSVRRSQRLSRAASRLSVVSNISFASSMKDAPPIPSIADTWLTGGQLARPSRPLSVARSHLPQVSYRDSIASSSLQPLQEESPIEPDRKSYVSFGSGSDPVLGDANSAQRSFLDETLSVAATDGGGSLNERLSMIVAEDGEEEDTGLADFLNGDNFAAKNWMKGSLIGEGSFGSVFLALHSITGELMAVKQVELPSATKGTEFDKRKNTMVTALKHEIELLQGLHHPNIVQYLGTSADDHNLNIFLEYVPGGSIAEMLKQYNTFQEPLIKNFVRQILAGLSYLHSRDIIHRDIKGANILVDNKGGIKISDFGISKRVEASAMLGSSAVSGRGHLHRPSLQGSVYWMAPEVVRQTAHTKKADIWSLGCLVVEMFIGAHPFPDCSQLQAIFKIGNNQARPPAPEHASEEARAFLDVTFEINHEKRPSADELLESCEMSLCMGFGLLGSEMLYNEID

SEQ ID NO: 11171 - protein, 354 aa, Glycine max
MGRQPCCDKVGLKKGPWTAEEDKKLISFILTNGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPATHKPLPNANEQNQNQTRQDQQLHHQPVELEEPNQQPLQVDFDPKVDPNKEPEKPETSLESSTITEEAKEEDQIITPLFDTMELMNGFCTDEVPIIEPHEILMPCAPSSSSTTSSSSSSNSTNFLEDLQLPDFEWSCNYNDNNTITNNNNNEDKDDDNNNNSSMALWDDDIIGNRYWLINEDDDSDENQVFDASLTQFSKMFMESESWGYGFFDLNFLPIICDLLLSFYEE

SEQ ID NO: 11172 - protein, 492 aa, Mycobacterium tuberculosis
MMPDYHALIVGAGFSGIGAAIKLDRAGFSDYLVVEAGDGVGGTWHWNTYPGIAVDIPSFSYQFSFEQSRHWSRTYAPGHELKAYAEHCVDKYGIRSRIRLNTKVLAAEFDDEHSLWRVQTDPGGEITARFLISACGILTVPKLPDIDGVDSFEGVTMHTARWDHTQDLTGKRVGIIGTGASAVQVIPEMAPIVSHLTVFQRTPIWCFPKFDVPLPTAVRWAMRIPGGKAVHRLLSQAFVEATFPIAAHYFAVFPLAKHMESAGRRYLRQQVHDPVVREQLTPRYAVGCKRPGFHNTYLSTFNRDNVRLVTEPIDKITPTAVATTDGASHEIDVLVLATGFKVLDTDSIPTYAVTGTGGASLSRFWDEHRLQAYEGVSVPGYPNFFTVFGPYGYVGSSYFALIETQAHHIIRCLKRARRTGATRIEVTEEANARYFAEVMRRRHRQVFWQDSCRLANSYYFDKNGDVPLRPTTTVEAYWRSRRFDLGDYRISS

SEQ ID NO: 11173 - protein, 331 aa, Bacillus cereus
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVRNGADLMEEMHKVAKEVSEKGNTPYVIPVGGSNPTGAMGYVACAQEIMVQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 11174 - protein, 486 aa, Candida glabrata
MVHLGPKKPPTRKGSMVDMPQQLLDQIKVFEEMYTVDGETLRKVTKHFITELDKGLSKKGGNIPMIPGWVMEYPSGKEKGDYLAIDLGGTNLRVVLVKLGGDRTFDTTQSKYKLPEAMRTTKNHEELWSFIADSLQAFLEDQFPEGVKGKLPLGFTFSYPASQDRINQGVLQRWTKGFDIPNVEGHDVVPMLQKQIEKRNLPIDIVALINDTTGTLVASLYTDGETKMGVIFGTGVNGAYYDVVSDIPKLEGKLADDIPNDSPMAINCEYGSFDNEHVVLPRNKYDLIIDEESPRPGQQAFEKMSSGYYLGEMLRLALLDLYDQGLILKGQDISKLKKPYVMDTSYPSKIEDDPFENLEDTDELLQKNLGIQTTVQERKLIRRLCELIGTRSARLSVCGIAAICQKRGYETAHIAADGSVFKMYPGFKEKAAQGLADIYGWEHKDPKDCPIVIVDAEDGSGAGAAIIAALAEKRIAEGKSLGVLGA

SEQ ID NO: 11175 - protein, 550 aa, Candida albicans
MASFKLATDLPEWKKLEETYKSVGEKFSVRDAFAKDPKRFEEFSWIYKNYDDSKILFDFSKNLVNKEILDQLVTLAKEAGVEKLRDAMFAGDHINTTEDRAVYHVALRNRALRKMPVDGKDTAQEVDDVLKHMKEFSDSIRDGSWTGYTGKSITDVVNIGIGGSDLGPVMVTEALKAYSKPGLNVHFISNIDGTHTAETLKNLNPETTLFLIASKTFTTAETITNATSAKNWFLATAKDSKHIAKHFAALSTNEKEVVAFGIDAKNMFGFESWVGGRYSVWSAIGLSVAIYIGFENFNDFLKGAEAMDQHFLTTPLENNIPVIGGLLSVWYNNFFGAQTHLVVPFDQYLHRFPAYLQQLSMESNGKSVTRANVFTNYQTGTILFGEPATNAQHSFFQLVHQGTKLIPADFILAAQSHNPIEKNLHQRMLASNFFAQSEALMVGKDEAKVKAEGATGGLVPHKEFSGNRPTTSILAQKITPATLGSLIAYYEHLTFTEGAIWNINSFDQWGVELGKVLAKVIGKELDDKKAVATHDASTNGLINQFKEWEE

SEQ ID NO: 11176 - protein, 458 aa, Erwinia carotovora
MANDQQELVLKRGLKNRHIQLIALGGAIGTGLFLGISQTIQMAGPSVLLGYAIAGMIAFLIMRQLGEMVVEEPVAGSFSHFAFKYWGDFAGFLAGWNYWAMFILVGMAELTAVGIYIQYWWPDTPTWLSAAIFFVLINLINLVNVKMFGETEFWFAIIKVLAIVGMIVFGSWLLLSGNGGETATVRNLWIHGGFMPNGASGLIMAMAVIMFSFGGLELVGITAAEAADPKRSIPQATNQVVYRILIFYIGALSILLSLYPWGNVVGGGSPFVLIFQALNSNIVANVLNVVVLTAALSVYNSGVYCNSRMLYGLAKQGNAPKSLAKVNARGVPVRSIALSALATSLGVAINYVMPGKAFELLMALVVSTLVINWIMICFAHLRFRQAMMEKGIVPAFKAFWYPWSNYLCLAFLAGILVIMLLSPGIRISVMLIPFWIAVIWLGFRFSRKTYSPAKIVPR

SEQ ID NO: 11177 - protein, 559 aa, Dechloromonas aromatica
MESFAQLFEESLARQEMRQGEVITAEVVLIDHNFVVVNAGLKSESYVPLEEFLNDQGELEVKVGDFVQVAIEMLEDGYGATRLSRDRAKRIAAWNFLEEALNNNSLVTGTITGKVKGGLTVMSNGVRAFLPGSLVDMRPVKDTTPYEGKTLEFKVIKLDRKRNNVVMSRRAVLEATADKDREKLLENLKEGTTVKGIVKNITDYGAFVDLGGIDGLLHITDLAWRRVRHPSEVLNVGDEVTAKILKFDAEKNRVSLGMKQLGDDPWVGIARRYPAGTRLFGKVTNLTDYGSFVEIEQGIEGLVHVSEMDWTNKNVHPSKVVQLGDEVEVMILEIDEERRRISLGMKQCQANPWDDFAMNHKKGDKVKGAIKSITDFGIFIGLPGGIDGLVHLSDLSWSATGEEAIRNFKKGDEVEAVVLGIDVEKERISLGIKQLEGDPYTNFIATHEKNSIVNCTVKSVDARGAVLTLDGENEGYLRASEFSRDRIDDLSQHLKVGDTVEAMIINVDRKTRGINLSIKAKDNAEQHEAMQKLSAESSAAASGTTNLGALLKAKLNQQG

SEQ ID NO: 11178 - protein, 313 aa, Roseovarius nubinhibens
MSDPRHTRVLIIGSGPAGYTAGVYASRALLNPILVQGIEPGGQLTTTTEVENWPGDSEVQGPDLMVRMEAHAKAMGCEIIGDIITDLDLSQRPFTAKGDSGTVYTADAVILATGARAKWLGLPSEEKFKGFGVSACATCDGFFYRGQEIAVIGGGNTAVEEALFLTNFASKVTLIHRRDELRCEAILEDRLRKHPKIELLWDHTLDEVYGTDTPLGVEGIKVKHVKTGEITDIPAKGVFIAIGHAPANELVKDQLELHAGGYVKVQPGSSLTSIPGVFAAGDITDPIYRQAVTSAGMGCMAALDAERFLAEAE

SEQ ID NO: 11179 - protein, 105 aa, Ashbya gossypii
MLIPKEERTKIHRKLFQDGVLVAKKDFNQPKHDEIDTKNLYVIKALQSLTSKGYVKTQFSWQYYYYTLTEEGVEYLRNYLGLPENVIPGTYMADRSQSQRPQRRY

SEQ ID NO: 11180 - protein, 724 aa, Pseudomonas putida
MANSEVRSVCPYCGVGCGIVMSVADGKVGKISGDKLHPSNFGRLCTKGLTAHQPLSASGRMADAYLRQQRSQPPVRTSMDQAIAATAERLRGIIDQHGPDAVALYVSGQMSLEAQYLANKLAKGFIRTRHIESNSRLCMASASSGYKLSLGADGPPGSYQDFEHADVFLVIGANMADCHPILFLRLLDRVKAGAKLIVVDPRRSATADKADLFLQVRPGSDMALLNGLLHLLHRNGHTNPDFIARHTEGWDEMPAFLDDYTPERVAAITGLAEADIIKAAEWIGSANNWMSCWTMGLNQSIHGTWHSNAICNLHLATGAICRPGSGPFSLTGQPNAMGGRDMGYMGPGLPGQRSALVEDDRAFVERQWQLPPGSLRSEGGEGTVALFGQMKAGEVKACWVICSNPVASVANRQQVIDGLRKAELVITQDAFLDTETNRYADILLPAALWAEGEGVMINSERNLTLMPRAVEPPGQSLPDWQIIARVACAMGYADAFDYPNAEAVYEEIRRFHNPSTGYDLRGIGYAELRTQPRQWPCAPGSEQHRSPLRYLNDGSSQALLLDARGRRPALAFPTASGKAHFFARPWLPAAEVPDDDYPMVLNTGRVQHQWHTLTKTGKVPALNKLEPGPYLEIHPEDAARLGVAEKDQVAVRSRRGQAVLPARISDRVMPGNCFAPFHWNDLIGEQLAINAATCDAVDPLSLQPAFKHCAVALERVAGERIDAL

SEQ ID NO: 11181 - protein, 145 aa, Oryza sativa
MGFSETQEELVLRSWQSMKKDSESIALKFFLRIFEIAPAAKQMFSFLRDSGDDVPLENHPKACESATQLRKTGDVKVREATLRRLGATHVKAGVADAYFEVVKTALLDTIKDAVPEMWSPEMKGAWEEAYDQLAAAIKEEMKKAA

SEQ ID NO: 11182 - protein, 321 aa, Brassica napus
  misc_feature (251)..(251): Xaa can be any naturally occurring amino acid
MENTDELVSIELPAPASWKKLFYPKRAGTPRKTEIVFMAPTGEEISSRKQLEQYLKAHPGNPVISEFDWTTGETPRRSSRISQKVKATTPTPEREPHMKKRRSSLTKKDLKEAAEKNQVAQQDKNGQTEEADVAVKEGLVEENKDGEKSEAEKEKENKEDENKEGEVVTDKKEPVEVDSSEVEKKAEAENKEGEVATDKKEPMEVDSSEVEKKAGSGGKAEETPKGGDLKDTEMKEGDGENKLAEKETENXGSIGAEANGGENATSGKPNLEANQGNGTHEAAAAVAEEKSNDVKAAEDTNRGLEANQVQQQQGAAASVSC

SEQ ID NO: 11183 - protein, 637 aa, Arabidopsis thaliana
MATGQNRTTVPENLKKHLAVSVRNIQWSYGIFWSVSASQSGVLEWGDGYYNGDIKTRKTIQASEIKADQLGLRRSEQLSELYESLSVAESSSSGVAAGSQVTRRASAAALSPEDLADTEWYYLVCMSFVFNIGEGMPGRTFANGEPIWLCNAHTADSKVFSRSLLAKSAAVKTVVCFPFLGGVVEIGTTEHITEDMNVIQCVKTSFLEAPDPYATILPARSDYHIDNVLDPQQILGDEIYAPMFSTEPFPTASPSRTTNGFDQEHEQVADDHDSFMTERITGGASQVQSWQLMDDELSNCVHQSLNSSDCVSQTFVEGAAGRVAYGARKSRVQRLGQIQEQQRNVKTLSFDPRNDDVHYQSVISTIFKTNHQLILGPQFRNCDKQSSFTRWKKSSSSSSGTATVTAPSQGMLKKIIFDVPRVHQKEKLMLDSPEARDETGNHAVLEKKRREKLNERFMTLRKIIPSINKIDKVSILDDTIEYLQELERRVQELESCRESTDTETRGTMTMKRKKPCDAGERTSANCANNETGNGKKVSVNNVGEAEPADTGFTGLTDNLRIGSFGNEVVIELRCAWREGVLLEIMDVISDLHLDSHSVQSSTGDGLLCLTVNCKHKGSKIATPGMIKEALQRVAWIC

SEQ ID NO: 11184 - protein, 524 aa, Clostridium tetani
MENLKFNNLGLNEDILKAIEDMGFETPSKIQAEVIPIVLQGFDVIGQAQTGTGKTLAFGAPVLNSISNESKKVKSIILAPTRELAIQVYKELTTVAKYTKFKLLPVYGGDSIDRQIKSLKKGIDIVIGTPGRVQDLINRKALNLSHIEFLVLDEADEMLNMGFVDDIENILKSCNEDRRTLLFSATMPSEIKKIAKKYMKKDAKHVAIAQNSMTVSSVEQFYYEVKQKNKFESLCKVLSVDEPTRAIIFCKTKKGVDELVSSMKEKGFSAEGMHGDMTQSHRLNTLNRFKERTIPFLVATDVAARGIDVKDTSHVINYDLPQDTESYVHRIGRTGRANKKGTAYTFVTPKEFSSLKRIQKISKSKINKRQLPTMDDVLKAKFDSILNDVEQTLSKDNYNTFIPLVKDLESKFDLTNVTAALMSMLYNDEISYDYDDDNTESNSLDYTRIFLNVGRKDRLNPKILLEFLDNNANINKSQVGSIDILDKFAFVDIATDRVGDLMDNCIDKTLCRRKLNIEVAKKSK

SEQ ID NO: 11185 - protein, 181 aa, Triticum aestivum
  misc_feature (56)..(56): Xaa can be any naturally occurring amino acid
  misc_feature (67)..(67): Xaa can be any naturally occurring amino acid
  misc_feature (123)..(123): Xaa can be any naturally occurring amino acid
MGRRPARCYRQIKNKPYPKSRYCRGVPDPKIRIYDVGMKRKGVDEFPYCVHLVSWXEKENVSSEALXEAARIACNKYMTNLQGKDAFHLKVRVTRSIPPVSNKALPVPGADSSKTGMRGAFGXPQGTVPGGHWPAPLPSIKDNNLPSNEPARPKSWRKIMRNGTNRTLIKTGKPMGTNRTR

SEQ ID NO: 11186 - protein, 169 aa, Streptococcus pyogenes
MERAIFAGGCFWCMVQPFEEQAGILSVRSGYTGGHLPNPSYEQVCAKTTGHTEAVEIIFDPEEISYKELVELYWAQTDPTDAFGQFEDRGDNYRPVIYYTTERQKEIAEQSKANLQASGRFDQPIVTTIEPAEPFYLAEDYHQGFYKKNPKRYAQSSAIRHQFLEENWS

SEQ ID NO: 11187 - protein, 590 aa, Cryptococcus neoformans
MLIPFLALASLSRITTAQLTPSPTYSPPTSSAGLTASSETPNTQWSNILGNSLWFYDAQRSGRLDEGTYGNRVDWRNDSALEDGSDWGLDLVGGWYDAGDYIKATFPLSFTLFALSWGALTHGQGYGLANQTAYLDGTLRWGFDWLMKAHPSDDVLFIQVGSGDVDNNYWGGDQDIPSPRPGYPINSSYPGTDGWAAASAAFSLGSLLYTPGVSYRPTSSSSPPTSPSLENSTYASQLLAHAESLYSVANSTTPRQTYYAALGDEVAAYASSDWRDNLCASALALALATNNSAYYADAYNYYVQYGLSGTHEVWNWDSSQPAIYVMFAEIASAKPELAQGAGLDVNLTGWQTEVENYFDGLIKEDFSNSYLTEGGLLYWDGDSDEASLNPAMAAAMLMFKYAPMASSTDKTNSYNSFAQSQLNYLLGSNPMSVPYIVGQHPNSPSNPHSAPASGGFNINNIRDDPPTEAHVLYGAVVGGPLSSDQFWDWRDDWVQTEIALDYNAMIPTLASMQLMNNTADPPYVDIAAGTYSIPSGQPCDAALPCRGGGGLSGGEIAGIVVGVIVGVVLLVIVGVWWWWRKRGKRWGSKW

SEQ ID NO: 11188 - protein, 415 aa, Bacteroides fragilis
MNLNDTFAAVQAAGRHLALLPDDRINQILNAVAEAALEQTSYILSENRKDLERMSPDNPKYDRLRLTEERLRGIASDIRNVATLPSPLGRILKESIRPNGMRLTKISVPFGVIGIIYEARPNVSFDVFSLCLKSGNACILKGGSDADYSNRAIVEVIHQVLRQFNIDTHMVELLPADREATRELLHATGYVDLIIPRGSSALINFVRQNATIPVIETGAGICHTYFDEYGDTAKGAAIIHNAKTRRVSVCNALDCVIVHESRLSDLPLLCEKLKADKVIIYADPSAYQALEGHYPAGLLKPATPESFGTEFLDYKMAIKTVNSFENALGHIQEYSSRHSESIVTENPERAALFTRMVDAACVYTNVSTAFTDGAQFGLGAEIGISTQKLHARGPMGLEEITSYKWIIEGDGQTRQ

SEQ ID NO: 11189 - protein, 477 aa, Medicago truncatula
MENIAAQLKRGISRQFSSGSLRKTLSRQFTRQASLDPRRNNLRFSFGRQSSLDPIRRSPGDDEDQAELTVPENLDSTMQLLFMACRGDVKGVEDLLNEGIDVNSIDLDGRTALHIAACEGHVDVAKLLLSRKANLDARDRWGSTAAADAKYYGNTEVYYMLKARGAKVPKTRKTPMTVANPREVPEYELNPLELQVRKSDGISTGTYQVAKWNGTKVAVKILDKDSYSDPDTINIFKHELTLLEKVRHPNVVQFVGAVTQNIPMMIVREYHAKGDLTGYIQKKGRLSPSKVLRFSLDIARGMNYLHECKPDPIIHCDLKPKNILLDNGGQLKVAGFGTVRFSLITPDKALLEQPEANIDPSSLYVAPEIYRGDVFDRSVDAYSFGLIVYEMIEGIPPFHPKPAEEALKLMCLEGKRPQFKIKTKSYPPDLKELIEECWDPEPEVRPTFSQVIARLDKIVANCSKQGWWKDAFKLPWK

SEQ ID NO: 11190 - protein, 475 aa, Medicago sativa
MENIAAQLKRGISRQFSSGSLRKTLSCQFGTRLDPRRNNLRFSFGRQSSLDPIRRSPGDDQDQVELTVPENLDSTMQLLFMACRGDVKGVEDLLNEGIDVNSIDLDGRTALHIAACEGHVDVAKLLLSRKANLDARDRWGSTAAADAKYYGNTEVYYMLKARGAKVPKTRKTPMTVANPREVPEYELNPLELQVRKNDGISTGTYQVAKWNGTKVAVKILDKDSYSDPDTINIFKHELTLLEKVRHPNVVQFVGAVTQNIPMMIVREYHAKGDLTGYIQKKGRLSPSKVLRFSLDIARGMNYLHECKPDPIIHCDLKPKNILLDNGGQLKVAGFGTVRFSLITPDKALLEQPEANIDPSSLYVAPEIYRGDVFDRSVDAYSFGLIVYEMIEGIPPFHPKPAEEALKLMCLEGKRPQFKIKTKSYPPDLKELIEECWDPEPEVRPTFSQVIARLDKIVANCSKQGWWKDTFKLPWK

SEQ ID NO: 11191 - protein, 580 aa, Cytophaga hutchinsonii
MLFKDLGLSPEVVEAIESIGYSEATPIQEKTIPILMTGKDLTGQAQTGTGKTAAFGIPAIEHVDISINQTQSLILCPTRELALQVCTELKKLSKFKKGLRVLAVYGGESIERQIRDLKAGAHIVVGTPGRIIDHLDRRTLNASHLSQIILDEADEMLNMGFREDIELILTRLPEERQTVLFSATLAPPILALAKRFQNNPEIIKIERKELTISTVEQFYYLVKNSQKTEIVTQIIDLNNLQLMLIFCNTKRKVEEVTDELKAYGHNPISLHGDKTQRDRTEVMSKFRKGLANILVATDVAARGIDVTGVDAVINYDVPLDIENYVHRIGRTGRAGQLGKSFTLVTSDEKYKLRDIERYTKATIEKAETPTRQELVAYKKDKLATRITTELEKPNIKIWSDLLEEYKEKGITADQIAIALLSKEMKDLAEPERRVFEDRGDRRDRGDRGDRGGRFDRGDRRDGPRRDGRSSDRFGDRPAASRDRDGGERRERTPRPRTSDASMARLFVNVGRIDRISPGDIVGAFAGEANIKGSQIGQIDIFDKYSFVELPHDLVDQVMDGMRNNKIKGKSINIEISNGKQ

SEQ ID NO: 11192 - protein, 662 aa, Unknown
  Rhizobium sp. NGR234
MAHSSDLALFRHRIAEALPSANVPTLLLLLYQFTGKEYWLTPPFLPVKSVWGDNDSGGLAAELQTEIRNAALDAIICWHSGAPVTKQDLSEEELIRMLTVSEAEPIPPEYADMMLHKLRRYAGAIPDPVSLPKGFRVLIIGAGMSGVAAAIRLRQLGISYIQVEKQDSTGGVWHAHHYPGCGVDTPGHLYSYTFASGNWSTFFPLQKEIDDYFNRVARDFGIESSIRYGTECLVTRYDEESLTWHSRLRLPNGTEETLVTNVVLSAVGGFTTPKWPNLSGLRNFDGPVVHTSKWDPEVALDGKRVAVIGNGASAMQVVPAIADRVGALTIFQRSRQWVAPFPKFQKPVPEPMQFLFREVPHYEWLYRLRLSWIYDSEVHEALQKDPAWPHPDRSVNAVNDRDREAYTQYIEGQLAGRPDLIAKVIPSYPPFGKRMLLDNGWYRTLLKPHVTLVDGAAARVEGRSIHAIDDETHEADLIIVASGYDTTRYLLPVEVIGRNGRTVRDVWDDDDCQAYLGTVVAGFPNFFMLYGPNTALGHRGSFIFTIESQIDYVLSVLRQMGEKRLVEVECRQDIYQHYNRKIQQMHQQMIWSHEGMSTFFRNDRGRIVTNSPWRLVDYWNLLKEADLDDYRTMPQVDSRLETSGVPREGVQRPGSRLRRRPS

SEQ ID NO: 11193 - protein, 190 aa, Schizosaccharomyces pombe
MGKSQSKLSQDQLQDLVRSTRFDKKELQQWYKGFFKDCPSGHLNKSEFQKIYKQFFPFGDPSAFAEYVFNVFDADKNGYIDFKEFICALSVTSRGELNDKLIWAFQLYDLDNNGLISYDEMLRIVDAIYKMVGSMVKLPEDEDTPEKRVNKIFNMMDKNKDGQLTLEEFCEGSKRDPTIVSALSLYDGLV

SEQ ID NO: 11194 - protein, 505 aa, Cucumis sativus
MDLLLLEKTLLGLFLSVVLAIAISKLRGKRFKPPPGPLPVPIFGNWLQVGDDLNHRNLTDLAKKFGDIFLLRMGQRNLVVVSSPELAKEVLHTQGVEFGSRTRNVVFDIFTGKGQDMVFTVYGEHWRKMRRIMTVPFFTNKVVQQYRQGWEFEAQSVVDDVKKNPESATTGIVLRRRLQLMMYNNMYRIMFDRRFESEDDPLFHKLRALNGERSRLAQSFEYNYGDFIPILRPFLRGYLKICKEVKETRLKLFKDYFVEERKKLANTKSTTNEGLKCAIDHILDAQQKGEINEDNVLYIVENINVAAIETTLWSIEWGIAELVNHPEIQRKLRNELDTVLGPGVPITEPDTQKLPYLQAVVKETLRLRMAIPLLVPHMNLHDAKLAGYDIPAESKILVNAWWLANNPANWKNPEEFRPERFLEEESKVEANGNDFKYLPFGAGRRSCPGIILALPILGITIGRLVQNFELLPPPGQSKLDTSEKGGQFSLHILKHSTIVVKPRVF

SEQ ID NO: 11195 - protein, 107 aa, Brassica napus
KVMSKALADKGYYKQKGVVRKVIDDYVGEIEMIDSKHVLRVDQEELETVIPQIGGLVKIVNGAYRGSVAKLLGVDTEKFCAKVQIEKGVYEGRVIKSIEYEDICKLA

SEQ ID NO: 11196 - protein, 391 aa, Methanocaldococcus jannaschii
MVKYMVLKIKDNIYCMSFIEWKIKEYRGLDIEKGTTYNSYLILDKNNVIIDTTRIKYFDELLSYLKDVANLKLDYIISNHISPDHNECIEKLIELTEAKIVTTKIRKYYLDAQFNTKDWEFVIVKNGDELNIGNRTLKFITDDKCEYMLTYCVEDKILFSNDLFSQHVVYKEKIDSDIGHKIMLDAKEYFANILLPYRKSILKILNILKDLDLEYICPSHGVIWHIMIDEILTKYRMWCSDSYKNTAVIVYATIYSSTEKIAKALGEGLSEEGVDVIYHRLDTSPLNIIMRDILDAKYVLVGSPTINMNVHPKVGMLLTYIEGLKPSNKKIGVAFGSYGWKECATKKIIEAFKRLGFKIVDDKILTFRFAPKENDIKKIKEFGRKLAKINV

SEQ ID NO: 11197 - protein, 439 aa, Unknown
  Synechococcus sp. WH 5701
MASNPSAVPDPSPELLSRAAAVRRAAMALGQCSDGQRQQALLAMAQSLERSAEAIVAANTADLEAAAADQLAPALVARLKLDGAKLAGAIEGVRQLAELPDPVGRRQLHTELDAGLVLERVTVPLGVVGVIFEARPDALIQIASLAIRSGNGALLKGGREASRSCTAIFAALQEGLAESEVDRQALALLTTRQESLGMLRLDGLVDLIIPRGSNELVRFIQDNTRIPVLGHADGVCHLFVDRSVNQEQALRIAIDSKTQYPAACNAIETLLVHQEVASQFLPAVISAFQAEAVELRGCPRACALGVARAASDDDWGREFSDRILAVKVVESLEEALEHIARHGSRHTDAICTTDPETAGRFLSAVDSAGVYLNCSTRFADGFRYGFGAEVGISTQTLPPRGPVGLEGLVTYRYRLRGEGHIAADYASGLRRFSHRSLPL

SEQ ID NO: 11198 - protein, 1424 aa, Ustilago maydis
MRPTLFRPFVLLALAHLIKPSYTLLDSGASANVGEASADSVPTRKDRVLSKDFPAGSLLVTDSEHSSNRPGCRRSTNFFEQVCSIPSGGSKDTDSRISSKLLAPLVAADLLICDLPEVEPLMQTESNLQASQKLPKAAYAISGTVVVQESDAKERLDAKNLAELTDSSCFTCENAVSENAITDPSGGQPDTSYPGPDDVGFWRQRDGLHEWHPALESVTKEIRTTRDTDSNVFQSSNQAGSRVPHHQDTSRLSEYDAWSAEQEQGAFLSFNEWKERHANDPSAQLRRAKTHNARADASDHTAQVRSPSTDPSVPIQQSEIDYQAAHMVADRDGHQGSTAQTTRRQRDDYTSTSPSATKTSAPLQTGATETTATDAPPRRSILDEAQESSAHKVGFSVAAHATSSQLLKLKHRWNFASLDCAAVVHRTNPEAKFASSILSEKKDRYMLSPCPQPGGKLKGGSQFVIVELCEKIKIDTIVLANYEFFSNMFKKFTVTAASQLTGMENDWTQLGVFRARNVRGQQVFRIPSAPRSEDFFRYVRIDFLEHFGSEFYCPVSLLRVYGITEIEAIKMEFERHSAELNLAPEVGEAEEDTVGDVQRPSLTSADAPNAEVPVARDLHPSIDSAGFTSQDEDIWRKHEQAFQRKHQNRTVIREAAELDIGVTFVAQIDNASSQNSSAPVQSGQAGTPATTHTVPGDDLGSNLADAAHCALENDPNFLARTNNICIRPRGQTKPFYHVSRFRTDARYTTSALDSGSAAKLDRPSVDSPTKSRPVPAATNGAESDLDRGRRATLQRPSGSLPSQQASQGSESVYRAIHRRLNALESNATLSHSYIEHSGQMLREVFARMERRQETRLSNMLRALNASNWQQIESLKRRQHVDLQRAIFEFDVHRQQADNERRALLREVQILAEEVLLEKRLSIAQLVMLLVVFIFVGMTRGSRPVPLLHAGFNKIGRGSKRSEAHIDATTVVSGSPSKATHRVEPSFDARRQKVSPLRESKLSQARKESRPECSNKSASGSHLARCNVEDAKLASRFSLYEAPGIPRIVASPKVGSQNYPRKSGKTLLATFAGRAAPRGEKMIGMHSHPRPTGHLMMILETLDALDRAAYRRRLSRTSTRRKLDVPRYALRSNTLNLPAAPHGTDLNLMPSSAMARRAARPNRSTATHKPELDFVHGRRHGTPGRDKWTGSLRLDDTAGMSSDWTERSENGEVSENAPNTSEDEDKAIRAARSDLINLEPVENVRAMMALDRTEGKQDIQEPSDRSSVIPASELASTGSAPPPDPADWPVGHSQLDKHIAATELPRIARADGHLSSSDSESEGGAWHRVLPRRTGNSNSLRRARQATIDDKTQRMDGEARVNTKTEASERRGSSRPSSAHGTGFRSQNPALSRLFRTGTPEHWGPESSQNQRSGTPDTIRDVRLA

SEQ ID NO: 11199 - protein, 223 aa, Oryza sativa
MGTPETSREPCPDRILDDVGGAFGMGAVGGSLFHFLKGTYNSPNGERLVGGAQAVRMNAPRVGGSFAVWGGLFSAFDCTMVFMRQKEDPWNSIIAGAATGGFLSMRQGPGAAGRSALMGGMLLALIEGAGLMLNRVLATPPPLPVDDPNLPAVMGGGGGIPGIPQVPVAPPEVASSSGGGSGWFGSLFGKKEEEKKASPSGGKSEMLESFDTPSTPIPTFEYK

SEQ ID NO: 11200 - protein, 569 aa, Ashbya gossypii
MTRRGRRRGRGRQALRQHHRYGSGGRGGVVEDIVNPALDAGALPHMLAEEDDAVSTMMMPFSPLLPHHLPLNSSTAGAGDHIVRRGTPVGVYGSATPELAGEHGSQLHSGLLSYNLRSSKLLTQKPSLVGRGPSKAGSSPPQLGGMPKKKLAAAKTKPAFVNKLWSMVNDPVNQSLIHWSHDGKSFIVTQREQFVHEILPKYFKHSNFASFVRQLNMYGWHKVQDVKSGSIQSNSDDRWEFANENFLRGREDLLANIIRQKSSAGSRDGAGMSVGAAHPNAVLVANGEEVDLGILFSELETVKYNQLAIAEDLKRISKDNELLWKENMLARERHQNQQQALEKIVKFLSSLYGSNTTRLLSDHVFREPQQAVAAPQGYGVHSTASMSPLHMADPLDAAPSPDVTATPVHRPRLLLKQRASPASDWPAQVQELRTSQVPSPVLQPLPARIHEIHPDAQLPADTPVLSPAVVDQASFFNDLQDNLDKQGESIQEIQDWIDKLSPASPFSRFDPRDYLAAPGFPAPPPDAADPISPRPAYKRPSNHREETRSEDYSPASKKQRQLSARDPPT

SEQ ID NO: 11201 - protein, 340 aa, Bacillus thuringiensis
MTKITVVGAGSWGTALAMVLADNGHDVRIWGNRSELMDEINTKHENSRYLPGITLPSTIVAYSSLEEALVDVNVVLLVVPTKAYREVLQDMKKYVAGPTTWIHASKGIEPGTSKRISEVIEEEIPEDLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEVLESMGMVVEGVRTTKAAHELAEKMEVEMPITAALYDVLFNGNNVKDAVGSLMGRVRKHEVEAIPDLL

SEQ ID NO: 11202 - protein, 299 aa, Dechloromonas aromatica
MYKTLQDFVGNTPLVRLVRIPGADNDKRGNVILAKLEGNNPAGSVKDRPALSMIVHAEARGDIKPGDTLIEATSGNTGIALAMAAAIKGYRMILVMPENQSVERRQSMRAYGAELVLTPKDGGMELARDVADKMRDEGKGIILDQFANPDNPLAHYEGTGPEIWRDTDGKITHFVSSMGTTGTIMGTSRFLKEANPAIEIVGCQPEDGSQIPGIRKWPEAYLPKIFDKTNVDRVEYVSQADAEAMTRRLAMEEGIFAGISSGGALAVALRLSQQLENAVIVSIICDRGDRYLSTGVFPA

SEQ ID NO: 11203 - protein, 249 aa, Rhodococcus erythropolis
MTVYFIGAGPGAADLITVRAQRIIAASPVCLYAGSLVPQELLAECPEGARVIDTARLSLDEIVALLIEADAAGQDVARLHSGDPSIFSAVAEQVRRLESAGVAYQVVPGVPAFTAAAASLGRELTVPGVSQSIVLTRVSTLSTAMPEGEDLRSLGRSGATMVVHLGAHRIDQIAEELIEDYGRDCPAAVVAFASRPDEIVLRGTLATIADQVKAAGVTKTAVVIVGRVLAAEGFPDSYLYSATRERTTH

SEQ ID NO: 11204 - protein, 770 aa, Candida albicans
MAPSSSSSLDLHYERPKWYRLAIYDTLLWLLSVIFDCFFREIRPRGAFKIPREGPVIFVAAPHHNQFVDPVLLMNQIKKEANRRISFLIAAKSYKLKAVGTMAKCQLSIPVVRPQDCLVKGTGKIFVDFDKDPLRVTGKDTKFTKECMVKGLIALPQSLGASEIVEIISDTELVIRKEFKSSDKVKVLLTNGTAYKRADKIDQKQVYQMVFDHLLDDGCIGIFPEGGSHDRPDLLPLKAGVAVMALGAMDKNPGCNIKIVPCGMNYFNAHKFRSRAVVEFGDPIEIPKELVKKYANPETNREAVKELLDTITTGLKAVTVTCEDYETLMLIHAVRRLYAGNFAQQLPLPLIVEMNRRLVIGYQHFKNVPKVQEIKEKVLHYNDFLKTLYLPDHDVESCNDEAHKITLIPIFFFRVFKLLILFILALPGATLFSPVFLSTKIISKKKAKEALANSVVKIQANDVVATWKILVSMGIAPIVYSFYASVGTYYCSTHDYFSHWKLFWVWIFLYSCGVLVTYSALITGEQGMDLFKSIRPLYLSITSGSSIKELKKMRHELSEEITELVNHYGPQLFPNDFNLLDLQKSLNINGDVVYADSDEEEDMKTEELRNRRIARRKAEKKKKQTQENEDTQELQSSDMKHSSSMSDGISLLNSDNSLTNLPMFSDYVLHKNAKNPDLQLDPQSHYGSRVNSNLNSGANSSVSIYDDYRFASQSEHGGTASPVRYSRLPHLPETSSSDHMELNFASKPEGQKMRLRDRIKTKLRENRKEN

SEQ ID NO: 11205 - protein, 538 aa, Dechloromonas aromatica
MLRIAVAQFNATVGDLTGNVERIIKCASEAKVRGAQVLLTPELALCGYPPEDLLLRPDFYRACQRALDNLVSRVEGIAVVVGHPEEHEGRCYNAATVIENGRSKAVYRKMRLPNYEVFDEKRYFEPGTEACVVTLAGVRCGINICADIWEAGAAELAHEAGAELLLVLNASPCHLEKHQQRIQVLGDRIDATGIPAVYCNLVGGQDELVFDGASFALDARKNCCMRLPQFEEALGIVDFDAGRLHSDDMADELSLEAEAYKALVVGVRDYIGKTGFKGAIIGLSGGIDSALTLCVAVDALGADKVRAVMMPSPYTAQMSLDDSREMIRVLGVQYDEIAIAPAMEVYGAMLDPLFAGLPADTTEENIQARIRGNILMALSNKTGALVLTTGNKSEMAVGYCTLYGDMAGGFAVIKDVYKTLVYRLSVYRNTLCQGDPVIPENIIVRPPSAELKPDQTDQDSLPPYEILDAIVRAYMEEDRSPREIIAAGLQEADVRRVVRLLRIAEYKRRQAPIGIRITPRGFGKDWRYPITNRYADEF

SEQ ID NO: 11206 - protein, 112 aa, Dechloromonas aromatica
MKKIEAIIKPFKLDEVREALSEIGISGLTVTEVKGFGRQKGHTELYRGAEYVVDFLPKIKIEIVVNSNNVEPAIDAIIKAARTGKIGDGKIFVMPVEQVVRIRTGETDEAAV

SEQ ID NO: 11207 - protein, 1042 aa, Thermus thermophilus
MAWLNPFWSSPKAYVRPPKRGLAPELWASRIPFTHLENFYEVFRALWENRDNLPYAWRILKDGVCDGCALGTSGLEDWTLHGVHLCNVRLRLLRLNTLPPLDPKVLEDVEALKGRKSRELRRLGRLPYPMLRRKGERGFRRVSWDEALGLAAEYLRRHLPEGAFFYLTSRGVPNETYYVVQKAVRALGCNHVDNAARICHSPSTVVLKEALGVAATTCSYTDLIGTDLVVFLGSNVANNQPVMMKYLYHAKKAGTKVAVVNPYREPGMERYFVPSDLESALFGTRIADRFFQILPGGDIAFLHGAAKWMLEEGWVDPGFIRAHTAGFEAYKALLEAIPFAELEKAAGVSREEMRAFAEMVGRAERAVFVWGMGITQHTHGEDNVRAIVNLALLKGFVGREGCGLMPIRGHSGVQGGAEMGAYATAFPGGLPVNPENARRLAELWGFPVPDRPGLTTPEALDRALEGRLGVLWAIGGDFREVMPDPEAVEEALRRVPLRVHQDIVLSSQMLLEPGECVLLLPATTRYEVPGGVTETSTERRVIFSPEIPGPRPPEARPEWEVFQELVHRLRPELKDRFRFASTAEVREEIARVIPLYEGIQRLKAKGDQFQYGGRHLCEGWRFPTPDGKAHFRPVPPAPKGGPRGGLPRGHPPGEAVQLHRPRGPGPPHRGLPGRGLHEPQGRRPPGPEAWGSGGAGKRLRPLRRPGLPGGGQRGHPGGPLARGERPGRPQGPLPPGPHPGLQGGPRPPAAGGGGGPFPAPAMRGKARVRVARLEGGRWREVRDEVAAEAPLEIRLRYRDEVASLGVVLRTPGQDAELAAGLLYTEGLLQDPKEVLAIAPCADGSLPPEAREGVIQVFLRHPLPPPPKRHLALTAACGACGREALPDLGKLGLSPPPPLAVDPDLLLALPERLGEAQRLFRATGGLHAAALFDREGRLVALREDVGRHNALDKLIGWAFLQGKLPLHDHILLVSGRAGYELLVKAVAAGIPVFCAVSAPTSLAVALAQAYGLTLVGFLRPGRMNVYAGRERVGPPRGLPNPCG

SEQ ID NO: 11208 - protein, 686 aa, Rubrobacter xylanophilus
MRLEIPVGERAIVLETGKLARQAGGAVTARFGDTTVLSTATRSEEPRPGATFLPLSVDIEERMSSAGKIPGGFLKREGKPSEKAILTARLTDRPIRPLFPKDYYYEVQVIGTVLVADQENPYDVVSMVGASAALALSDIPFGGPIGAVRVGRHPDGGFILNPTYQQLEESDLDIVVAGTKEAITMVEAGAREVTEDVVVEALEVAQGVIREQAEAIERWAAEHGEEKQPFEEPGENPFVEELRGAYLERIKEGLISTDRRARHEAIDLLKEELVEGRSEEEVPLVLDALAQLQKEAFRKLYLEDRKRTDLRAFDEIRPTTAEAHVLPRVHGTGLFTRGETQVLSSLALADLGLVQRLDTLEPQTTKRYMHHYYFPPYSTGETGRLGPPRRREIGHGALAERALLPVIPSEEEFPYAIRIISEVLESNGSSSMASVCGSTLALMDGGVPIKAPVAGVAMGLVKEGDDYVILTDIQGLEDHMGDMDFKVAGTRDGITALQMDMKITGVSAELLKEALEQARRGRLQILDIMREEIAEPRPEISDHAPRVEVIQIPTDKIGLLIGPGGKTINALQDEYGVNISVENDGTVYVAGVEGMSVKAAVSAIKGMTKEVEAGDIYVGKVVKTTNFGAFVELTPGRDGLLHISRLAPGKQRVRRVEDVLNEGDVVKVRVLEIDKQNRISLEMVED

SEQ ID NO: 11209 - protein, 472 aa, Thermoplasma acidophilum
MEFRQAYYDEPLIKDIKSDTSFKLSEDVDENLLPQDMRRTDLKLPQVSEVDVVRHYTRLSQMNYTVDVGIYPLGSCTMKYNPKYADRIASFAEFRNIHPFQPESTVQGTLQIMYELQEFLKKISDMDAVTLQPMAGADGEFTGILIIKKYFEDLHEDRTEIIVPDSAHGTNPASATMGGFDVVEIPSNSEGMVDLNALKAAISKKTAALMITNPNTLGIFEQNITEIAKILHDAGALLYYDGANLNAIFGITSPGLMGFDIVHFNLHKSFATPHGGGGPGAGPVAVKSFLSDFLPVPVVGYDGKRYFLDYGKKKSIGRVSSFYGSFSILLRAWSYVIRNGDDGLKNATIRAVLNSNYLKKKVEGYYEVPYYPLKKHEFVLSTEKTGRRALDIGKYLLDFGIHSPTVYFPLIVKEAMMIEPTETVSKDDLDRYADVLISALKVPEDDLKSRPRNTAVSRIDEVKAARDLKVRW

SEQ ID NO: 11210 - protein, 320 aa, Dechloromonas aromatica
MPQNVRHNPLIILGSGPAGYTAAVYAARANLKPVLITGMAQGGQLMTTTEVDNWPAAADGIQGPELMANFEAHARRFETEIVFDHIHTTQLTEKPFTLIGDAGTYTCDALIIATGASAMYLGLPSEETFAGKGVSACATCDGFFYRNKPVAVVGGGNTAVEEALYLANIASHVTVIHRREKFKAEKIMQDKLFQREKEGKVTILWNSTLDEVLGDDSGVTGLSIKNVKSGETQKVDVHGVFIAIGHKPNTDIFAGQLEMDNGYLVTQAGRNGNATQTSIPGIFAAGDVQDQIYKQACTSAGSGCMAALDAERYLDNLGHA

SEQ ID NO: 11211 - protein, 400 aa, Triticum aestivum
  misc_feature (3)..(3): Xaa can be any naturally occurring amino acid
  misc_feature (36)..(36): Xaa can be any naturally occurring amino acid
RVXEFPGFPDGITGPDLMDKMRKQAERWGAELHQEXVEFIDVKSRPFVIRSSDREVKSHSVIIATGATAKRLRLPREEEFWSRGISACAICDGASPLYKGQVLAVVGGGDTATEEAIYLTKYACHVHLLVRRDQLRASKAMQDRVLNNPNITVHFNTEAVDVVGNTKGQMSGIQLRRIDTGEEKVLEVKGLFYGIGHTPNSQLLQGQIELDSSGYILVDEGTAKTSVDGVFAAGDVQDHEWRQAVTAAGSGCIAALSVERYLVSNDLLVEFHQPVREEKKKEIEGKDVEMGFDITHTKHKGQYALRKLYHGSPRLILVLYTSPTCGPCRTLKPILNKVIDEYDEYVHFVEIDIEEDPEIAEAAGIMGTPCVQFFKNKEMIRTFSGVKMKKEYREFIESNK

SEQ ID NO: 11212 - protein, 525 aa, Ralstonia eutropha
MLGYRPANLHQGTMQGADTPAHARPPYRIDHQFDRGLVWFRRDLRSTDHAALHYALKHCREVWCVFVFDRDILDPLLARGLKGDRRVDFIRASLIELDATLRAAGGGLIVMNDSAASAIPALARELGVQAVFANHDYEPDAVARDAAVRDSLAGDARVLFTFKDQVIFERDEILTSQGKPFAVFTPYKNAWLKTIQPFDLRPYPIEPYLHALAPLPSKRLVPLPSLEDLGFAPSNLAEVAMPTGSSGGQALFEEFTSRMGDYGRRRDYPALRGPSYLSVHLRFGTVSIRTLARAAHGAVLRGGADSAGAATWLSELVWRDFYFMILHHHPRVAAGEAFHPAYDIIRWRDGETGDRYFESWRDAATGYPLVDAAMLQIRQSGYMHNRLRMVTASFLVKDLGVDWRRGEHYFADQLNDFDFAANNGGWQWAASTGCDAQPWFRIFNPVTQSEKFDPQGRFIRKYLPQLAALPDKYVHAPWTAPQDVLLAAGVRLGENYPRPLVQHDVARKETLERYAVVKEWRRPEG

SEQ ID NO: 11213 - protein, 433 aa, Thermoplasma acidophilum
MDELLSMLNFLGMKDPEELFSDIPKSVRKKSIGIGGGLDEYRVIDRAMEIGRKNKTDMINFLGNGIYDRVIPEAVNYILSKPEFLDSYTPYQPEISQGMLQSMFEYQSLISDLMGMDVTNASMYDGYSALGEAARMAYRINGHSKILVPESSYDSKISVLRNYIWGLNMKIMKYRIGEDGMIDLDDLSSKIDSDTSAIVVENPNGYGILDKNIFGVKDIKKDAVLISYVDPISLGVVKPPGEYGSDIAVAEGQQLGIPMNFGGPLLGLMSFKMEHIRRSPGRIIGESIDSNGKRAYVMTLQTREQHIRRAKATSNICSNQALLTLAASAYLSIMGSTGLRKVALLTIKHSRMIKEKLSSIGVKPYFSTESFSDVMFRLERDVMEALASKNILGGLKLRQLISDTPMKDATFFTVTEKTDAAAIEKLAAALEVI

SEQ ID NO: 11214 - protein, 360 aa, Bacteroides fragilis
MKKEFTRIAIKVGSNVLTRQDGTLDVTRMSALTDQIAALHKAGVEVILISSGAVASGRSEIRTPRKLDSVDQRQLFSAVGQAKLINRYYELFRDHGIAVGQVLTTKENFGTRRHYLNQKNCMTVMLENGVIPIVNENDTISVTELMFTDNDELSGLIASMMNAQALIILSNIDGIYNGSPSDPDSLVIREIGQGKDLSNYIQTSKSSFGRGGMLTKTNIARKVADEGITVIIANGKRDNILINLIEHPEETVCTRFIPASQPVSSIKKWIAHSEGFAKGEIHINEQATEVLNSDKAVSILPVGITRIEGEFEKDDIVRIIDYRGTPVGVGKVNCDSMQARDSIGKHGKKAVVHYDYLYIE

SEQ ID NO: 11215 - protein, 112 aa, Fulvimarina pelagi
MKIVMAIIKPFKLDEVREALTGVGIQGLTVTEVKGYGRQKGHTEIYRGTEYAVSFLPKLKVEVVVGDESVDKTIEAIQSAAKTGQIGDGKIFVYGIDQAVRIRTGETDSSAL

SEQ ID NO: 11216 - protein, 233 aa, Cyanophora paradoxa
MAIVTLDEMLEAGVHFGHQSRRWNPKMSQYIFTERNGIHIIDLVQTAQLLAEAYDFLRISAEEGKKVLFIGTKRQAANIIAQEATRCGAFYINQRWLGGTLTNWTTIQSRVEYLKELEMREESGALDLLPKKEAAILRRQLEKLRKSLGGIQTMRHIPDIVVIVDQKRENNAVQECKKLNIPIIALLDTNSDPDVVDIPIPGNDDAIRSIKLIIGKLADAILEGSHTKTSSAE

SEQ ID NO: 11217 - protein, 271 aa, Glycine max
MANPEGSSRGSRWSLKGTTALVTGGTRGIGHAVVEELAEFGATVYTCSRNEEELNACLKEWKEKGFSVSGLVCDASSPPHRENLIQQVASAFNGKLNILVNNVGTNVRKPTIEYTAEEYSKLMATNLDSTYHLCQLAYPLLKASGNGSIVSISSVASQTSVGSGAIYAATKAAIDQLTKYFACEWAKDNIRSNGVAPWYTITSLVEPLLANKQLVSEIISRTPIKRMAETHEVSSLVTFLCLPAASYITGQIVSVDGGFTANGFQPSMRIS

SEQ ID NO: 11218 - protein, 955 aa, Coprinopsis cinerea
MYGSTSEESESEDSGMEIDLPSAPWHDDSEPADEADEDEHLSDEQHELNSTDDHLLHWATFHQLNKVKKDDLVRLYRAANLPEDPELLTKAEIITVIMDARQDELASLPPSSPPGRTDAASSDYSSDEGNVAGDEETDAGPHYDAPGRSLSMGNVMAPQSNGHQGLKRKASLRIQTEALSRPRTSKDSSPSTSALASSSTQSPPGHRLRSRKVSASTPVDVPTPTSAASKGRGKGKNKQVEFSTEIVQVKSTSRRSSQKEKDRQREQAEALAEESDLTDLDDALPVPTSRPQPSPRRLRSKDRGRTHIDSKSRESDDADHTPTSKSRSAKAMPQSHSKPQPKRVTPMRKAKGKIKSLKESETEASHEEDGSENSEEDEEGQEVEMEMEEDDGEGEMEEDQDADVQGGDTGEEDEVDELVSSASITPPPSNTYARKTPLRQRLRRRPCATTAELDAEENEGDDEHEEDADGDDDDTETVDGHDGDEGEDDESTIAVEPRRLRNGKIVGDEEAHMDEDDGGSAEGGEEEAEESEETEGEPITVDETEEEAEEDTMEDEVDLSVATAKTLVRLRRDDLVKLCETRNLEPIGTKPQLAEALLQWRDRHANGSSCPSSTGTVRPPSTATTSRRRRKKQSSSSSVPVLLRSQKVHDDEPRTPVPGKEAKDKENDELELDLESLGLEDREIPPEKIQKLEKIGSGGFKDVFIGKFRGRRIAISEFRGQLSAMDIKELKLLGGFDHPNIVRFLGVSIPENTKETPVMIVSELCSNGDLFDYIRNVSAPSLHKVLTMMLDIARGLEYLHMRKPSVIHRDCKSSNILITAKGVAKIADFGLAKVKQSTRSMVRSLVGTVNWQAPELWTAHPKYNHKVDVFSCAMVFWEMLQWHLPNKKFPWEGMNEHAIYEQVGAKKQRPSITGLRKQWCPEIVTLIEEMWAQDPSDRPTMSKVVETLEDLVRQY

SEQ ID NO: 11219 - protein, 205 aa, Thermoplasma acidophilum
MSSDHRDQYYWRAKRDQFRSRAAYKLEFLIERYGIIKDGQAVLEIGSSPGGWTQVLVDHGCRVVAVDIQPMDEIPGVIFLKLNILREDAAERIREEMARSLVQRFDVVLSDAMAKTSGIRSSDHAASVMIGNAVMKIAMDTLRRGGVAVVKQFQGDMTGDFIKNWGHYFRDHRITKPPASRKESSEVYIIFYGFSGKETDNSVQG

SEQ ID NO: 11220 - protein, 901 aa, Dunaliella viridis
MPALANNTAEPSSSPGEMMLSKLKANGSSGGDSANGVPQQNGKVVVESFVHKHLGAPYEPPLSPEDPDWALHVPASTVNDKDKGTADAWIPRDPRILRLTGRHPLNCEPPMHDLMAAGFITPPSIHYVRNHGPAPKIRWDQHRLEIGGLVERPMSLTMDEIVSMPSVTIPVTMVCAGNRRKEENMLKKSIGFNWGPCAVSTGYWTGVKLCDLLKHVGAKGPKQGGGYHVGFSGPKGELPAGDGTYGTSIPWGKAMNPAEDVLVAYKHNGRWLTIDHGFPVRTIIPGNIGGRTIKWLCKITVQEKESNNHYHYMDNRVLPAHVDQEIATKEGWWFKPEYIINDLNINSAVARPWHDEVVSFKDAKKMYTVKGYAYAGGGHKIIRCEISLDGAQTWRLANIRRFAEPNEYGKHWCWVHWDIDVPIFDFFGPREMLLRAWDETQNTQPATITWNVMGMMNNCHFRVLLHPFMDDKGNVGVRFQHPAPVEVGERGNIGWREEENLRMQALEAAGITTKEGPLPPNRDIAAAAAAKPATPKATGSGKEYTMEEVAQHTTHDSAWFVHEGKVYDATAFLDEHPGGSDSILTATGADATEDFNAIHSKKARNMLADYYIGELVASKPGAPPQPQANGHATANGHTSLITLNPREKVTLKLAERIEVSHNTRIFRFALPSPEHILGLPTGKHLFVYAHVNGELVARAYTPISSDEDKGRLDLLIKVYGPNQHPAFPQGGKMSQHLDKLKIGETIQVKGPVGHFTYEGKGNYVNGKSKGKASKLSMLAGGTGITPILQVLEAIFRDKEDQTCMSLIFANNSEPDILARDRLDKLAQENPERFKVYHVLSKAPEGWPQGKGYVTEHMMRERFFPPGEDSLALMCGPPGLISLVGGPGFEKMGYSKERTVSF

SEQ ID NO: 11221 - protein, 207 aa, Zea mays
APSHYSLACASASRVAPPSPSPPLHPPRRPCTTAIALPSLALFLCPHLAHDFTVKDASGKDVDLSTYKGKVLLIVNVASQCGLTNSNYTELSQLYEKYKDQGFEILAFPCNQFGGQEPGTNEEIVQFACTRFKAEYPIFDKVDVNGDNTAPIYKFLKSSKGSLFGDNIKWNFSKFLVDKEGHVVERYAPTTSPLSIEKDVKKLLGSS

SEQ ID NO: 11222 - protein, 180 aa, Streptococcus mutans
MLEQNIKKVLYSEEEIIVKTKELGAQLTKDYAGKNPLLVGVLKGSVPFMAELMKHIDTHIEIDFMVVSSYHGGTTSSGEVKILKDVDTNIENRDVIFIEDIIDTGRTLKYLRDMFKYRQANSVRIATLFDKPEGRVVDIDADYVCYKVPNEFIVGFGLDYAENYRNLPYVGVLKEDVYSK

SEQ ID NO: 11223 - protein, 359 aa, Burkholderia xenovorans
MQVLSDTDKPTASAQRDMPQEFLPPRCTFSAEDWRILARQWYPVARSVDVKSSPVAVTLLDLELVTYRTPAGVHVARDLCPHRGVPLSMGCVEGDELVCAYHGLRYAADGQCRKIPAQPELKPSAKFRLTVFPAVERYGLVWTCLNPQGGEANLPPMPSWGDPLCQSILPPFVDIAGSAGRQVEGFVDVAHFAFVHHDAFADRNRPEVPMYQTEFTDFGLRTEYWSNVSNYPKALQHLAPDDFSWLRVYEIYPPFCARLTVHFPNEGRLNILNAASPVSARKTRLFVPITRNFDTTGSLDDVYAFNAQIFAEDQAIVERQRPEDLPLDMQAEAHFAADRTSVGYRRLLREMGLTMAYAG

SEQ ID NO: 11224 - protein, 250 aa, Nicandra physalodes
SGTIVCGKGMNLIFVGTEVGPWSKTGGLGDVLGGLPPALAARGHRVMTISPRYDQYKDAWDTSIAVEVKLGDSTEIVRFFHCYKRGVDRVFVDHPMFLEKVWGKTGGKIYGPKAGKDYLDNQLRYSLLCQAALEAPRVLNLNCSEYFSGPYGEDVLFIANDWHTALIPCYLKSMYQSRGIYENAKVVSCIHNIAYQGRFAFSDFSLLNLPDEYRSSFDFMDGYEKPIKGRKINWMKAGILESHRVVTVSP

SEQ ID NO: 11225 - protein, 416 aa, Vibrio vulnificus
MDLITLGKAAKDAAFQLATASTAQKNKALAIIADELEANAADILAANSKDIELGRQAGLSEAMLDRLLLNESRLNGIANDVRNVISLTDPVGSEIDSKVLENGMQLSRRRVPLGVVGVIYEARPNVTIDIAALCLKTGNASILRGGKETFFSNMELVKVIQSALAKAGLPAASVQYIEKPDRELVTQLLKLDDYVDMIIPRGGAGLHKMCKENSTIPVIIGGFGISHIFVDETADLAKSVDVVENAKAQRPSACNALDTLLVHERIAEQFLPMLVAKLNGKVTFVVEPKAKAYMTKAEQVRDASEGDFDTEWLSYTLGVKVVADVQEAIDHMREHNASHSDAIMTNHLQNAELFINSAGSAAVYVNASTRFTDGAQFGLGAEVAVSTQKLHARGPMGLEELTSYKWVGKANYLSRA

SEQ ID NO: 11226 - protein, 236 aa, Glycine max
  misc_feature (122)..(122): Xaa can be any naturally occurring amino acid
MAQRDLRLLGAWFSPFALRVQIALNLKGLDYEVVEETLNPKSELLLKSNPVHKKIPVFFHGDKVICESAIIVEYIDEVWSNNALSILPQNAYDRANARFWVSYIDDKWYTSIRKSVLLKRLXQDDEAKKPHFVRMEEALERMEEVFNKCSEGRAYFGGDTIGIVDIVFGSLWSWMRVIEEMNGRKVFDEAKNPALAKWADKFSADPAVKGVLPETQKLIEFAKIRKQKWAAAAAAK

SEQ ID NO: 11227 - protein, 254 aa, Pyrobotrys stellata
MSAVAFRAQRAVAAKAGRKTTVSVQARRTQAKKAVPESPFYGPNRPLFLGGLSGEPPAYLNGEFPGDYGWDTAGLSADPETFKRYRQLELIHARWALLGALGCVVPELLARNGVAMPADGVWFKVGAEIFKEGGLNYLGNENLVHAQSIVATLLVQLVLMGWAEGYRINGGPLGEGLDPLYPGGAFDPLGLADDPDTLAELKVKELKNGRMAMAAMFGFLVQAIVTQKGPLENLADHLAAPGTNNVFSNAATYA

SEQ ID NO: 11228 - protein, 501 aa, Escherichia coli
MNMSSISHGAPQKRRIIPNPGLWLAIIAGIIITLLPLGDTLPVAGQNMIAILVFAIIVWISEAMDYTASAIVISALIIFMVGFAPDMNHPDTILGTAKALKMTLSGFSNSALALVAAAMFIAAAMTITGLDKRIALFTMSKIGASSRSIIIGAIVVTIVLSLVVPSATARTACVVPIMMGVIAAFKVDKHSRLAASMMIVIAQATSIWNVGIQTSAAQNLLSIGFINKTFGAGHSVSWLDWLLAGAPWSLTMSVILYFLARKLLPPETEAVEGGSEAIKKALAELGPTTGKEKRLIGISLLLLLFWSTGGKLHSIDTTSVTLAGLAIMLLPGIGVMSWKEVEKRVQWGTLLMFGIGISLGSTLLDTQAASWMANYVVKGFGLDGLPSLAIFAILAAFLIIIHLGFASATALTAALLPILISLLSSLPPELGVNPVGMTILLAFSVSFGFILPINAPQNMVCMGTDTFTPRQFTRVGLYLTVIGYLLLLLFAATWWKILGLM

SEQ ID NO: 11229 - protein, 334 aa, Methanococcoides burtonii
MFGTVELGTEGDTTESVESGEEGEMTGSDTKGESNESGKEGEVTESDMKGESVESGKEGEMTESEIKGESNGSGKEGEMTESEIKGESKGSGKEGEMTESEIKGESKGSGKEGEVTESDMKGESVESGKEGEMTGSDTKGESKGSGKEGEVTESDMKGESVESGKEGEMTGSDTKGESNGSGKEGEMTESEIKGESNGSGKEGEMTESEIKGESNGSGKEGEMTGSDTKGESNGSGKEGEMTESEIKGESNGSGKEGEMTESDTKGESNGSGKEGEMTGSDTKGESNGSGKEGEMTESDTKGESAGSGKEFIQSKSSTDPNSLILDIPLRDKTR

SEQ ID NO: 11230 - protein, 316 aa, Unknown
  Synechococcus sp. WH 7805
MSMPGTVLITGTTSGVGLNATRALVSRGWTVITANRSPQRAAAAADELDLPKERLQHVLMDLGDLESVRQAVDALPETLDAVVCNAAVYKPKLKQPERSPQGYEISMATNHFGHFLLVQLLLGRLQNSSHPSRRVVILGTVTANSKELGGKIPIPAPADLGDLSGFEAGFKDPIAMASGKPFKPGKAYKDSKLCNMITTQELHRRLHADMGITFTSLYPGCVADTPLFRNTPKAFQTIFPWFQKNITGGYVSQALAGERVADVVANPDFAESGVHWSWGNRQKKDGQQFSQELSDKATDPDTARRVWELSMQLVGL

SEQ ID NO: 11231 - protein, 223 aa, Clusia minor
  misc_feature (197)..(197): Xaa can be any naturally occurring amino acid
QLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKDHHFWXVRTPIPLIMVKAKIQDKEGIPQTNSG

SEQ ID NO: 11232 - protein, 726 aa, Arabidopsis thaliana
MTEIDRSRAFAKDVKRIVVKVGTAVVTGKGGRLALGRLGAICEQLAELNSDGFEVILVSSGAVGLGRQRLRYRQLVNSSFADLQKPQMELDGKACAGVGQSSLMAYYETMFDQLDVTVAQMLVTDSSFRDKDFRKQLSETVKAMLRMRVIPVFNENDAISTRRAPYKDSTGIFWDNDSLAALLSLELKADLLILLSDVEGLYTGPPSDSTSKLIHTFIKEKHQDEITFGEKSKLGRGGMTAKVKAAVNAAYGGVPVIITSGYAAENISKVLRGLRVGTLFHQDAHLWAPVVDTTSRDMAVAARESSRKLQALSSEDRKQILHDIANALEVNEKTIKAENDLDVAAAQEAGYEESLVARLVMKPGKISSLAASVRQLAEMEDPIGRVLKKTQVADDLILEKTSSPIGVLLIVFESRPDALVQVSSLAIRSGNGLLLKGGKEARRSNAILHKVITDAIPETVGGKLIGLVTSREEIPDLLKLDDVIDLVIPRGSNKLVSQIKNSTKIPVLGHADGICHVYVDKSGKLDMAKRIVSDAKLDYPAACNAMETLLVHKDLEQNGFLDDLIYVLQTKGVTLYGGPRASAKLNIPETKSFHHEYSSKACTVEIVEDVYGAIDHIHQHGSAHTDCIVTEDSEVAEIFLRQVDSAAVFHNASTRFSDGFRFGLGAEVGISTSRIHARGPVGVEGLLTTRWIMRGKGQVVDGDNGIVYTHKDLPVLQRTEAVENGI

SEQ ID NO: 11233 - protein, 182 aa, Brassica napus
  misc_feature (40)..(40): Xaa can be any naturally occurring amino acid
MAYSMLSSAAVVTSPAQATMVAPFTGLKSSSAFPVTRKAXNNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 11234 - protein, 174 aa, Methanocaldococcus jannaschii
MASLRPNRCYRDVDKPPYTRKEYVKGVPQPKVVHFIMGNLSAEFPVKVNLVATRPIQIRHNALEAARVAANKYLTKMCGRMGYKFQIRVYPHQILREHKMATGAGADRISDGMRLAFGKPIGTAARVKEGQAILTVWVNPDKFPAAKEALRRAAMKLPVPCRIVIEQGKELLKL

SEQ ID NO: 11235 - protein, 849 aa, Gibberella zeae
MAMLASKAAFPAGMGSSSHTPVASQPAMPLPRRTPMMPSSGAYGSPTESEFTEHDPAESVKNWDEDQVCEYLRTVKCGEYEKIFRKNHINGENLLEMDKDVLKEMGVEKVGDRVRLFLSIKKLRTRAYANEKKRNRDSFGGLDIQITAPNDSPRLHSSRGVPASSSKRYSRQLDLYGALDNGKTSSRPNSPLPGTDVRNLRARGKTYASIPVNAQGQRIVTTNPDLPANRLVTTHTRNNSSMDGSLMAALPQGQEVIRVISTGGVTKVVKISGCNTCEEVMRVTLRKFALREDHERNYCFWVLAGIDPDPGQCRRLGDTELWRIIKDQRRPERNRLILRRVPAGEPGEAELHRAAAIAMEEEQQKHARALETVDKRRSLRPFGGLRPPSELIASDLTSYFPDHTREDIDRTARLSMRRSTRMSKVNSRLSVASNLSFASSIQDAPPIPTIADSWLNANTQLAKVRTRDSHIRVPQAAYNRDSVTSSVLDTLQEESSLEPDRKSYVSFTESGSDSAPVSVTDPEGNTTATSYYDGDTSTGSGSFQEIRQALTNDGDDVDEELHSFLAGESWGDDKWMKGALIGQGSFGCVYLALHAVTGELLAVKQVETPAPGANSQGDNRKKGMIDALKREISLLRDLRHPNIVQYLGCSSTADYLNIFLEYVPGGSVQTMLNSYGALPEPLVRSFVRQILTGLSYLHNQDIIHRDIKGANILVDNKGTIKISDFGISKKLEATNILNGANNSKHRPSLQGSVFWMAPEVVKQTSYTRKADIWSLGCLVVEMMTGSHPFPDCSQLQAIFKIGGGKAAPTIPEHASEAAKEFLAQTFEIDHNLRPSADQLILSPFLIPIT

SEQ ID NO: 11236 - protein, 472 aa, Candida albicans
MSLSPKLEEIVSSIEKSFEIKDDFLVKATEYFVESMNVGLESPKPSKDVMPMIPTYVTSIPTGKEVGLYLAADLGGTNFRVCSIDLKGDHTFSMKQSKYRIPVDLMKAEKSNDLFGFLAKKVQSFLLENHSEACTAKNTEPLKLGFTFSFPVNQTALNRGTLIRWTKGFDIPDTVDRDVVELLQANLTILEVNVKVVAIANDTVGTLLTAAYSNDSAKTNRNTIIGCIFGTGTNGVYFESKIPKLSSLTGKSQGMVINTEWGSFDNGLKILPSTEFDEIVDSETANPGYHLFEKRISGMFLGEILRVALIHLFKNGLIFQELYKARGGSLPHRIEEPWLLDAEVLSYLQIDDSTDLKTSGLILQNVLRLETNKEEREVIQRLTRAISQRAAHLSAIPIAAIAKKVKDQYKDDDRDFEVGCDGSVIEFYPGFRQAVLESIEKINPLKGTNKKIHLKIAKDGSGVGAALCASTA

SEQ ID NO: 11237 - protein, 192 aa, Pirellula sp.
MPFDSEIVEVKTRPGEEVATLAGGCFWCTEAVFERMEGVNDVVSGYIGGKIKNPNYKQVCGKMTGHAEAVQIYYDPSKTNFEELLKVFFKTHDPTTLNRQGADGGPQYRSSIFVHNDEQREIAKKTMEKLGEEYRDPIVTLIEPATKFYVAEEYHQDYYRRNPNAGYCQAVVAAKVRKFNRNFGDKIKGSGK

SEQ ID NO: 11238 - protein, 147 aa, Glycine max
  misc_feature (104)..(104): Xaa can be any naturally occurring amino acid
NEGLFFIFLCSFSDLQNPQGDLDGKACAAVGQSSLMALYDLMFSQLDVTSSQLLVNDGFFRDTAFRKQLSDTVSSLLDLRVIPIFNENDADSTRKAPYEGELSXDSSGIFWDNDSLAGLLALELKADLLVLLSDVDGLYSGPPSDPK

SEQ ID NO: 11239 - protein, 901 aa, Dunaliella viridis
MPALANNTAEPSSSPGEMMLSKLKANGSSGGDSANGVPQQNGKVVVESFVHKHLGAPYEPPLSPEDPDWALHVPASTVNDKDKGTADAWIPRDPRILRLTGRHPLNCEPPMHDLMAAGFITPPSIHYVRNHGPAPKIRWDQHRLEIGGLVERPMSLTMDEIVSMPSVTIPVTMVCAGNRRKEENMLKKSIGFNWGPCAVSTGYWTGVKLCDLLKHVGAKGPKQGGGYHVGFSGPKGELPAGDGTYGTSIPWGKAMNPAEDVLVAYKHNGRWLTIDHGFPVRTIIPGNIGGRTIKWLCKITVQEKESNNHYHYMDNRVLPAHVDQEIATKEGWWFKPEYIINDLNINSAVARPWHDEVVSFKDAKKMYTVKGYAYAGGGHKIIRCEISLDGAQTWRLANIRRFAEPNEYGKHWCWVHWDIDVPIFDFFGPKEMLLRAWDETQNTQPATITWNVMGMMNNCHFRVLLHPFMDDKGNVGVRFQHPAPVEVGERGNIGWREEENLRMQALEAAGITTKEGPLPPNRDIAAAAAAKPATPKATGSGKEYTMEEVAQHTTHDSAWFVHEGKVYDATAFLDEHPGGSDSILTATGADATEDFNAIHSKKARNMLADYYIGELVASKPGAPPQPQANGHATANGHTSLITLNPREKVTLKLAERIEVSHNTRIFRFALPSPEHILGLPTGKHLFVYAHVNGELVARAYTPISSDEDKGRLDLLIKVYGPNQHPAFPQGGKMSQHLDKLKIGETIQVKGPVGHFTYEGKGNYVNGKSKGKASKLSMLAGGTGITPILQVLEAIFRDKEDQTCMSLIFANNSEPDILARDRLDKLAQENPERFKVYHVLSKAPEGWPQGKGYVTEHMMRERFFPPGEDSLALMCGPPGLISLVGGPGFEKMGYSKERTVSF

SEQ ID NO: 11240 - protein, 83 aa, Desulfotalea psychrophila
MSEASMAKEEAIEVEGTIIEPLPNAMFRVELDNGHKVLAHISGKMRMHFIKILPGDRVTVELSPYDLTRGRVTFRTKNTKKKK

SEQ ID NO: 11241 - protein, 351 aa, Oryza sativa
MENGHAKNLVAVIGSGNWGSVASRLIASNTAKLPSFHDEVRMWVFEEILPTGKKLSESINQANENCKYLPGIKLGANVIADPDLENAVKDANMLVFVTPHQFVEGICKKLVGKLRPGTEGISLIKGMEVKMEGPCMISKLITNILGINCCVLMGANIANEIAVEKFSEATIGYKKDKEVATRWAKLFTTPYFLVSVVEDIEGVELCGTLKNVVAIAAGLVDGLDMGNNTKAAIMRIGLREMRAFSKLLSPTVRDNTFFESCGVADLITTCLGGRNRRVAEAFARNGGKRSFDELEAEMLHGQKLQGVSTAKEVYEVLTYRGWQELFPLLSTVHEICIGQLPPTSIVEYRIH

SEQ ID NO: 11242 - protein, 316 aa, Haemophilus influenzae
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLLGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 11243 - protein, 312 aa, Zea mays
MISRDTIRRAIGVIGNGSALVLFLSPVPTFIRIWKKGSGEQYSPIPYVATLLNCMMWVLYGLPAVHPHSMLVITINGTGMEIQLTYVALFLLYSVGAARRKVVLLLAAEVGFVGAVAALVLTLAHTHERRSMVVGILCVLFGTGVYAAPLSVMKMVIQTKSVEYMPLFLSLASLVNGICWTVYALIRFDLYITIPNGLGVLFAVAQLVLYAIYYKSTQEIIEARKRKADQIAMTGVVVDGGKTNNQAGAGQYAQARSQRQINYVAAGFYVFCDSICTLAACPSRPMEKKGGRKNVCRYMCSRRITLAHSWWG

SEQ ID NO: 11244 - protein, 227 aa, Solanum lycopersicum
GTEVGPWSKTGGLGDVLGGLPPALAARGHRVMTISPRYDQYKDAWDTSVALEVKVGDSIEIVRFFHCYKRGVDRVFVDHPMFLEKVWGKTGSKIYGPKAGLDYLDNELRFSLLCQAALEAPRVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILES

SEQ ID NO: 11245 - protein, 190 aa, Cryptococcus neoformans
MPNGLPEHNGAPPPPMNNSSIINGNSEWKLCIRDQKEARLIFPRFPEEFKYMTLDISDHPDQNLITIFPTCRDFVEEALSTGGTVLAHCNGGIALSPAIVVGYLMWKFNWTAEHALAHVQNKRYCVSTMSFQNQFKEYEPIYMAQKMVETAAKRETTTSKRQVEEEDEEGDGYRRKQRYVQGEASDMMLD

SEQ ID NO: 11246 - protein, 118 aa, Panax ginseng
LCSGGELFDRIIQRGHYSERKAAELTKIIVGVVESCHSLGVMHRDLKPENFLLVSKDDDFSLKAIDFGLSVFFKPGQVFTDVVGSPYYVAPEVLLKHYGPEADVWTAGVILYILLSGV

SEQ ID NO: 11247 - protein, 248 aa, Brassica napus
  misc_feature (159)..(160): Xaa can be any naturally occurring amino acid
MDATKEASVTDLKRPREEDDHATAAVASMETDNSAPASNGEQTKKPACFSSVIPGWFSEMSPMWPGEAHSLKVEKVLFQGKSDYQDIIVFQSATYGKVLVLDGVIQLTERDECAYQEMITHLPLCSIPNPKKVLVIGGGDGGVLREVARHSSVEQIDMXXIEDIVSNCREIFKGSVNYAWTSVPTYPSGVIGFMLCSTEGPDVDFKHPVNPIDDSKSSGPLKFYNAQIHSAAFCLPSFAKKVIESKTN

SEQ ID NO: 11248 - protein, 358 aa, Unknown
  Malus x domestica
MAMEGSAIGFEGYEKRLEIAFFEPSIFLDPEGRGLRSLSKAQIDEFLDQAECTIVSSLSNDDVDSYVLSESSLFIHPYKMIIKTCGTTKLLRVIPTVLQLAETISLAVRSVKYTRGSFIFPGAQTYPHRSFSEEVSVLDSYFGKLGSGSRAYVMGRSDGPQKWHVYSATAESASFVEPVYTLEMCMTGLDRGKASVFYKSESSSATTMTNESGIRKILPDSDICDFEFDPCGYSMNSIEGAAISTIHVTPEDGFSYASFETAGYDLKDVNLNQLVERVLVCFQPKEFSIAVHANVVSKSLQQHSLVDLKGYCREESSHEELGLGGAIVYQRFLKTERCGSPRSTLKGCWREEEEEEDY

SEQ ID NO: 11249 - protein, 306 aa, Musa acuminata
MAIPVIDFSKLDGKERAETMARIANGCEEWGFFQLVNHGIPVELLERVKKVSSECYKLREERFKGSKPVQLLDTLVKEGDGQRLDNVDWEDVFVLQDDNEWPSNPPDFEETMKEYREEIRKLAEKMMEVMDENLGFEKGCIKKAFSGDGQHPPFFGTKVSHYPPCPRLDLVKGLRAHTDAGGVILLFQDDQVGGLQMLKDGRWIDVQPLADAIVINTGDQIEVLSNGRYKSAWHRVLATSHGNRRSIASFYNPSLKATIAPAAGAATEEAAPPALYPKFLFGDYMDVYAKQKYEPKEPRFEAVRAI

SEQ ID NO: 11250 - protein, 332 aa, Pinus pinaster
MAKEPARILVTGAAGQIGYALVPMIARGIMLGPDQPVILHMLDIPPAAEALNGVKMELIDAAFPLLKGIVATTDPVEACSGVNIAVMVGGFPRKEGMERKDVMSKNVSIYKSQASALEQHAAPNCKVLVVANPANTNALILKEFAPSIPEKNVTCLTRLDHNRALGQILERLHVPVSNVKNVIIWGNHSSSQYPDVYHASVVTGAGEKPVRELVADDAWLDGEFITTVQQRGAAIIKARKLSSALSAASSACDHIRDWVLGTPKGTFVSMGVYSDGSYDVPPGIIFSYPVTCENGSWSIVQGLPINEFSRKKLDATANELVEEKALAYSCLN

SEQ ID NO: 11251 - protein, 211 aa, Aloe vera
MISRAMQARNYNLGVRSQPMKLAAAAAPPQPKPTKLYRGVRQRHWGKWVAEIRLPKNRTRLWLGTFDTAEEAALAYDKAAYKLRGDYARLNFPHLKHTGAHLAPGGPLHSSVDAKLQAICQSLEQNKSSNSNSSKKEKRGDAVEEKSDKVVVVVAEGEESCSSSSMNTGSASSPSSEIESLDFTEVPWDESEDFVLRKYPSWEIDWDAILS

SEQ ID NO: 11252 - protein, 457 aa, Salmonella enterica
MDHLPIFCQLRDRDCLIVGGGDVAERKARLLLEAGARLTVNALTFIPQFTVWVNEGMLTLVEGPFDETLLDSCWLAIAATDDDTVNQRVSEAAESRRIFCNVVDAPKAASFIMPSIIDRSPLMVAVSSGGTSPVLARLLREKLESLLPQHLGQVARYAGQLRARVKKQFATMGERRRFWEKFFVNDRLAQSLANADEKAVNATTEHLFSEPLDHRGEVVLVGAGPGDAGLLTLKGLQQIQQADIVVYDRLVSDDIMNLVRRDADRVFVGKRAGYHCVPQEEINQILLREAQKGKRVVRLKGGDPFIFGRGGEELETLCHAGIPFSVVPGITAASGCSAYSGIPLTHRDYAQSVRLVTGHLKTGGELDWENLAAEKQTLVFYMGLNQAATIQEKLIAFGMEANMPVALVENGTSVKQRVVHGVLTQLGELAQQVESPALIIVGRVVALRDKLNWFSNH

SEQ ID NO: 11253 - protein, 339 aa, Silicibacter pomeroyi
MHLARYPRRFIAHLPTPLERLDRLTAELGGPEIWIKRDDCTGLSTGGNKTRKLEFLMAEAELQGADMVMTQGATQSNHARQTAAFAAKLGMDCHILLEDRTGSNNANYNNNGNVLLDHLHGATTEKRPGSGLDMNAEMEKVAEKFRADGRKVYTIPGGGSNPTGALGYVNCAFEMLNQFNERGLKVDHIVHATGSAGTQAGLITGLQAMNAQIPLLGIGVRAPKPKQEENVYNLACATAEKLGCPGVVAREDVVANTDYVGEGYGIPTESGLEAIRMFAELEAILLDPVYSAKGAAGFIDLIRKGHFKKGERVVFLHTGGAVALFGYDNAFDYSGRWVA

SEQ ID NO: 11254 - protein, 215 aa, Pseudomonas fluorescens
MVLRSEILVNKNVLPTKEQALPGRETPMALPAEHYVNGNPLLGPFPGNVDFAIFGLGCFWGAERRFWQREGVFSTCVGYAGGFTPNPTYEEVCSGLTGHTEVVLVVYEPEKVSYKELLAMFWELHNPTQGMRQGNDIGTQYRSVIYATNPTQLEQALHSRDVFQAELTKAGLGTITTEIEEAPTVYFAEAYHQQYLAKNPEGYCGIGGTGVTCPI

SEQ ID NO: 11255 - protein, 342 aa, Oryza sativa
MADQLISTADHDTLPGNYVRPEAQRPRLADVLSDASIPVVDLANPDRAKLVSQVGAACRSHGFFQVLNHGVPVELTLSVLAVAHDFFRLPAEEKAKLYSDDPAKKIRLSTSFNVRKETVHNWRDYLRLHCYPLHRYLPDWPSNPPSFREIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQALSNGRYKSVWHRAVVNSDKARMSVASFLCPCNDVLIGPAQKLITDGSPAVYRNYTYDEYYKKFWSRNLDQEHCLELFRTTPTDTS

SEQ ID NO: 11256 - protein, 482 aa, Listeria monocytogenes
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCK

SEQ ID NO: 11257 - protein, 517 aa, Mesorhizobium loti
MALFELTLVLLLTAVALTALSRRLEVPYPSLLALAGVGIAFVPGAPMIEIDPELALALFIAPVLLDAAYDTSLRDLKRYRLSLLLLALGAVVFTTVVVAFVGWKMAGLPIAAAIALGAIVAPPDAVAASAVLGQFKVPHRITAILQGESLLNDATALLIYRLAVSAALGSIMLSNAIPVILLSTIGSLIAGYLLGRLSLLTLTRIEDAASSTVVQFAGTFGVWILADKLGLSAIITIVVYAITIARRAPRRMSARRRVSTYSVWESAVFVLNVLAFVLMGLQARSIVGRLSGEGQGEAFLFAATVLVVVIVARLVWVASYVAIIRWFARVGSEDKKRDLPTFGGAVLVGWCGMRGLVTLVVAIALPAGFPGRDPIVLAAFAVVLGTLVLQGMTLKPLLRILDFDPDRTIDNEVAQARVAVMQAALDVLSRKTSAAAAVVREQYEAQRVIAENPEDAQAATEYDRLRLYAINRQRDTLEELRSNGTIGDEAYHRLEEEIDWAELAASPAGRFQPLTTD

SEQ ID NO: 11258 - protein, 321 aa, Bacillus cereus
MNSVSEEKIYDVVIIGAGPAGMTAAVYTSRANLSTLMLERGIPGGQMANTEDVENYPGYESILGPDLSNKMFEHAKKFGAEYAYGDVKEVIDGKEYKTIIAGKKEYKARAIIVASGAEYKKIGVPGETELGGRGVSYCAVCDGAFFKGKELIVIGGGDSAVEEGVFLTRFASKVTIVHRRDTLRAQKILQDRAFQNEKVDFIWNHTIKEINEASGKVGSVTLVDVNSGEEKEVKTDGVFVYIGMLPLSKPFVELGITNENGYLETNERMETKIPGIFAAGDVREKMLRQIVTATGDGSIAAQSAQHYVEELLEELKTVSEK

SEQ ID NO: 11259 - protein, 488 aa, Listeria monocytogenes
MNLEETMPLVFERSIPGRIGFSLPESDVPETKASDYFEQAYIRSVPADLPELSELEIMRHYTNLSNHNFGVDSGFYPLGSCTMKYNPKINEKVARFPGFANIHPNQPESSVQGALELLYDLQTSLVEITGMDEVTLQPAAGAHGEWTGLMLIRAFHEKNGDTKRTKVIIPDSAHGTNPASAAVAGFDVVTVKSNEKGLVDVADLKKVVGEDTAALMLTNPNTLGLFEKDIVEMAEIVHEAGGKLYYDGANLNAIMAKVRPGDMGFDVVHLNLHKTFTGPHGGGGPGSGPIGVKKELIPFLPTPVLTKKEEGYTFDYNYPDSIGRVKPYYGNFGINVRAYTYIRTMGPDGLKLVTEYAVLNANYMMRKLQEAYDLPFDQVCKHEFVLSGNRQKKLGVRTVDIAKRLLDHNFHPPTVYFPLIVGEAIMIEPTETESKETLDSFIDTMLKIAKEAEENPEIVQEAPHSTYVKRLDETRAARKPILRYQKEV

SEQ ID NO: 11260 - protein, 671 aa, Listeria monocytogenes
MAIFISNLLNRFVPFVSVPLIQIGLGVLIAIMPITFDLQLNPELFLVMFIAPLLFNDGRQTDKAALWGMRMPILVLALGLVFATVVVIGYFVHWMIPTIPLAAAFALAAALAPTDAVAVSSLSGRINLPKRIMNLLEGEALINDASGLVAFQFAIAAMVTGVFSFMDASISFFVIAIGGILVGLILSWLKFRLLKWVRGLGMEDVTFHMLIQILTPFIIYLAAEEIHVSGILAVVAAGIMHSMEQKKMDPQSVKLNVVSQSTWSVIIFVLNGLVFLLLGTQLPAITEVVWNDSGSSNLQVMAYILSITAALILLRFLWVYISWSIGAKQRQKQNKKTQLPKFRPVVLTSLSGVRGAVTLASALAIPFFLDDGSLFPQRSLIIFIASGVILCTLVIATFILPLLAKSEEVTTEDERAETATRIRILRNVIRELKEQTLPETKAATDEVIEDYRRRIYDLQQNNSSNRGMDERERAKRLEIIQWERENTQKMTDEGRIVATDSYRYQHYLNMMEQAIKQRFRTKIKTAWMFLYRLIMLVIHPKKWGRITHKVKKGISKDSERFQAIRQLREENEVLIISKLKEQLTKENVDIIGPLITEHTIFLERVRKEHSPRGKRAKFEQKKREVQVLAFQLERDIIQNMFEKGGISRDLARDLRQNLNMIETYLYDDFLE

SEQ ID NO: 11261 - protein, 107 aa, Oryza sativa
MTEKKNRREKKTPREAKITFEGLVMEALPNGMFRVRLENDTIILGYISGKIRSSSMRILMGDRVKIEVSRYDSSKGRIIYRLPHKDSKRTEDSKDTEDLKDTKDLNG

SEQ ID NO: 11262 - protein, 105 aa, Zea mays
  misc_feature (15)..(16): Xaa can be any naturally occurring amino acid
  misc_feature (81)..(81): Xaa can be any naturally occurring amino acid
  misc_feature (90)..(90): Xaa can be any naturally occurring amino acid
MVRRPPRFYRQRKNXXYPKSRYCRGVPDPKIRIYDVGMKRKGVDHFPYCVHLVSWEKENVSTEALKATLIVCNKYMTNSAXKDASHLTVXVHPLHVLRINNMLSC

SEQ ID NO: 11263 - protein, 276 aa, Chlamydomonas eugametos
MTSHAANPKEEQDQRLPFKSDISGPIAPSQAPAHTVQAHDSQPKPSDDSSDEHLSFYEAKARIVRAFAASRAPQPAAPAAKALEGDASVIVPGKLILSSCEVEESSELLTKLGVTHILQVGEELKPSHPGRFTYLSLPILDMEGQDIVALLPSCFQFLQQAQASGGVCLVHCLAGISRSASVVIAYLMWTQGMPYTEARAMVRRARSKVYPNTGFTLQLQELDRLRESGAIQWGDTPSLASSLEQHRQPWNLIRYLEVKEKQAQEEGWTWGRTLVI

SEQ ID NO: 11264 - protein, 549 aa, Escherichia coli
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSILEENLERRFRLAALRSERAELYHLRATREISNETLQKLLHDLDLLEALLIEENQ

SEQ ID NO: 11265 - protein, 131 aa, Pseudomonas aeruginosa
MRILHSMLRVADLEAALEFYTRALDMRLLRRRDYPEGRFTLAFVGYQDERAAAALELTHNWDRDGYTQGDGYGHLAIEVEDAAVTCARARALGYRVTREAGLMQHGRSVIAFLEDPDGYKVELIQKGTQFD

SEQ ID NO: 11266 - protein, 489 aa, Aspergillus nidulans
MTEDADFGLIGLAVMGQNLILNAADHGFTVCAYNRTTSKVDRFLENEAKGKSIVGAHSVEEFCSKLKRPRRIMLLVMAGNPVDQFIESLLPHLEEGDIIIDGGNSHFPDSNRRTKYLKEKGIRFVGSGVSGGEEGARYGPSLMPGGNEEAWPYIKDIFQSIAAKSDGEACCDWVGDEGAGHYVKMVHNGIEYGDMQLICEAYDILKRGVGLSSKEIADVFAKWNNGVLDSFLIEITRDILYFNDDDGTPMVEKILDKAGQKGTGKWTAVNALDLGMPVTLIGESVFARCLSALKDERIRASSLLNGPTPEFTGDKEEFIADLEQALYASKIISYAQGFMLIQNAAKEYGWKLNKPAIALMWRGGCIIRSVFLKDITEAYRKDPDLENLLFNDFFNKAIHNAQKGWRNVVSKGALWGIPTPAFSTALSFYDGYRTKALPANLLQAQRDYFGAHTFRIKPEHASEKYPADKDIHVNWTGRGGQVSASTYTA

SEQ ID NO: 11267 - protein, 304 aa, Vibrio parahaemolyticus
MPASQYQWTMSKHMATNDSVTPLPVQKPRLVSDNQVSGVTRFAKQSLKPGEVALVGAGPGDPELLTIKALNCLQQADVVLYDYLVSEEIMALIPSDTILVCVGKRAGHHSVPQEKTNQLLVDFAKQGYRVVRVKGGDPFVFGRGGEELEVLADAGIRFQVVPGITAAAGATAYAGIPLTHRDYAQSAIFVTGHLKEESDEMDWSTLARGNQTLVIYMGLMKSHYIQNQLIQHGRAASTPIAIIERGTQIQQKVFTGELSQLSDLSKEAQAPSLIVVGEVVRLSQKLDWFLSSTDFNKSAIANSI

SEQ ID NO: 11268 - protein, 1094 aa, Erwinia carotovora
MKRMLINATQQEELRVALVDGQRLYDLDIESPGHEQKKANIYKGKITRIEPSLEAAFVDYGAERHGFLPLKEIAREYFPSNYASHGRPNIKDVLREGQEVIVQVDKEERGNKGAALTTFISLAGSYLVLMPNNPRAGGISRRIEGDDRTELKEALGSLQLPDGMGLIVRTAGVGKSAEALQWDLAFRLKHWDAIKKAAEGRSAPFLIHQESNVIVRAFRDYLRQDIGEILIDNPKILELAKEHISALGRPDFSSKIKLYSGEIPLFSHYQIESQIESAFQREVRLPSGGSIVIDTTEALTAIDINSARATRGGDIEETAFNTNLEAADEIARQLRLRDLGGLIVIDFIDMTPVRHQREVENRLRDSVRQDRARIQIGRISRFGLLEMSRQRLSPSLGESSHHVCPRCTGTGTIRDNESLSLSILRLIEEEALKENTKEVHAIVPVQIASYLLNEKRDAVNAIETRQGGVRAIIVPHDGMQTPHYSVVRVRKGEEKPTLSYLLPQRLETETQQLQDEQTIERKQPEQPALATFSMAEMPEETTPPVAKAAPDVAKAAEEAQPGLISRFFSALKGVFASEPAAKAVDSVDEKKVEEEKAGEGQRSERRNPRRQGNNRRDRGSREQRDDQRRNKRQTEEVVAETRVAENVEKADSEEQPRREPRAERQRRRQDERRQAPVEEKIQPVADDSDDNTAEQDKPTQVMQRRQRRQLTQKVRVQSETQQDTLSDNTAPIAEAPELAQSYVKPNDVAVDNNESDNEQNDANRANGENGGMPRRSRRSPRHLRVSGQRRRRYRDERYPSQSPMQLEFAAASPEMASGKVWISYPVAQSQQAENQQLEENVAAIETPLLPAVVDVAVTAQADTAESNAIENVAITEAVVHEDAVVTATVQSADVIQDSNVEHVEVSAADEETVVEPITENTAIDDVIAAIAVSAVEEAKAVEVDDTDTTQATEDVQAVEAVVAEEKQADDIADATEKADVAEPVSSPVVSVVQEVSQPQSIQDEPVAAISAQSVVEEPASGVTKAATVVEQPHYKLHATAPMTKAPAPAYNAEPARHSDWVRPDYPFSGKGSAGGHSAVNQSTAPATKPAPVNE

SEQ ID NO: 11269 - protein, 97 aa, Gloeobacter violaceus
MATYKVTLVTPSGKKEIDCPSDEYILDAAERQGLDLPFSCRAGACSTCAGKMVSGTIDQGDQSFLDDDQIAAGYVLTCVAYPTSNCSIETHKEDELY

SEQ ID NO: 11270 - protein, 181 aa, Brassica napus
MASVMLSSATMTSSLAHATMVAPFIGLKSSAAFPVTCKANTEITSITSNGGRVNCMKVWPPVGKKKFETLSYLPDLTDVEIAKEVDYLIRNKWTPCIEFELEHGFVYREHGNIPGYYDGRYWTMWKLPLFGCTDSTQVLKEVKKCKQEYPNAFIRIIGFDNNRQAQCISFIAYKPPSFTDA

SEQ ID NO: 11271 - protein, 833 aa, Rubrobacter xylanophilus
MKAVIMAGGQGTRLRPLTSEQPKPMIRIANVPCMEHIVNLLKRHGFTDIAVTLQFMPDEIRDYFGDGSDWGVNIRYSVEDSPAGTAGSVKMAERQLGLEGERLLIISGDALTDVDLGELLAYHEQKGGEATMVLKSVENPLDFGIVITGEDGRISRFLEKPAWGQVFSDTVNTGIYLLEPSVLREIPDPEEGEYDFSKDLFPRLLEQGRPLYGMVTDAYWEDIGTLEQYASANRDVLEGRVRGVRPPGTRLRENIYVGRRVQVDDEELEGPVVIGDNVRIDEGARISPYSVIGNNVVVASGAHIERSIVADGTYVGEGAELRDTLVGRSCYIQERARILERSALGDDVIVGEGATIAPDVKVYPHKTVESGASVTQSLIYETMGLRTIFRGGRVSGKFNVDVTPEFVIRLASSFGTTLSPGSIVTLGRDSSAAAQVVKRAMTAALLATGVNVRDLRAAHAGVVRHDVLAGKSSAGCHTRAGEDSDEVEVLFFSSDATPMTEGEQRAIEKVFVREEYRRAHEGDIGQLIFPGRAVEQYVERLERAVDRSRVSGGSVVVDFCGGVAGLVASRVFSRLGISAVVMEGFANANVVGGAPRMDLEEGLERVGRIVPTVEAAFGCVVNPTGEQVHFVDDAGEYVPPDVMLACLIRGLEPREVVLPINLSSRYAELVESYGGTVHYARTGMGNVAIRAAERAADLGGLEDGQYIFPAFLPAPDCFMTLARALELFRDRPLSKVRREFGERFGNVVRERLECPWSAKGRVMRGLAERFGGDPDAILTEGVKLMVDGGWVLMLPDPDNPLFYVYAEADDGRRPEALMQDYVRLVRELIESGD

SEQ ID NO: 11272 - protein, 531 aa, Mycoplasma mobile
MKNVNSKKIVYQIYPSSFKDSKGTGRGDIKGIIEKLDYIKDLGVDYLWLSPIFKSPLKDNGYDVSDYLSINTLFGDLEDLKSLIKKAKEKNLKVMLDMVFNHTSTEHEWFKKWINNDPEYKDFYISKKSVGKPPTNWVSKFGGSAWKEYKKNNWYLHLFDETQADLNWENEKVKEKIKEVIRFYINLGVKGFRFDVINLISKSNFNEDETDGRKFYTDGKKVEDYLQELRNEFPKEGDFLTVGELSSTTMQKASIYSNLDKKRLDSAFTFHHLKIDYDEKGKFIYKKPDIKKLNEIFDTSFTETQKLNGYLAVFLNNHDQPRAVSRFIDEEFHNVGAKMLGMLTLSLPGDTYIYQGEEIGMKNPNFENKEDYKDVETLNYFKELKLEKANDGIKQKSRDNSRTPMQWNSEKNSGFSMVKPWINVAPSYKEINVEKQENDPNSILSFYRKMVKVSKSDKVFANGNITFLPYKENLIQFTRTYKNKTYYFIFSFSNKKISLDSKSNIIILYSNYEYEKNIIKPYQFIVGEISE

SEQ ID NO: 11273 - protein, 374 aa, Unknown
  Malus x domestica
MAVPVSAIGFEGYEKRLEVSFFEPGLFADPKGMGLRSLSKAQIDEILTPAECTIVSSLSNDDLDSYVLSESSLFVYPYKVIIKTCGTTKLLRSIPAILKLADSLSLAVKSVRYSRGSFIFPGAHPSPHRSFSEEVAVLDGHFGKLGLASKAYVMGSPDKTQKWHIYSASAELASLLWGSRQSGPTYTLEMCMTGLDRKRASVFYKSDASSAAGMTVESGIRNILPQSDICDFEFEPCGYSMNSIEGNAVSTIHVTPEDGFSYASFETVGYDFKDVNLTQLLYRVLDCFKPAEFSIALHTTSTAGEDLDAKCPLDLKGYCCGGSSYEGLGLGGAVMYHSFVKDDSGSQSPRSILKCCWSEDEKDEEVEEIGMAKI

SEQ ID NO: 11274 - protein, 217 aa, Physalis peruviana
  misc_feature (9)..(9): Xaa can be any naturally occurring amino acid
GLPPALAAXGHRVMTISPRYDQYKDSWDTSITVEVKVGDSIETVRFFHCYKRGVDRVFVDHPMFLEKVWGRTGSKIYGPKAGQDYLDNELRFSLLCQAALEAPRVLNLDCSKYFSGPYGEDVLFIANDWHTALIPCYLKSMYQSRGIYMNAKVAFCIHNIAYQGRFAFSDFSLLNLPDEYRSSFDFIDGYEKPVKGRKINWMKAGILESHRVVTVSP

SEQ ID NO: 11275 - protein, 375 aa, Clostridium tetani
MPKKDFYEVLGVEKGANDAEIKKAFRKLALKYHPDKNAGNKEAEERFKEINEAYQVLSDPQKRAQYDQFGTADFNGGGAGFSGFEDFDLGDIFESFFGGGFGGFGGSSRRRNGPQKGPDVQYSINLTFNEAVFGVEKEVSITKSETCETCTGTGAKPGTNSKTCPKCNGSGQIKVQRNTALGSFVSVNTCDMCGGKGTIISDPCSDCKGKGTVRKQKKIKVNIPAGVDTGNVIPIRGQGEAGVNGGPPGDLYISVRVMPDPFFKRRGDDIYIDQHISFAKASLGTELKVKTIDGEVKYDIPSGTQPGTVFRLKGKGVPHVNGRGRGDQYVNIIVDIPKSLNQKQKEALFAYMEASGEIQSSEKEGFFDKIKKNFK

SEQ ID NO: 11276 - protein, 390 aa, Glycine max
MGKREKQKQRHERGHRGRGSFNYLQEDHDFDDTPRSSPSEEEGADGSNEEKEEDEENVTISHENQSHDMPSKFLLYQQSVQSPKGDISYMQKFFLMYVGGRMPLHLQEDFCGTALLSTEWLRSDSRRTVVGLDLDLEALNWCMENNIPKVGADGFSRISLFHGNVLQPLQSKLVKVDPQELVSNISLSQNEENLQTGVPESDAPTGSIAQDDKYTKGNITLPGRDIVCAFNYSCCCLHKRAELVLYFKHARGALSTKGGIFVMDLYGGTSSEHKLRLQRRFPNFTYVWEQAEFDIIQRKTRISLHFHMKKEQRKLRHAFSYSWRLWTLPEIRDCLEEAGFRSVHFWVREMPDTTEIMKTEGFGAGKNVKYEEATSFQQQDSWNAYIVGVA

SEQ ID NO: 11277 - protein, 382 aa, Pseudomonas putida
MTSPVVIIGTGLAGYNLAREFRKLDAQTPLLLITADDGRSYSKPMLSMGFAKQKDADGLCMAEPGVMAAQLNAEIRTHTRISGIDPGHKRLWIGEEAVEYRDLVLAWGAQTVQVPIEGDGSHLVFPINDLEDYARFRAAAVGKQRVLILGAGLIGCEFANDMSLGGFKVDVVAPCEQVMPTLLHPAAAAAVQAGLQGLGVSFHLGPVLTRLQQVAQGLEAHLSDGSVIACDLVVSAIGLRPRTDLAAAAGLRTNRGVSVDRELRTSHANIFALGDCAEVDGINLLYVMPLMSCARALAQTLAGKPTAVAYGPMPITVKTPACPLVVSPPPLGNEGTWQVEGQGSDLKVLCHGADGKLLGYALTGAAVMDKLSLNRQLPPVMA

SEQ ID NO: 11278 - protein, 520 aa, Zea mays
MGDVAHHHVHDPASFSPLSSDAGLSPHFPPALADGGAGALDLSFTSTASASTSSFTTATTFSARSSLSLPSFSSSTSLSPRPHSSSASPHWAHLAAARAATPDGVLRLAHLHLVRELGHGHLARVFLCRLKSSPPASPLFALKVVDLRDDDPSRVSHVLAESRVLSCLDHPFVPTLYARLDAGRYACFLMDYCSGGDLHAVLRRRPGGRLPVAAARFYAAEVLLAIEYLHALGFVYRDLKPENVLLRGDGHVVLSDFDLALPASVEPAVRLRQVRKQSRRRRIALLLSCFSGPSNGGGEDEEEIDGKERFEFVAEPTAASSKDCVGTHEYLAPELVSGSGHGNGVDWWAFGVFLYELVYGRTPFKGHTKEATLKNILSKQATYPQLDGEADASQLRDLVGRLLERDPRRRMGATRGAAEIKRHPFFSGVDWALIRCVAPPVVPDRDAAAPVGGGDRKAAKLGSWSSMSSNRGSKKRKSSSFGRRSTSTCEERQGVFRKLMSWNQESRSSNKIKTTTSKVK

SEQ ID NO: 11279 - protein, 847 aa, Salmonella enterica
MSKVRLAIIGNGMVGHRFIEDLLDKSDASLFDITVFCEEPRKAYDRVHLSSYFSHHTAEELSLVREGFYEKHGVKVLVGERAITINRQEKVIHSSAGRTVYYDKLIMATGSYPWIPPIKGSETQDCFVYRTIEDLNAIEACARRSKRGAVVGGGLLGLEAAGALKNLGVETHVIEFAPMLMAEQLDQMGGEQLRRKIESMGVRVHTSKNTQEIVQQGNEARKTMRFADGSELEVDFIVFSTGIRPRDKLATQCGLAVAQRGGIVINDTCQTSDPDIYAIGECASWNNRVYGLVAPGYKMAQVAVDHILGSENAFEGADLSAKLKLLGVDVGGIGDAHGRTPGARSYVYLDESKEVYKRLIVSEDNKTLLGAVLVGDTSDYGNLLQLVLNAIELPENPDSLILPSHASSGKPAIGVDKLPDSAQICSCFDVTKGDLIAAINKGCHTVAALKAETKAGTGCGGCIPLVTQVLNAELAKQGIEVNNNLCEHFAYSRQELFHLIRVEGIKTFEELLTKHGKGYGCEVCKPTVGSLLASCWNEYILKPQHTPLQDTNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNLEGGIEYLKSVIIDDKLGLNEHLEEEMARLRAAVVCEWTETVNTPAAQVRFKHFINSDKRDPNVQVVPEREQHRPATPYERIPVTLVEENA

SEQ ID NO: 11280 - protein, 321 aa, Flavobacteria bacterium
MNLFDVTNAVNQSFKDYNDGKTRVDIKREDLLHELVSGNKLRKLKYNILEAQRQGHNTLLTYGGAFSNHIAATAAAGNICGFKTIGVIRGEELGHNLEKTLGGNKTLSTAHALGMQFKFVSRSNYREKYDDKFQKVLNAEYGHVYHIPEGGTNHLAVKGTEEILTVKDKDYYDYICVAAGTGGTAAGIINSTAPHQKVLVFSALKGDFMFDEIARYTHRENFMVFDENRFGGYARSSDGLIKFMNGRFRESVTSENPKGIPLEPIYTGKMMYRLEHLVKTGVISGETRILAIHTGGLQSVTGYNAMLEKKGKITLDYINEI

SEQ ID NO: 11281 - protein, 347 aa, Psophocarpus tetragonolobus
GGELFDRIVQKGHYSERQAATLIKTIVEVVEACHSLGVMHRDLKPENFLFDTLHEDAKLKATDFGLSVFYKPGESFCDVVGSPYYVAPEVLRKLYGPESDVWSAGVILYILLSGVPPFWAETEPGIFRQILLGKIDFQSEPWHSISDSAKDLIRRMLDQNPKTRLTAHEVLRHPWIVDDNLAPDKPLDSAVLSRLKQFSAMNKLKKMALRVIAERLSEEEIGGLKELFKMIDTDNSGTITFDELKDGLKRVGSELMESEIKDLMDAADIDKSGTIDYGEFIAATVHLNKLEREENLVSAFSYFDKDGSGYITLDEIQQACKDFGLDDVHIDDMIKEIDQDNDGQIDY

SEQ ID NO: 11282 - protein, 245 aa, Witheringia solanacea
  misc_feature (160)..(160): Xaa can be any naturally occurring amino acid
GTIVCGKGMNLIFVGTEVGPWSKTGGLGDVLGGLPPALAARGHRVMTISPRYDQYKDSWDTSITVEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANXWHTALIPCYLKSMYQSRGIYVNAKVAFCIHNMAYQGRFAFSDFSLLNLPDEYRSSFDFIDGCEKPVKGRKINWMKAGILESHRVV

SEQ ID NO: 11283 - protein, 78 aa, Marchantia polymorpha
MEKQKLIDMEGVVIESLPNATFRVYLDNGCIVLTHISGKIRRNYIRILPGDRVKVELSPYDLTKGRITYRLRAKSSNN

SEQ ID NO: 11284 - protein, 437 aa, Treponema denticola
MKEIDDFFKRNNFDYKIDIEYAASILLEDMKKGLESEAESVSSMDMIPLWKNLPTDIPKDKKVIIIDAGGTNFRAGIVYFDKKGVPEILSFFKHPMPALDREMTNEEFFDSIAEYLEPLKDESDMISFCFSYAIKIFPDGGGQAIKLSKEIKLPYIGDCKINEGLFQALSRKGWKKIKKIIMVNDTAAVLQSGIFSETDDQGFDSHIGFVLGTGLNSAYIEYGKIEKLKTTEFYDKPQIIVCESGKSNKIPQSKFDKILSENSNLKNEYFLERMCSGRYLGELCSIALRAGSAEGIFSPRVNKMLLNSCDFSTEEISLFLKEQNHDKNIFSGIIEAHSVSEDYVKIYSICKCFFERAGRLSAAVIAAACIKTGKGKSPDKPICISADGSMFLKGFLIKERIFKSLHTCLTEKRGIYFVLKTNDEAVTLGTALAAFLN

SEQ ID NO: 11285 - protein, 592 aa, Cryptococcus neoformans
MCGIFCCFNRAGDISQYRARAIACSKRQRHRGPDWSGCYMTNNTVLVHERLAIVGVDTGAQPLTNEDESLVLAVNGEIYNHVALRKSLKNKDAVFKTHSDCEVIMHLYKEHDTGLCNMLDGMFSFVLVDKSVSPPRLIAARDPIGITTLYMGWNSQSPDTLYFASELKCIHEECDNLQAFPPGHFYDSKEKKLTRYFNPSWWDSDKGVVPHNDIDYKLLRETLEAAVKKRLMSEVPYGVLLSGGLDSSLIASIAARETDKLAEEQEKLRQERKQAIASGKWVGDEQPLASWPQLHSFAIGLPGAPDLIAARKAADFLGTIHHEYNFTVQEGLDAIPEVIHHLETYDVTTVRASTPMYLLSRKIKAMGVKMVLSGEGSDEIFGGYLYFHAAPTAKDFHEECVKRVKNLHTADCLRANKSTMAWGLEARVPFLDKTFLEVSMNVDAKYKMFSKGTHQEVDEDGRPKMEKYILRKAFDCSPEGKAYLPDSILWRQKEQFSDGVGYSWIDGMKDHAAAIVSDEKFANRATRWPLDTPDTKEAYWIREIFEHHFPTEAAAKTAVRWVPKQEWGVSSDPSGRAVSIHTAAYADGEAKA

SEQ ID NO: 11286 - protein, 153 aa, Oryza sativa
MAPKAEKKPAAKKPAEEEPAAEKAEKALAGKKPKAEKRLPAGKAEKGSGEGRKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 11287 - protein, 335 aa, Mycobacterium tuberculosis
MTAPPVHDRAHHPVRDVIVIGSGPAGYTAALYAARAQLAPLVFEGTSFGGALMTTTDVENYPGFRNGITGPELMDEMREQALRFGADLRMEDVESVSLHGPLKSVVTADGQTHRARAVILAMGARARYLQVPGEQELLGRGVSSCATCDGFFFRDQDIAVIGGGDSAMEEATFLTRFARSVTLVHRRDEFRASKIMLDRARNNDKIRFLTNHTVCAVDGDTTVTGLRYRDTNTGAETTLPVTGVFVAIGHEPRSGLVREAIDVDPDGYVLVQGRTTSTSLPGVFAAGDLVDRTYRQAVTAAGSGCAAAIDAERWLAEHAATGEADSTDALIGAQR

SEQ ID NO: 11288 - protein, 177 aa, Staphylococcus aureus
MTKEYATLAGGCFWCMVKPFTSYPGIKSVVSGYSGGHVDNPTYEQVCTNKTGHVEAVQITFDPEVTSFENILDIYFKTFDPTDDQGQFFDRGESYQPVIFYHDEHQKKAAEFKKQQLNEQGIFKKPVITPIKPYKNFYPAEDYHQDYYKKNPVHYYQYQRGSGRKAFIESHWGNQNA

SEQ ID NO: 11289 - protein, 478 aa, Escherichia coli
MTRIKINARRIFSLLIPFFFFTSVHAEQTAAPATPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 11290 - protein, 172 aa, Glycine max
EDLPRSNVLYGYRIDGPGDRGKGHRFDSSIVLVDPYAKLVEGRRYFGDISLKLSKFLGTYDFDSLPFDWGENYKLPNISEKDLVIYEMNVRAFTSDESSGLDSNIRGSYLGVIEKIPHLLELGINAVELLPVFEFDELEKLTGFVICYDLICDLFDFLLCFILKTCPRVILV

SEQ ID NO: 11291 - protein, 736 aa, Solanum lycopersicum
MDCNCFDPLLPADELLMKYQYISDFFIAVAYFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSEEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 11292 - protein, 482 aa, Neisseria meningitidis
MNGDIGVIGLAVMGQNLILNMNDCGFKVVAYNRTTAKVDEFLNGAAKGTNIIGAYSLQDLVDKLEKPRKIMMMVRAGSVVDEFIEQLLPLLEEGDILIDGGNANYPDTTRRTHYLAEKGILFVGAGVSGGEEGARRGPSIMPGGDKRAWDAVKPIFQAIAAKTSQGEPCCDWVGKDGAGHFVKMVHNGIEYGDMQLICEAYQFMKDGLGLSYDEMYRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQALLASKIISYAQGFMLIREAGESYGWDLDYGNTALLWREGCIIRSAFLSNIRDAYENNPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 11293 - protein, 107 aa, Oryza sativa
SCAGADRLQTGMRGAFGKPTGLVARVSIDQVLMSIRTKENAKEHAIEALRRCKFKFSGQQKIVVSKHWGFTNFTKEQYQQLRSEDKIVPDGAHVKPYTLHGPLVKKW

SEQ ID NO: 11294 - protein, 466 aa, Triticum aestivum
  misc_feature (15)..(15): Xaa can be any naturally occurring amino acid
  misc_feature (35)..(35): Xaa can be any naturally occurring amino acid
  misc_feature (63)..(63): Xaa can be any naturally occurring amino acid
  misc_feature (192)..(192): Xaa can be any naturally occurring amino acid
ESPHLTNIASVVHPXGEVDVEDVPKPARLARIVPXPGLDEFKTRAIAERGKDASSQTGHVIHXRRGPSGQLYNYASAAKGAKVLDFNKEAKGASNILDKDKDKYLRNPCSVQGKYVIIELSEETLVDTIAIANFEHYSSNLKEFEMLSSLIYPTENWETLGRFTVANAKHAQSFTFPEPKWARYLKFNLLSXRGRGRGCTLSMLEVYGMDAVEKMLENLIPVESKNAESDDKSKEPIEQPPLKEPSGGKDSSQEPLDEDEFEVEDDKPNGDSSRNGVHDQIVETRTLQAGRIPGDTVLKILMQKVQSLDVSFSVLERYLPGRPRRYGQIFKDFDSDIDSKDALLEKIKLELKELQSSKNDFARDIESILSWKSVASSQLDQLVLDNVILRSEYERFRDKQVDLENRSFVVIFLCFIFGCLAIAKLSIGMIFNICRLYDCEKLDRVKSGWLVLLLSSCIVASILVIQ

SEQ ID NO: 11295 - protein, 754 aa, Solanum lycopersicum
MMKKVVSWLLFLSIVASLWVVDGYIECPCDDSDAFFSMETMLFVQKAGDLGIAVAYFSIPIEIIYFVSCSSFPFKWVLFQFGAFIVLCGLTHFLTFLTHFGKYTFHLILALIVCKLLTALVSMLTAITLMNLIPLLLKAKAREFMLRRKNRELDREVEKIKQLEELGLHVRMLTNEIRKSIDRHTILYTTLVGLSKLLSLQNCVIWMPNENRTEMKLTHDTTRENVSSVYNVPIPISDREVKEIKGSDDVKILGADSRLAAASSRGSCEPESVAAIRIPMLTVSNFRGETREIVSQCYAILVLVQPCGHGRFWLNQEVEIVRAAADQVAVALSHAAVVEESEYIKDRLMEQNQALQKAREEALRASQARSSFQTVMSHRLRRPMHSILGLLSMLQEQKLRDEQQLLVHSIIKSSNVVSTLMDDVIVTSTKENVKFPLEMKHFQLHSLIREAACTAKSLCMYKGYNITIEVEKSFPNKVMGDERRFFQVLLHIIGNLLNGIHGGHLTFKVLSASENDVSWKTPRSNSSNDIVYIKFEICTKFNRSQSEITPAPPTYDTEEIEESLSFAVCRKLVHLMQGDIFIIRNLADFDQGMAVIVGFQRQPLIPLGMSEYVESSNPTYPHPVLRGVEVLLADYDDSNRAVTKKMLEKLGCIVTLVSSGYECLGAVGPVVSSLQIILLDLHLPDLDGFEVTMRLRKHRRQTWPLIIGLAAITDEDIRKCLKIGMNGIICKPLLLSGLADELQKVLLHANRGMP

SEQ ID NO: 11296 - protein, 445 aa, Porphyromonas gingivalis
MERIRLDLSKTGSSVASYGETAEKFNALLDNGTGRGSDFLGWVHLPSSITEEELNAVEAAATILRERCDYVINVGIGGSYLGARAVIEALQNSFEAYRSDRENPVILYAGNNIGEDYLSELLQFLRDKRFGIIYISKSGTTTEPAIAFRLLKGLLESQVGREDARERIVAVTDSAKGALRRMADEEGYRSFVIPDNVGGRFSVLTPVGLLPVAVAGFDIRQLVRGAADMQAMTASDIPFSDNPALRYAAARNALYAEGKKIEILANFHPKMHYIGEWWKQLFGESEGKEEKGIFTATVDLTTDLHSMGQWMQEGERTIFETVISVENQDTCLTIPSDSADLDGLNFLAGKRVDEVNKMAELGTRLAHVDGGVPNIRIILPQLDAYYIGQLFYFFEKAVGVSGYMLGVNPFDQPGVEGYKNNMFALLNKPGYETESAAMAGRLKEC

SEQ ID NO: 11297 - protein, 316 aa, Glycine max
MGRASRDKRDIYYRKAKEEGWRARSAFKLLQIDEEFNLFDGVKRVVDLCAAPGSWSQVLSRKLYLPAKLAPDAKDENLPLIVAIDLQPMAPIEGVIQVQGDITNARTAEVVIRHFDGCKADLVVCDGAPDVTGLHDMDEFVQSQLLLAGLTIVTHVLKEGGKFIAKIFRGKDTSLLYCQLKLFFPVVTFAKPKSSRNSSIEAFAVCENYSPPEGFNPKDLHRLLEKVGSPSGVDDTDCCSGWLEGPNKVYIPFLACGDLSGYDSDRSYPLPKVAGGTYQSLDPVQPPIAPPYKRALELKKASSQGFRELENLSLDS

SEQ ID NO: 11298 - protein, 334 aa, Porphyromonas gingivalis
MGGIGRIGILGSGSWATALAKIILTSQPSINWFMRREEQAQGIKRTGRNPNYLRDAVFDPRKISFFTDSDLNSFFRASDVVVLVTPSPFIKSYLKRVRSSSMRDKLIINAIKGIVPDENVLVSEYLHDFCDVPNELIGVVSGPCHAEEVARERRSYLTVGCFDINKAKAMANVLRNDYVSCTTSQDVVGIEYASVLKNVYAIAAGICNGLQYGDNFQSVLMSNAIAEMNSFVNTVHLLEREITDSVYLGDLLVTAYSNYSRNRTFGNMIGKGYSVKSAQMEMEMIAEGYYGAKCVREVNKRYQVNMPIMNTVYEVLYEKRDAAEAITALTAHFK

SEQ ID NO: 11299 - protein, 373 aa, Rubrobacter xylanophilus
MQTKDLYKVLGVDRGASQEEIRRAYRKLARRYHPDANPGDKEAEERFKEIQHAYEILSDPQKRREYDEGPRTFFEGARQGTGGFRPGGFSDLSDLFEGFGGLGDIFGRAGRRGDAGPRRGEDVTVSVNLRFKDALEGVTTRVSVPVEAVCEACRGTGAAPGTVPRRCPRCDGRGMRSRDQGLFAFSEPCSACGGRGTVIDSPCSACGGGGRVRMNRRVTVRVPPGARDGMKIRVPGRGSAGRDGGPPGDLYVVTRVEEHPVFKRRGDDFVVEVPVSFVEAALGAEIEVPRPEGGRLRLRLPAGTQEGRQFRVRGAGAPKARSRSGERGDLIVRAHVVVPQKLRRREREILEAFAEERGEDVREELFKRAGSWT

SEQ ID NO: 11300 - protein, 221 aa, Pseudomonas fluorescens
MVLRSEILVNKNVLPTKEQALPGRETPMALPEKHFVFTETPLLGPFFQDVDFAIFGLGCFWGAERRFWQREGVVSTVVGYAGGFTPNPTYEEVCSGLTGHAEVVLVVFDKAKVSYEELLAMFWELHNPTQGMRQGNDIGTQYRSVIYATHPEQLDAALKSKAVYQAELSKAGLGEISTEIEQAPTVYFAETYHQQYLAKNPEGYCGIGGTGVCMPPSLAGN

SEQ ID NO: 11301 - protein, 250 aa, Larnax sachapapa
SGIIVCGKGMNLLFVGTEVGPWSKTGGLGDVLGGLPPALAARGHRVMTISPRYDQYKDAWDTSVTVEVKVGDSIEIVRFFHCYKRGVDRVFVDHPMFLEKVWGKTASKIYGPKAGQDYLDNELRFSLLCQAALEAPRLLNLNCSKYFSGPYGDDVLFIANDWHTALIPCYLKSMYQSRGIYMNAKVAFCIHNIAYQGRFAFSDFSLLNLPDEYRSSFDFIDGYEKPVKGRKINWMKAGILESHRVVTVSP

SEQ ID NO: 11302 - protein, 506 aa, Ralstonia eutropha
MSSHSHPHPHQHPVVEHDDLQRKLKARHLTMIAIGGAVGTGLFVASGASIAQAGPGGALLMYALLGFMVYCLMTSLGELAVHMPVAGSFVTYSALYVEEGFGFALGWNYWFSLAVTIAVELTAAQLVMQFWFPGMPGMVWSAGFLLLMFALNAFSVRGFGEAEYWFALIKVITVIVFLGVGLLMIFGIMKGGPQSGWHNFTTGDAPFVGGIPAMIGVAMIAGFSFQGTETVGVAAGEAQDPARTIPRAIRQTFWRILLFYVIAILIIGVLIPYTDPNLLRNDVTDVGVSPFALVFRQAGLAFAAGLMNAVVLTALLSAGTSSMYVSTRILYGLAVSGRAPRWLGKLTVNGVPFNALLVTTAVGALCFFSSLFGDKAVYLWLLNTSAMTGFFAWFGIALSHYRFRRGLVYQGYDINALAYRSPLYPFGPIFAGVLCLVIVAGQNYQAFADIPNRWPEIIATYIGVPVFLALWLGYRIVRKTRLIDYEDMPFELPKTAKVIAGQAAQV

SEQ ID NO: 11303 - protein, 511 aa, Glycine max
  misc_feature (484)..(484): Xaa can be any naturally occurring amino acid
  misc_feature (492)..(492): Xaa can be any naturally occurring amino acid
MAQPTTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGMGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQPVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQXKKLDYCIXANQDFPNKCNIFCSDCMLS

SEQ ID NO: 11304 - protein, 346 aa, Unknown
  Candidatus Desulfococcus oleovorans Hxd3
MSSGQTDLRVAVVGAGSWGTAIAHLLASKGLFPLLWAYEPELCEQIEKGRENTIYLPGIQLAEGISVSNDLGAVVADRDIVVMVVPSHLTRDVAARAADHLDGRTIVVTASKGIENKTHLTMTGVLSEVLPNTPAEKIAVLSGPSFAREVAANLPTVVAVASTSTETALFLQQVFAAPLFRVYTNDDPVGVELGGAVKNVIAIASGVCDGLGLGLSARAAMITRGLAEMRRLGMALGANPHTFSGLAGIGDLILTCTGSLSRNYTVGKKLGEGMTIDEILASMRMVAEGVKTAKSVFNLSNKRNVEMPICHEVYRILYEGLAPGDAVLRLMTRTLKHEIDDEVTAY

SEQ ID NO: 11305 - protein, 161 aa, Lycium brevipes
VDRVFVDHPMFLEKVWGKTASKIYGPKVGQDYVDNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVT

SEQ ID NO: 11306 - protein, 344 aa, Lycium californicum
EIKVGDSIETVRFFHCYKRGVDRVFVDHPMFLEKVWGKTASKIYGPKVGQDWVDNELRFSFLCQAALEAPRVLNLNCSKYFSGPYGEDVLFIANDWHTALIPCYLKSMYHSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSSITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSR

SEQ ID NO: 11307 - protein, 848 aa, Pseudomonas synxantha
  misc_feature (233)..(233): Xaa can be any naturally occurring amino acid
  misc_feature (240)..(240): Xaa can be any naturally occurring amino acid
MLNPPPTGNSSRLLQRTGNDATRYLLPVFGRHRNFAGDVIPDEADRLLGWVEVELSHNGMLLRGYRSMFASLLLIAIGLMFTAALALRISRTINSPIGQIKQAVAQLKDGNLETRLPPLGSQELDQLASGINRMAETLQNAQEEMQHSIDQATEEVRQNLETIEIQNIELDLARKEALEASRIKSEFLANMSHEIRTPLNGILGFTHLLQKSELSPRQLDYLGTIEKSADNLXGIINEIXDFSKIEAGKLVLDSVPFNLRDLLQDTLTIFAPAAHAKQLELVSLVYRDTPLALVGDPLRLKQILTNLISNAIKFTREGTSSPGDGRDEQEDSVQLRISVQDTGIGLSNQDVRALFQAFSQADNSLSRQPGGTGLGLVISKRLIEQMGGEIGVDSTPGEGSEFWISLNLPKTRDDVEDLPAPPLLGRRVAVLENHELARQALQHQLEDCGLEVTPFNTLESLTNGITSAHQTEQAISLAVLGVTANDIPPERLNQHLWDLEHLGCKVLVLCPTTEQMLFNQSVPNPNSQLQAKPACTRKLRRSLADLISPRPSRSEPGEPLSSRAPRVLCVDDNPANLLLVQTLLEDMGAKVQAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERVNDGLAQGVQLLVLDHEEGLRLAANKADLAADMLAMLLASLEADRLAITVAREANDNHALIERVHRLHGATRYCGVPQLRAACQRAETLLKQDDAKAMAALDELDMAIARLASVSQSQRLTQFYGQHQSKCGGKPPPTFSQHFHRVNCREPS

SEQ ID NO: 11308 - protein, 164 aa, Lycium californicum
RGVDRVFVDHPMFLEKVWGKTASKIYGPKVGQDWVDNELRFSFLCQAALEAPRVLNLNCSKYFSGPYGEDVLFIANDWHTALIPCYLKSMYHSKGIYLNAKVAFCIHNIAYQGRFPFSDFSLLNLPDEYRSSFDFIDGYEKPIMGRKINWMKAGILESHRVVTV

SEQ ID NO: 11309 - protein, 180 aa, Silicibacter pomeroyi
MTDRAYVIDEMISAKAIAARIEALCREIQTEFADTDKLVVVGLLRGSFVFIADLVRELNLPIEVDFLEASSYGDAMESSREVRILKDLRSPIEGRDVLVVEDIVDTGHTLNHVTHLLLSRMPKRLKSIALLDKPSRREVDFRADWIGFEIPDEFVVGYGIDFAQRNRNLPFIGKVRFTEA

SEQ ID NO: 11310 - protein, 181 aa, Pyrococcus abyssi
MALRPAKIDRYVDKPAYTRREYIRGAPGPKITIFDMGNPAGDFEFEVALHVSQPVQIRQNALEAARQQVNRYLQKNVGRSNYHFKIRVYPFQVLRENPMATGRKADRYGNGMRRPFGKPIGLAARLKKDQKVLSIRVNRQHLKFAIEGARRAAMKFPVKCYYRIYDKEGNDVTTKILSQGL

SEQ ID NO: 11311 - protein, 334 aa, Rickettsiella grylli
MKKHRSLKSSDDCSPIAIIGAGAWGSALAIHLARNDQKVRLWAYEKQQITEINTRRTNERYLPDVLFPSNITCSDDYQTIFSGVQDVLIAVPSIAFRDTLRKIQPYLHVNQRLLWASKGLDSEKHQLLNETAKEILEDINMAVLSGPSFAKEVAKGLPTAVCIASENYDFAHDLLLRFQTKNFRVELTQDIIGVELGGAMKNILAIAVGITEGLGFGANAKAAVMTAGLSEMLELGLILGAKQETFLGLSGLGDLVLTCTDNQSRNRRLGLALGAGQSIEEAKKLIGTTEGYETAKNIFFLIKKYRMKTLFCEGVYQILYEKKQPKTLFKNYFS

SEQ ID NO: 11312 - protein, 371 aa, Candida albicans
MTTSPYPIETPFKVCIVGSGNWGTAVAKLVAENCAEKPNIFQRDVKMWVFEEEIEGRKLTEIINTEHENVKYLPEIKLPTNLVANPDIVDTVQDADLIVFNIPHQFLGRIVKQIEGKVKPTARAISCLKGLDVSPEGCKLLSTSITDTLKIYCGVLSGANIANEVAKGNWSETSIAYTVPEDFRGAGKDIDPFILKEAFHRPYFHVRVIEDVVGASIAGALKNVIACSVGFVEGAGWGDNAKAAIMRIGIKETIRFASYWELFKIKALSPPNPKTFTEESAGVADLITTCSGGRNVKVARYMIKNNVDAFEAEKIVLKGQSSQGILTAKEVHELLTNFNLQDEFPLLEATYKVIYENGSVDDFPQLLEGDQ

SEQ ID NO: 11313 - protein, 640 aa, Pseudomonas fluorescens
MSAFNTTLPSLDYDDDTLREHLQGADIPTLLLTVAHLTGDLQILKPNWKPSIAMGVARSGMDLETEAQVREFCLQRLIDFRDSGQPAPGRPTSDQLHILGTWLMGPVIEPYLPLIAEEAVTAEEDLRAPRWHKDHVASGRDFKVVIIGAGESGMIAALRFKQAGVPFVIYEKGNDVGGTWRENTYPGCRVDINSFWYSFSFARGIWDDCFAPAPQVFAYMQAVAREHGLYEHIRFNTEVSDAHWDESTQRWQLLYRDSEGQTQVDSNVVVFAVGQLNRPMIPAIPGIETFKGPMFHSAQWDHDVDWSGKRVGVIGTGASATQFIPQLAQTAAELKVFARTTNWLLPTPDLHEKISDSCKWLLAHVPHYSLWYRVAMAMPQSVGFLEDVMVDVGYPPTELAVSARNDRLRQDISAWMEPQFADRPDLREVLIPDSPVGGKRIVRDNGTWISTLKRDNVSMIRQPIEVITPKGICCVDGTEHEFDLIVYGTGFHASKFLMPINVTGRDGVALHDVWKGDDARAYLGMTVPQFPNMFCMYGPNTGLVVYSTVIQFSEMTASYIVDAVRLLLEGGHQSMEVKTPVFESYNQRVDEGNALRAWGFSKVNSWYKNSKGRVTQNFPFTAVEFWQRTHSVEPTDYQLG

SEQ ID NO: 11314 - protein, 138 aa, Brassica napus
  misc_feature (18)..(18): Xaa can be any naturally occurring amino acid
  misc_feature (39)..(40): Xaa can be any naturally occurring amino acid
  misc_feature (46)..(47): Xaa can be any naturally occurring amino acid
  misc_feature (61)..(62): Xaa can be any naturally occurring amino acid
  misc_feature (69)..(69): Xaa can be any naturally occurring amino acid
  misc_feature (76)..(76): Xaa can be any naturally occurring amino acid
  misc_feature (83)..(85): Xaa can be any naturally occurring amino acid
  misc_feature (87)..(87): Xaa can be any naturally occurring amino acid
  misc_feature (89)..(90): Xaa can be any naturally occurring amino acid
  misc_feature (93)..(93): Xaa can be any naturally occurring amino acid
  misc_feature (99)..(102): Xaa can be any naturally occurring amino acid
  misc_feature (104)..(104): Xaa can be any naturally occurring amino acid
  misc_feature (106)..(107): Xaa can be any naturally occurring amino acid
  misc_feature (110)..(110): Xaa can be any naturally occurring amino acid
  misc_feature (116)..(117): Xaa can be any naturally occurring amino acid
  misc_feature (119)..(121): Xaa can be any naturally occurring amino acid
  misc_feature (124)..(124): Xaa can be any naturally occurring amino acid
MASSMLSSAAVATSPAQXTMGAPFTGLKSSAAFPVTRKXXTDITSXXSNGGKVNCLKGGPXXEKKIENXFFFLTYXGELAQKXXXLXPXXKGXPWGEFXXXXRXFXXREXGNTPGXXKXXXWKXGKFGPGGPPPFFFP

SEQ ID NO: 11315 - protein, 750 aa, Pseudomonas amyloderamosa
AINSMSLGASYDAQQANITFRVYSSQATRIVLYLYSAGYGVQESATYTLSPAGSGVWAVTVPVSSIKAAGITGAVYYGYRAWGPNWPYASNWGKGSQAGFVSDVDANGDRFNPNKLLLDPYAQEVSQDPLNPSNQNGNVFASGASYRTTDSGIYAPKGVVLVPSTQSTGTKPTRAQKDDVIYEVHVRGFTEQDTSIPAQYRGTYYGAGLKASYLASLGVTAVEFLPVQETQNDANDVVPNSDANQNYWGYMTENYFSPDRRYAYNKAAGGPTAEFQAMVQAFHNAGIKVYMDVVYNHTAEGGTWTSSDPTTATIYSWRGLDNATYYELTSGNQYFYDNTGIGANFNTYNTVAQNLIVDSLAYWANTMGVDGFRFDLASVLGNSCLNGAYTASAPNCPNGGYNFDAADSNVAINRILREFTVRPAAGGSGLDLFAEPWAIGGNSYQLGGFPQGWSEWNGLFRDSLRQAQNELGSMTIYVTQDANDFSGSSNLFQSSGRSPWNSINFIDVHDGMTLKDVYSCNGANNSQAWPYGPSDGGTSTNYSWDQGMSAGTGAAVDQRRAARTGMAFEMLSAGTPLMQGGDEYLRTLQCNNNAYNLDSSANWLTYSWTTDQSNFYTFAQRLIAFRKAHPALRPSSWYSGSQLTWYQPSGAVADSNYWNNTSNYAIAYAINGPSLGDSNSIYVAYNGWSSSVTFTLPAPPSGTQWYRVTDTCDWNDGASTFVAPGSETLIGGAGTTYGQCGQSLLLLISK

SEQ ID NO: 11316 - protein, 284 aa, Unknown
  Synechococcus sp. PCC 6716
MSYPLHLFWHRRDLRLADNLGLYAARQHTPTVVGVFCFDPALLQGQDVAAVRVAYLLGCLQALKEAYQQRGGCLLMVQGDPRQVIPEVATTLKATAVHWHEDVEPYARERDRVVAATLNDLGIAVHRQWDQLLHPPSAVQTQQGQPYTVYTPFWRNWSALPKAAPVPPPPDFAPLEATEIASIPLPSTHDLGFDWSGELILAPGEAAAAQQLAHFSQHAIYEYGEQRNYPGRPGTALLSPALKFGVIGIRTVWAASEAALEHARSDEARASIRTWQQELAWREF

SEQ ID NO: 11317 - protein, 42 aa, Glycine max
LKSNDPVGFNIDDVLASGFIGHVVAYYILSNTSNGYDPAFFG

SEQ ID NO: 11318 - protein, 292 aa, Caulobacter crescentus
MARTLSVAAIQTSYGMDLQANIKKTEGFIREAASKGAQVILPSELFQGPYFCVAQEERWFAQAHPWREHPVVKAIAPLAGELGVVIPISIFEREGPHYFNSLVMADADGSLMGVYRKSHIPDGPGYMEKYYFRPGDTGFKVWDTRFGRIGVGICWDQWYPECARAMALMGAEALFYPTAIGSEPHDASLDTALPWRRAMQGHAVSNVIPVIGANRIGFEPWDGYPNGGQTFYGSSFVADHRGDLVSELGRADEGLVSATFDLDFLTTHRAAWGFFRDRRPELYTALSSGRPA

SEQ ID NO: 11319 - protein, 212 aa, Vibrio parahaemolyticus
MLNKQTLISIEDALPGREQPMQIEDCHFVNQSSLTAPLAHHQQQILLGMGCFWGAERLFWQLDGVVSTSVGYAGGFTPNPTYEEVCTGKTGHTEVVRVVFDERVISLAQLLAVFWEKHDPTQGMRQGNDLGTQYRSAIYTYSQDQQEIADKSKLQYQQALEAELRSTITTEIVPAGPYYFAETYHQQYLAKNPDGYCGIGGTGVCFPPSLQG

SEQ ID NO: 11320 - protein, 216 aa, Triticum aestivum
MATLVKHLILCSSTTTLSSASPSPSNRRPPSSPDGVDKRAHLTQSSTRRLAVAASTAMVATAALSARRPAAPPPAMAAEAAAVRAPAPPGTVPRWGTRSYVRERFFEPRLTTEEAAARIRQTAEGMRTLRPMLETMSWKYVLFYVRLKSKYLDLDLTTAMAGVPEPRRPEYVLVANELVDNMTEFDRFVRTPKVYESYLYYEKTLKSLDDVAEFLG

SEQ ID NO: 11321 - protein, 326 aa, Leptospira interrogans
MSKTVKVAVTGAAGQIGYSLLFRIASGQMFGADTAVEIQMLELEAAIPAAKGVIMELEDCAFPLLQKVTVSSDLDTAFKEINWALLVGSVPRKAGMERGDLLKINGGIFVNQGKAIEKNAASDVRILVVGNPCNTNCLIAMNNAKGISQDRWFAMTKLDENRAKSQLASKAGVPVKEVTHLGIWGNHSATQYPDFYNTKISGKPVTDVISDHEWLKGDFIKNVQQRGAEIIKARGASSAASAANGVVDTVRGIITPTAPGDCFSAAVVSDGSYGAEKGLIFGFPLKSDGKKVEIIQGISLNDFAKEKFKITHEELVSERNEVKEML

SEQ ID NO: 11322 - protein, 384 aa, Candida albicans
MSKVPAIYQLGHLPIKDHVFSPDRSILAITKGNDVEVYQISPSNLSSKPQLIAVLKDHDKTVTSVDISPDGSKILTCSQDRNALVWEYANGEYKPTLVLLRINRAATVCRWSPDGSKFAVGSSDRIIAVCYYEEENDWWVSKHLKKPLKSTITTIDWHPNGVLLACGSTDGHVRVFSGYIKGIDAKPDPSVWGTKLPFQTLCGDYTNETNAWIHGVKFSPDGNALAYVSHDSSVGFVYPQGEGLPPRAIFNVKTDNLPFKSVVWLNDQQVCAGGFTCNLVVFQGDEHGWQQAYQVEEQKDLTKEVPHSKLGEGDDDDEEISSHQALNMFKQMDLKGRVSKPSAGGKPAKALNTIHQNTINSIRNFDQGRVSTSGIDGKVVIFNV

SEQ ID NO: 11323 - protein, 850 aa, Brassica oleracea
MQGVRYIYHHSYTLLVFVVMILFRPALSIYVNTLSSTEYLTISNNKTLVSPGDVFELGFFKTTSSSRWYLGIWYKTLSDRTYVWIANRDNPISNSTGTLKISGNNLVLLGDSNKPVWSTNLTRRSERSPVVAELLANGNFVMRDSNNNDASQFLWQSFDYPTDTLLPDMKLGYDLKTGLDRFLTSWRSLDDPSSGNFSYRLETRKFPEFYLRSGIFRVHRSGPWNGIRFSGIPDDQKLSYMVYNFTDNSEEVAYTFRMTNNSIYSRLTVSFLGHFERQTWNPSLGMWNAFWSFILDSQCDIYKMCGPYAYCDVNTSPICNCIQGFNPSDVEQWDRRSWAGGCIRRTRLSCSGDGFTRMKNMKLPETTMAIVDRSIGVKECEKKCLSDCNCTAFSNADIRNGGMGCVIWTGRLDDMRNYAADGQDLYFRLAAVDLVKKRNANWKIISLTVGVTVLLLLIMFCLWKRKQKRAKANATSIVNRQRNQNLPMNGMVLSSKTEFSEENKIEELELPLIDLETVVKATENFSNCNKLGQGGFGIVYKGRLLDGKEIAVKRLSKTSVQGTDEFMNEVTLIARLQHINLVQIIGCCIEADEKMLIYEYLENLSLDSFLFGKTRRSKLNWKERFDITNGVARGLLYLHQDSRFRIIHRDLKVSNILLDKNMIPKISDFGMARMFAREETEASTMKVVGTYGYMSPEYAMHGIFSEKSDVFSFGVIVLEIVTGKRNSGFNNLNYEDHLLNYAWSHWKEGKALEIVDPVTVDSLPSTFQKQEVLKCIQIGLLCVQELAENRPTMSSVVWMLGSEATEIPQPKPPGYCIRRSPYELDPSSSRQYDNDEWTVNQYTCSFIDAR

SEQ ID NO: 11324 - protein, 176 aa, Chromobacterium violaceum
MEKAILGGGCFWCLEAAFSQLKGVERVVSGYCGGHTDSPDYRQVCSGDSGHVEVVEISYDPALIDYATLLQVFFAVHDPTTLNRQGHDVGTQYASAIFYLDETQRECARRVIAQLDAEQIFDAPIVTRVESAPRFHPAEDYHQNYYAQNQQQNYCQLVISPKLAKIRRRFSHLLQN

SEQ ID NO: 11325 - protein, 112 aa, Arabidopsis thaliana
MASFTASASTVSAARPALLLKPTVAISAPVLGLPPMGKKKGGVRCSMETKQGNVSVMGAGVSAAATAALTAVMSNPAMALVDERMSTEGTGLPFGLSNNLLGWILFGVFGLI

SEQ ID NO: 11326 - protein, 436 aa, Thermoplasma acidophilum
MSGKADPLEIAKEAKPSQANNEVEEDPFEIALKQLRKAAKVLNLDEQALEILSSPQKILQVSLPVKMDDGKVKVFTGFRVRHNIARGPAKGGIRFHPQETLSTVKALSMWMTWKCAIADIPYGGAKGGIICDPSTMSQGELERLSRAYIRAIADFIGPDVDVPAPDVNTNPQIMAWMLDEYENIVRHNAPNVITGKPLEVGGSLGRFDSTGKGGMFVLREGAKKIGLDLSKARVAVQGFGNVGQFAVKFVEEMFGAKVVAVSDIKGGIYSENGFKFDDLLAWSKKIGSVVGFPGSKPITNEELLESDVDVLIPAAIEEQITARNADKIKAKIILELANGPTTPEADEILYKKGKLVLPDVLSNSGGVIVSYFEWVQNNYGEYWSTEEVTNKLDVKITKAARQVLETMDKYHVDPRTAAYVIAVKKVADAMKVRGWY

SEQ ID NO: 11327 - protein, 581 aa, Zea mays
MCGILAVLGCGDESQGKRVHVLELSRRLKHRGPDWSGLHQVADNYLCHQRLAIIDPASGDQPLYNEDKSIAVAVNGEVYNHEELRARLSGHRFRTGSDCEVIAHLYEEYGESFIDMLDGVFSFVLLDARDNSFIAARDAIGVTPLYIGWGIDGSVWISSEMKGLNDDCEHFEIFPPGNLYSSKEKSFKRWYNPPWFSEVIPSVPYDPLRLRSAFEKAVIKRLMTDVPFGVLLSGGLDSSLVAAVAARHFAGTKAAKRWGTRLHSFCVGLEGSPDLKAAKEVADHLGTVHHEFNFTVQDGIDAIEDVIYHIETYDVTTIRASTLMFQMSRKIKALGVKMVISGEGADEIFGGYLYFHKAPNKEEFHQETCRKIKALHQYDCLRANKATSAWGLEVRVPFLDKEFINEAMSIDPEWKMIRPDLGRIEKWILRKAFDDEERPFLPKHILYRQKEQFSDGVGYSWIDGLKDHAASNVSDKMMSNAKFIYPHNTPTTKEAYYYRMIFERYFPQSSAILTVPGGPSVACSTAKAIEWDAQWSGNLDPSGRAALGVHLSAYEQDTVAVGGSNKPGVMNTVVPGVAIET

SEQ ID NO: 11328 - protein, 588 aa, Oryza sativa
MEETPLPSGKNFRSQLAAAARSINWTYAIFWSISTSRPGVLTWKDGFYNGEIKTRKITNSMNLTADELVLQRSEQLRELYDSLLSGECGHRARRPVAALLPEDLADTEWYYVVCMTYAFGPRQGLPGKSFASNEFVWLTNAQSADRKLFHRALIAKSASIKTIVCVPFIMHGVLELGTTDPISEDPALVDRIAASFWDTPPRAAFSSEAGDADIVVFEDLDHGNAAVEATTTTVPGEPHAVAGGEVAECEPNSDNDLEQITMDDIGELYSLCEELDVVRPLDDDSSSWAVADPWSSFQLVPTSSPAPDQAPAAEATDVDDVVVAALDSSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHRVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDPLGAGINIGWSPWTEDTSQVCLICCRRTWDDYRSSPESYSKLAS

SEQ ID NO: 11329 - protein, 337 aa, Campylobacter fetus
MKKILFVVATIFMALFLNAKENDMRNLKDIYLAGGCFWGTQAYFDKIRGVIKTDVGYANGKSDKTDYHSLHYSGHAETVHITFDENIVSLAEILAHYFRIIDPFSVNKQGNDVGSQYRTGIYYNDSSLKNSISEFIKHEQTKYDKKIAVEVEPLKNYVLAEDYHQKYLDKNPGGYCHVDLSLADKPLYNESKFKAPSKDELKAKLSDLQYSVTQEKATERPYSSEYDKFDKKGIYVDIVSKKPLFSSSDKFDAGCGWPSFTKPITTDALGYNRDLSHGMERVEVTSNLANSHLGHVFTDGPKDKGGLRYCINGASLKFIPLEDMEKEGYKDYIIYVK

SEQ ID NO: 11330 - protein, 418 aa, Unknown
  Oceanospirillum sp. MED92
MNVQEYMIELGENARDAARLVAKADTNLKNQALLAMADAIDNSRPALREANAIDLENGRNNGLDAAMLDRLELTDARIDTMIEGLRQVAALPDPVGAINDLKFLPSGIQVGKMRVPLGVIGIIYESRPNVTVEAASLCLKSGNATILRGGSEAINSNKAVAECIQQGLKLAGLPENAVQVVETTDREAVGQMITMPEYVDVIVPRGGKGLIERISRDAKVTVIKHLDGICHVYIDDAADKGKAINVALNAKTHRYGTCNTMETLLVNAGIAAEVLPELAERYQAVGVELRGCERTCELVPFANQASSEDWATEYLAPILAVKIVDTMDEAILHINRYGSHHTDSIITENYTKSRAFLREVDSSSVMVNASTRFADGFEYGLGAEIGISTDKIHARGPVGLDGLTSEKYVVLGDGHIRQ

SEQ ID NO: 11331 - protein, 350 aa, Triticum aestivum
NILIEKYHLGWGGEGAEGMSGGGGGGVLGAGSSYQSFVRTALEQTRLRTALTPHPSQEKFRLIRANDDAAVLDALSFSTPKIRLLRSLTVEKKNSVQVLDFAAFSEPEYDLPIFCANAFTTPAQSIVVLDLNPLYDITEDKDYKDKYYRNLMPLIHKYSEVLGSYPSPQIYYPSLLLLALYIECYLYLEKMQLLPWGGKITSESLRFFSPIVIWTIFEPTERNHHVLYSALMDYYKVWLQLTDQATEENDTTKVVRNREAQHRYLTWRAEKDPGFPLLKKLIGESHAKDLVTEFLFEGVHSLGTKSFLDYFREYACDDGTVNKKRSMIGKSFEDRPWDATGEFIGGKDAG

SEQ ID NO: 11332 - protein, 634 aa, Methanococcoides burtonii
MCGICGYAGFDDEDLLGKMCDAIVHRGPDDSGSFTDKGIGLGHRRLSIIDLEGGHQPVCNEDGTIYVVYNGEIYNFLSLRDELEKRGHRFQTSSDTEVIVHLYEEYGKDLVHHLRGMFAFALWDSNTRTLLLARDRLGVKPLYYTTIDNRLLFASEIKSIVQYSGYEKAVDIGTLHDYLTFRHALGTETMFAGIKKLLPGHVMTYREGEVNISEYWDVPLVTVGNESEDFYIKKTRLLLEESVKMRLMSEVPLGIYLSGGIDSGIVTGLMSKMVDEPIETFSVGFGERGEIGELSQAQEAADFFGTNHHEIIVDQGAFKQNLKDIIWHNDEPIADPSALAMFQLSKMASKHVTVVLNGAGGDEVFGGYISYKVGLANQKYHKIVPKVIRQGLVRPFVNAISPHLSSKMYVGIQSATQEVEEHGFLFTKSVFSEEDKEDIYTDKIKDKIHHNTFEKATTSLFRGKRYSGAIDERSSAKNTDLLSKMMYADTKSYLVDHILLETDKLTMSSSIEARVPIIDHKVVEFAASIPQELKLRGMTEKYILKKVGQGMLPPAAQNRKKRPFRIPIDTWFKDELHEMSQQVLDESSIVEQGYFRPEVVKDIMKKHERAELLYNHQMYALLVFEMWHERFMKM

SEQ ID NO: 11333 - protein, 357 aa, Lycium cestroides
  misc_feature (303)..(303): Xaa can be any naturally occurring amino acid
RYDQYKDAWDTSVAVEIKVGDSIETVRFFHCYKRGVDRVFVDHPMFLEKVWGKTASKIYGPKVGQDYVDNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIXLDVQIIVLGTGKKKFEQEIEQLEVLYPDKAKGVAKFNVPLAHTITAGADFMLVP

SEQ ID NO: 11334 - protein, 218 aa, Ochrobactrum anthropi
MSFLDSYRKKTLMPSTDEALPGRAQPIPTSATHFVNSRPLKEPWPEGYKQVLFGMGCFWGAERLFWQVPGVYVTAVGYAGGVTPNPTYEETCTGLTGHAEVVLVVYDPKVVSLDELLTLFWEEHDPTQGMRQGNDIGTTYRSVIYTFDKADRDVAEKSREAYSQALAGRGLGPITTEIEDAPELYYAEDYHQQYLAKNPNGYCGLRGTGVSCPIPLAQ

SEQ ID NO: 11335 - protein, 446 aa, Pyrococcus abyssi
MRVVKVKKTVVIIGGGAAGMSAASRVKRLKPEWDVKVFEATEWVSHAPCGIPYVVEGISPTEKLMHYPPEVFIKKRGIDLHLNAEVIEVDTGYVRVREKDGEKSYEWDYLVFANGASPQVPAIEGVDLKGVFTADLPPDAVAIREYMEKNRVEDVVIVGGGYIGLEMAEAFVAQGKRVTMIVRGERILRRSFDKEVTDIIEEKLKQHVNLRLQEIVLRIEGKDRVEKVVTDAGEYRADLVILATGIKPNIELARQLGVRIGETGAIWTNEKMQTSVENVYAAGDVAETKHVITGRRVWVPLAPPGNKMGYVAGSNIAGKEIHFPGVLGTTVTKFLDVEIGKTGLTETEALKEGYDIRTAFIKASTRPHYYPGGKEIWLKGVVDNETNRLLGVQAVGAEILPRIDAAAAMLMANFTTKDAFFTDLAYAPPFAPVWDPLVVLARVLKF

SEQ ID NO: 11336 - protein, 105 aa, Staphylococcus aureus
MIDYFYTLVEKDERLNHLFPGDFAETSRKQKQFLTQFLGGPNIYTEEHGHPMLRKRHIDFTITEFERDAWLENMQTAINRAAFPQGVGDYLFERLRLTANHMVNS

SEQ ID NO: 11337 - protein, 163 aa, Lycium chinense
  misc_feature (68)..(68): Xaa can be any naturally occurring amino acid
VDRVFVDHPMFLEKVWGKTASKIYGPKVGQDYVDNELRFSFLCQAALEAPRVLNLNCSKYFSGPYGEXVLFIANDWHTALIPCYLKSMYQSKGIYLNAKVAFCIHNIAYQGRFPFSDFSLLNLPDEYRSSFDFIDGYEKPIMGRKINWMKAGILESHRVVTVS

SEQ ID NO: 11338 - protein, 358 aa, Lycium ciliatum
RYDQYKDAWDTSVAVEIKVGDSIETVRFFHCYKRGVDRVFVDHPMFLEKVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKRIPLIGFIGRLEEQKGSDILVAAIHKFIGLDVQIIVLGTGKKKFEQEIEQLEVLYPDKAKGVAKFNVPLAHTITAGADFMLVPS

SEQ ID NO: 11339 - protein, 551 aa, Oryza sativa
MEASDEDRPLIHHLPPQEQCSKYTCDGTVNIDSVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVSFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVVAVLALIPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 11340 - protein, 696 aa, Glycine max
  misc_feature (214)..(214): Xaa can be any naturally occurring amino acid
MAMIPLMMMILLLLFKFPSVVLATLKSDEANLELVFTYHKCNEELGNFTTETYSNNRNVLLSNMYSDKEIENGFYNSSYGEGPDKVYGIGFCRGDVKPDKCRSCLEKSSTLLTDRCPVQKEAIGWYDLCMLRYSNRSIVEQPVTDTDDIIKCSNTNATNKDRFDKELDDLVVRMRSRSAEGDSRLKFAEGEAPVQSSNETIHALLQCVPYLSHXNCTRCLEYAMSRISYWCDGKTGGWYLGRSCSLRYETYLFFELIFHDAPAPQPSQPAVTPTKDFPKKTNPSRNIIVIVVPVFAVAIVVVGLIVLIYNYFGARRPRHKPIQSEGDGEGDGEGEGELDNDIKTDELAQFEFATIKFATNNFSDANKLGQGGFGIVYKGTLSDGQEIAIKRLSINSNQGETEFKTEISLTGKLQHRNLVRLLGFCFAKRERLLIYEFVPNKSLDFFIFDPNKRGNLNWERRYNIIRGIARGLLYLHEDSRLQVVHRDLKISNILLDEELNPKISDFGMARLFEINQTEANTNTVVGTFGYMAPEYIKHGKFSVKSDVFSFGVMMLEIVCGQRNSKIRGNEENAEDLLSFAWKNWRGGTVSNIVDTTLKDYSWDEIKRCIHIGLLCVQEDINGRPTMNSVSIMLNSSSFSLAEPSEPAFLMRGKSQLPMIMLSGSEQYSEATKSSDSGSQFAQGSSNKAPITEPYPR

SEQ ID NO: 11341 - protein, 489 aa, Yersinia pestis
MTAELLVNITPSETRVAYIDGGILQEIHIEREAKRGIVGNIYKGRVSRVLPGMQAAFVDIGLDKAAFLHASDIMPHTECVAGDEQKNFNVRDIAELVRQGQDLMVQVVKDPLGTKGARLTTDITLPSRYLVLMPGAAHVGVSQRIESEAERERLKKTVAAYCDEQGGFIIRTAAEGIGEEELSADAAFLKRLWTKVQERKKRNITKYKLYGEMALAQRVLRDFAGAALDKIRVDSKLTYDLLVEFTREYIPEMTDKLELYTGKQPIFDLYDVENEIQRSLERKVELKSGGYLIIDQTEAMTTVDINTGAFVGHRNLEETIFNTNIEATQAIARQLRMRNLGGIIIIDFIDMSNEDHRRRVLHSLEQALSKDRVKTSINGFSQLGLVEMTRKRTRESIEHVLCHECPTCRGRGTVKSVETVCYEILREIVRVHHAYDSDRFLVYASPAVGEALKGEESHALAEVEIFVGKQVKVQIEPLYNQEQFDVVMM

SEQ ID NO: 11342 - protein, 336 aa, Oryza sativa
MGILSLITGKAGASGFGSGSTAEQVTAGVDATGLTVIVTDFWNFLDYREFIIQSGGASGIGLETSRVFALRGAHVIIAARNTEAASVVRKKIIEENPKAHIDVLKLDLSSLKSVRAFADQFNSMNLPLNILINNAGVMFCPFGLSEDGVEMQFATNHLGHFLLTNLLLDNMKATAKSTGIEGRIVNLSSVAHLHTYPKGIEFDKLNDEKTYDDKMAYGQSKLANILHAKELSRRLKEGGANITINCVHPGLIMTNLMRHSFFLMRVLQFATYILWKSVPQGAATTCYVGLNPQLKGVTGQYFADCNVEKTSRFARNDALAKQLWEFSEKLIKFSSK

SEQ ID NO: 11343 - protein, 466 aa, Arthrobacter sp.
MNQEGKLQKGLKIRHLTMIAFGGSIGAGLFVGSGAIIQMTGPAAVFTALMAGILVILIMRMLGEMVVAKPSLGSFSDYAREALGNWAGFTVSWLYWYFWVIVIAVEAIAGAAILKDWLFPNVSLWVLNLILLIALTITNIFSVKAYGEFEYWFSLIKIVAITLFLTLGGAYIFGLFPGIPMHLSNLTAHGGFIPNGAGIVFIAVATIIFSFVGSEIVTIAAAESAESEKAVVRAVNSVIVRIMTFYVGSVFIIVAVVPWNDAKALTNPYVSALKLMGMPGADMIMNLVVVTAVLSCLNSGIYTASRMLFALGDKGDAPKWMMHVTKTGVPLKAILTCTIFGFISVIMAFVSPETVFQFLLNSSGAIALFVYLLIAVSQLKLRKTIERETPERLKLRMWAYPYLTIATIIAMLMIITTMAFNASTRSQFILSLLSSAIVVAIYFIKTNLSKKQSLDTSIVNPENIKS

SEQ ID NO: 11344 - protein, 266 aa, Cytophaga hutchinsonii
MCIYFHKFNMFLALWHHFFIPLIYLTTCNLSVHKSSIYHIKIIHMKAHLKELGTLAIGLFSIMACSSITKETKPIAHDIHMENQTGDTKQLDTATFGNGCFWCTEAVFQDIKGVVKVTSGYSGGTVTNPSYKQICTGTTGHAEVLQIVYNPSIVSYSELLQMFWYSHDPTTLNRQGNDVGTQYRSVVFYHNETQRKEAEFYKKKLDEEKIFEKPIVTEIVSFTKFYPAEDYHQNYYKEHGSEPYCMYIIRPKLEKFKKVFGEKFKQ

SEQ ID NO: 11345 - protein, 715 aa, Escherichia coli
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAESAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRVAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 11346 - protein, 570 aa, Brassica rapa
MVASPDCRISLSAPSCLRGSSGYTKHIKLGSFCNGELMGKKLNLAQLRSSSTNSSQKRIQMSLNSVAGESKVQEIESEKRDPKTVASIILGGGAGTRLFPLTKRRAKPAVPIGGAYRLIDVPMSNCINSGINKVYILTQYNSASLNRHLTRAYNSNGVFGDGFVEALAATQTPGETGKRWFQGTADAVRQFHWLFEDARSKEIEDVLILSGDHLYRMDYMDFVQDQSTKRRDISISCIPIDDRECKRVQQIHSKIMVSYKSLSVLHGRRASDFGLMKIDDKGRVISFSEKPKGDDLKAMAVDTTVLGLSKEEAEKKPYIASMGVYVFKKEILLNLLRWRFPTANDFGSEIIPFSAKEFYVNAYLFNDYWEDIGTIRSFFDANLALTEHPPAFSFYDAAKPIYTSRRNLPPSKIDGSKLIDSIISHGSFLTNCLIEHSIVGIRSRVGSNVQLKDTVMLGADFYETEAEVAALLAEEKVPIGIGENTKISSKTKRSLSNGLPSKQKVLDSFFPSHFPYRECIIDKNARVGKNVVIANSEGVQEADRSSDGFYIRSGITVILKNSVIADGVVI

SEQ ID NO: 11347 - protein, 104 aa, Triticum aestivum
  misc_feature (95)..(95): Xaa can be any naturally occurring amino acid
MSELTHPTIKDGWFREISDMWPGQAMTLKVKNIIHHEKSKYQDVLIFESTDYGTVLVLDNVIQCTERDEFAYQEMITHLANELTPKIPKKVLVIXGGGDGGVPP

SEQ ID NO: 11348 - protein, 335 aa, Zea mays
MEATAVPRALSLLGPSLSTAPLLPWMRMNCLRVAVGGGVRRQGGVVWAKKTRRGRDDVAEERVDTHSFARKAGESAELFPEAVLFRKKMVREDGQVSPEFADANEEKLYDFLNIQLKSDMKRIQRRNVLSTMLSAWTILLLGPGQVSLAETTGGAFREYIDTFDGYTFLYPKNWIQVRGAGADIFFRDPMVLDENMSVEISSPSSSRYTSVEDLGPPEKAAEKVLGQYLTEFMSTRLGVRRESNVLSASSKVADDGKLYYEVEVNIKSYASNNELAVMPQDRVQSLEWDRRYLSVLGVENKRLYELRLQTPEQVFMQEEEDLRRVMDSFRVIKAA

SEQ ID NO: 11349 - protein, 330 aa, Unknown
  Synechocystis sp. PCC 6803
MVIMEAKSNYPKTMSFANADTPPQVVVLGAGAWGSSLAYVLNNNDIPTQVWSRRSPQSLESMVAGADVIVSAVSIKGVPSVAARLEAMDLQRRTILVTATKGLDPETMTTPSQIWQAALPSQPIAVLSGPNLSKEIDQGLPAATVVASSDQAAAEEIQTIFAADNFRVYTNNDPLGTELGGTLKNVMAIAVGVCEGLGLGTNAKSALITRALPEITRVGLHFGAQPDTFWGLAGLGDLLATCSSMLSRNYRVGYGLSKGQSLEEILANLGGTAEGVNTTDVLIKIANREKIAVPITRQVYRLLHGKITPPQAVEALMERELKAEFEDFDL

SEQ ID NO: 11350 - protein, 215 aa, Ashbya gossypii
MIRIGSRLTPSLRHYTSSSQRITKFTMSGFYDLSPLDAKGEPFPFSQLKGKVVIIVNVASKCGFTPQYEELEELYKKYKDQGFEVIGFPCNQFAHQEPATNEEIVQFCKLNYGVTFPVLKKVDVNGADADPVYVYLKSQKSGLLGFKGIKWNFEKFLVDRKGQVKDRYSSITKPLSLEKTIETLLKEEGGPAPTATTEATATATADAAKPSGESL

SEQ ID NO: 11351 - protein, 1462 aa, Unknown
  Synechocystis sp. PCC 6803
MVISATVISMKSPLRRLLLSPVLPILIGAGLSVMTVHTWLFLYNQVQERLKQVLTNRLTNIHEQIENQLNIHVRQLEQMAGRWERSPTGTEQTDWRLDARAQAEGFDGYQTIQWVDPKFVVRWVEPLPDDEHDIDYANQYPHQIQSLELAARQKNTILSGVVDLDQGEKGFLVYVPLFIGDRFDGFVVGVFQLDQFIGSVRPLSGNKPDQDSGLRSFGLRIFEGNQLIYNDVPDDWEQDIVVTQELAWANSLPQAEAMTSRWQLQLVPGPILLDQYGSSQWILFSGLLMAWAVAIAVYYLQKSSKHSEQLSESIKQQQKVEEFLKSTLQELAVQKTALDEAAIVAITDTEGVITYVNDKFVEVSGYSREELIGNTHRLVSSGYHSPEFFQQFWQTIRAGKVWHGQINNRAKAGNTYWVDSTVVPFLDDNGNPYQYLAIRFEITSSKQAEKSLRESEARFRMMADTSPIMLWVADQDKKMTFVNQSWLEFRGATLAEESGNGYLEGIHPDDKGHYLGVYSQAFGDRRRFELEYRYRRVDQQYRWIVNVGVPRYLEDGKFMGYVGSCLDITDRKQAQDILQKKLNQILLMRKISQEIRRSLQPTLIFQTAARQVGNVFAVSRCLIHNYSEATTLQVPVVAEYLGGQFTSLLAGEIAVEQAYDPTIIQGDRAMAVVDLDQDLNSTHTKAFYQRFQVKSFLAVRTSYQGKANGIIALHQCDRQRVWTADEIELLEAIAEQMGIALAQAALLEKERERRRELAQKNLELEKATWAAEAANRAKGEFLAMMSHEIRTPMNGVIGMTELLIMTDLNLQQLDYVQTIRQSGETLLTIINDILDFSKIEADKLVLETQAFELRPLIETVLEMFGPIARAKHLELTYGIDPQTPARILGDQVRLRQILSNLIGNALKFTEKGEVVLTVKGEPFDPAESYHTILNLPHPSHRICFNLRDTGIGIPLDRQDRLFKSFSQVDSSTTRKYGGTGLGLVISQRLTQMMGGVLTVTSEPGVGSNFRFCILTTAQAPALAEADSVQQMKGKQVLIVDDNETNRRILQDQCQAWGLVCHCFTSGESALDWFARCPDLDAAILDLQMPNMDGITLAHHLRQFAQGKDLPIILLSSGLVAGADELSVFQTVLNKPVRQSLIFDSLVNIFQGSIGLADYAPQFDQLDLPEFVPDGDGLPTEDNATSLQPALQILLAEDNLVNQKVAHQMLNNLGYPVAIANNGQEVIDALEKKFYDLVLMDMQMPVMDGITACRHIRQTLPLERQPRIVAMTANAMPGDRQECLDAGMDGYISKPISINQLRKVLQDTSALITSPQAREDIVTLGDKITVVEEQTMVKPTDVTESPLDPTAIAFLRDDLCGGDLTLFGEMVACYCQESQKLIEELVQGLEVDDFAVIRRTAHSLKSSSASLGAQQLSTFCQQLEKNAGSGNLGLGSPPQLVDRCRQLHIAVVEALAPFTIPSP

SEQ ID NO: 11352 - protein, 522 aa, Neisseria meningitidis
MKHRTFFSLCAKFGCLLALGACSPKIVDAGAATVPHTLSTLKTADNRPASVYLKKDKPTLIKFWASWCPLCLSELGQTEKWAQDAKFSSANLITVASPGFLHEKKDGDFQKWYAGLNYPKLPVVTDNGGTIAQSLNISVYPSWALIGKDSDVQRIVKGSINEAQALALIRDPNADLGSLKHSFYKPDTQKKDSKIMNTRTIYLAGGCFWGLEAYFQRIDGVVDAVSGYANGNTKNPSYEDVSYRHTGHAETVKVTYDADKLSLDDILQYFFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKTAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSYNMRRTEVRSHAADSHLGHVFPDGPRDKGGLRYCINGASLKFIPLEQMDAAGYGALKGKVK

SEQ ID NO: 11353 - protein, 292 aa, Rubrobacter xylanophilus
MRGMREAVIIGNPASGRVSMRRLKLCAEILERGGVRAEIWPTERPEHATELATLAGARLVVAAGGDGTINEVINGLHRDARLGILPLGTANVLARELGIPLSLERACHRILEGETVRIDLGVARNASGVERRFACMAGIGFDASVVLEVTPGIKRRLRRTAFALMAFKVFLTSEIPPFEVSCGGERRRARFAIVANGRNYGGDFWSAERASLTNGRLEVVLVERVRRLLRPDILATILSKRPLSRRMPAVSVPRVEAAPLGGASVPVQLDGEAWGHLPMSFRVEPSALPVLR

SEQ ID NO: 11354 - protein, 974 aa, Medicago truncatula
MKNITCYLLLLCMLFTTCYSLNNDLDALLKLKKSMKGEKAKDDALKDWKFSTSASAHCSFSGVKCDEDQRVIALNVTQVPLFGHLSKEIGELNMLESLTITMDNLTGELPTELSKLTSLRILNISHNLFSGNFPGNITFGMKKLEALDAYDNNFEGPLPEEIVSLMKLKYLSFAGNFFSGTIPESYSEFQKLEILRLNYNSLTGKIPKSLSKLKMLKELQLGYENAYSGGIPPELGSIKSLRYLEISNANLTGEIPPSLGNLENLDSLFLQMNNLTGTIPPELSSMRSLMSLDLSINGLSGEIPETFSKLKNLTLINFFQNKLRGSIPAFIGDLPNLETLQVWENNFSFVLPQNLGSNGKFIYFDVTKNHLTGLIPPELCKSKKLKTFIVTDNFFRGPIPNGIGPCKSLEKIRVANNYLDGPVPPGIFQLPSVQIIELGNNRFNGQLPTEISGNSLGNLALSNNLFTGRIPASMKNLRSLQTLLLDANQFLGEIPAEVFALPVLTRINISGNNLTGGIPKTVTQCSSLTAVDFSRNMLTGEVPKGMKNLKVLSIFNVSHNSISGKIPDEIRFMTSLTTLDLSYNNFTGIVPTGGQFLVFNDRSFAGNPSLCFPHQTTCSSLLYRSRKSHAKEKAVVIAIVFATAVLMVIVTLHMMRKRKRHMAKAWKLTAFQKLEFRAEEVVECLKEENIIGKGGAGIVYRGSMANGTDVAIKRLVGQGSGRNDYGFKAEIETLGRIRHRNIMRLLGYVSNKDTNLLLYEYMPNGSLGEWLHGAKGCHLSWEMRYKIAVEAAKGLCYLHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWINKTELELYQPSDKALVSAVVDPRLNGYPLTSVIYMFNIAMMCVKEMGPARPTMREVVHMLTNPPHSTSHNLINL

SEQ ID NO: 11355 - protein, 591 aa, Glycine max
MEKRKRGKSEEKGEEKWVHDASVDYKGRVPLRASTGVWKASLFVLAIEFSERICHFGIATNLIMYLTKVMHEDLKTATKNVNYWVGATTLMPLIGGFVADAYTGRFRMVLFSSLLYLKGLSLLTMSQFIPSLKPCNNEICHWPRKVHEVVLFLALYCVALGTGGFKPCLQSFGADQFDDDHLEERKKKMSFFNWWNFTLCTAMLLGATVIVYVQDFVSWGVSYLILSMFMALTIIAFYEGKRFYRYRSTEGNPFMLILQVLIAAIRKSNLSCPSNPDSLYEFPKSEKSQGRLLSHTCRLRFLDKAAIVEGKYTEHRDQNPWRLATVTRVEETKLILNVIPIWLTSLIIGICIAQGSTLFVNQAASMNLKIINSFKIPPASMTSVSAISPIIAIPIYDKIIVPIMRKVKGNERGISVLWRVGIGLAFLVIAMVVAALVETKRLRMVEHDEVITVGGTRHETMSVLWLIPQYLILGIGADSLSLIGLQEYFYDQVPDSVRSLGVGLYLSVVGVGFFLSSFLIITVDHVTGKNGKSWIAKDINSSRLDKFYWMLAVINAFNLCFFLFLAKGYTYKTVQRKTREICSDGVETMES

SEQ ID NO: 11356 - protein, 358 aa, Flavobacteria bacterium
MSNFHNITLSHVYKETDDTTVIAFDVPQELKEEFKYRPGQFLTLRAIINGEDLRRSYSLCSSPLDNEWKVAVKEIFEGKFSTYVNRELKSGDVLQVAAPSGDFGIESYGENKAKNYIAFAAGSGITPMLSIIKTHLAQEPNAKFKLFYLNRTVKSIIFKEEIEALKNKYLSRFEVFYFLSREHRDIPLFNGRFDQEKLQTLTQTLINAPHTDHAFICGPEEMIFLIRDELVAAGMKKENVHFELFVSGLSEEDKARAAAALEQKVDGVDVTIIDGSKEFHFVLGDDFDNVLDGAIGAGADLPYACKGGVCSTCKCKVVEGSVAMKVNYALTDEEVEKGFVLSCVSVPTSKKLVVDYDV

SEQ ID NO: 11357 - protein, 437 aa, Nostoc punctiforme
MKTNQIPPGSFGLPVLGETLSFVFDRDFAKKRYHQYGPIFKTHLLGRPTVVMAGPEALEFVLSSHIENFSWREGWPDNFKTLLGESLFLQDGEEHRRNRRLMMPALHGPALASYFSTMEDITRSYLQKWEKKQEFTWFQEFKQLTFDIASQLFLGTRPGPECVRLSQLFTTLTNGLLAINPLPLPFTTFGKAIAARNEILEHLTQVVRERQQNPTQDTISLLIKAKDEDGNSLSEKEIIAQAVLLLFAGHETTTSMLTWLCTELACHPEVLEKARVEQLQLASQGDLDLEQLGKMPYLEQVLWEVERLHQPVGGGFRGVIKDFELNGYHVPTGWQLYYSIGVTHQIEEIYSEPELFDPDRFSPQRQEHKKYPFSLVGFGGGPRICIGIAFAKMEMKIVAAHLLRSYHWEILPNQSLEVVAVPTNRPKDGLRVRFQPR

SEQ ID NO: 11358 - protein, 324 aa, Picea sitchensis
MAIPVIEMGNLKGNEKERFMAEMGKACEEVGFFQLKGHSVPLELMERVKKVCSEHYNRVREPKFKTESVPVKLLNKSLTEAELSNSSEPKKVENVDWEDCFVLQYAQEDYPWPSEPSEFKETMMEFGKEITKLAETLLEILSENLGLEKGYLKTTLAGGDGPDDKAFFGTKISHYPPCPRPELVEGLRAHTDAGGLILLFQDDEVGGLQVLDNTGRWIDAPPMKDTLVIDIGDQLEAISNGRYRSAWHRVLATDNGNRMSVASFYNPSFDAVISPAPQLLLQPKEGSELSLYPKFVFGDYMNVYAQQKFLPKEPRFQAVTALQY

SEQ ID NO: 11359 - protein, 143 aa, Glycine max
GAFTEKQDALVSSSFEAFKANIPQYSVVFYNSILEKAPAAKDLFSFLANGVDPTNPKLTGHAEKLFALVRDSAGQLKASGTVVADAALGSIHAQKAVTNPEFVVKEALLKTIKEAVGDKWSDELSSAWEVAYDELAAAIKKAK

SEQ ID NO: 11360 - protein, 73 aa, Sinningia schiffneri
ISGTNGEVMPGQWEFQVGPSVGIEAGDHIWCSRYLLERITEQAGVVLSLDPKPIEGDWNGAGCHTNYSTKSMR

SEQ ID NO: 11361 - protein, 320 aa, Pseudotsuga menziesii
MAIPVIELGDLKGNGREKFMAEMGKACEEVGFFQLKGHGVPVELMERVKKVCSEHYNCVREPKFKTESVPVKMLNKSLTEAKLSNSTPKKVENVDWEDCIVLQYAQEDYPWPSEPTEFKETMVEFGKEISKLAETLLELLSEYLGLEKGYLKRTLAGGDGPDQKAFFGTKISHYPPCSRPDLVEGLRAHTDAGGLILLFQDDEVGGLQVLDNTDRWIDAPPMKDSLVIDVGDQLEAISNGRFRSAWHRVLATDNGNRMSVASFYNPSFDAVISPAPQLLLQPNEGSDLSIYPKFVFGDYMNVYAQQKFLPKEPRFQAVTA

SEQ ID NO: 11362 - protein, 419 aa, Thermococcus waiotapuensis
MVELDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPWSDIPAPDVYTNPKIMGWMMDEYETIMRRTGPAFGVITGKPLSIGGSLGRGTATAQGAIFTIREAAKALGIDLKGKTIAVQGYGNAGYYTAKLAKEQLGMKVVAVSDSQGGIYNPNGLDPDEVLKWKNETGSVKDFPGATNISNEELLELEVEVLAPAAIEGVITEKNADGVKAKIVAEVANGPVTPEADEILREKGILQIPDFLCNAGGATVSYFEWVQNINGYYWTEEEVREKLDKKMTKAFWDVYNTAKEKNIHMRDGAYVVAVSKVYQAMKDRGWVKH

SEQ ID NO: 11363 - protein, 204 aa, Lycium cooperi
  misc_feature (81)..(81): Xaa can be any naturally occurring amino acid
  misc_feature (189)..(189): Xaa can be any naturally occurring amino acid
SPRYDQYKDAWDTSVAVEIKVGDSIETVRFFHCYKRGVDRVFVDHPMFLEKVWGKTASKIYGPKVGQDYVDNELRFSLLCXAALEAPRVLNLNCSKYFSGPYGEDVLFIANDWHTALIPCYLKSMYQSKGIYLNAKVAFCIHNIAYQGRFSFSDFSLLNLPDEYRSSFDFIDGYEKPIKGRKINWMKAXILESHRVVTVSPYYA

SEQ ID NO: 11364 - protein, 252 aa, Triticum aestivum
AVSALLDLISALSAFVASTPPFPHSSRYGNPAFRLWHEKLGGSVNELIAPITAAAASPSDLAGAEVELAPYLLDSFGNGTRIDYGTGHETNFAAFLYCLARLGLITDPDYPAVVLRVFASYLDLMRTLQDTYLLEPAGSHGVWGLDDYHFLPFVFGAAQLIDHKYMKPKSIHNPDILENFSKEYMYLACVMYVKKVKKGPFAEHSPMLDDISAVPNWKKVNSGLLKMYKAEVLEKVPIMQHFLFGSLIKWED

SEQ ID NO: 11365 - protein, 107 aa, Glycine max
  misc_feature (92)..(92): Xaa can be any naturally occurring amino acid
MASSMISSPAVITVDRACAGMVAPFTGLKSMAGFPTRKTSNDITSIAINRGKVHCMHVLPPIGNKMFETLSYLPYLDDAQLAKEVEYLLMKXWIPCLEFELEHRFAY

SEQ ID NO: 11366 - protein, 358 aa, Lycium elongatum
QYKDAWDTSVAVEIKVGDSIETVRFFHCYKRGVDRVFVDHPMFLEKVWGKTASKIYGPKVGHDYADNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSRFE

SEQ ID NO: 11367 - protein, 233 aa, Bacillus cereus
MSVISMKQLLEAGVHFGHQTRRWNPKMKRYIFTERNGIYIIDLQKTVKKVEEAYRTMRDIAAEGGDILFVGTKKQAQEAIKEEATRAGMYFVNQRWLGGTLTNFQTIQKRIKRLKDIERMQEDGTFEVLPKKEVVQLKKELERLEKFLGGIKDMKGLPSALFVVDPRKERIAVAEARKLHIPIIGIVDTNCDPDEIDHVIPANDDAIRAVKLLTSKMADAILEAKQGEETVTA

SEQ ID NO: 11368 - protein, 339 aa, Lycium exsertum
  misc_feature (256)..(256): Xaa can be any naturally occurring amino acid
  misc_feature (320)..(320): Xaa can be any naturally occurring amino acid
IKVGDSIETVRFFHCYKRGVDRVFVDHPMFLEKVWGKTASKIYGPKVGQDYADNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPXDKKIPLIGFIGRLEEQKGSDILVAAIHKFIGLDVQIIVLGTGKKKFEQEIEQLEVLYPDKAKGXAKFNVPLAHTITAGADFML

SEQ ID NO: 11369 - protein, 73 aa, Sinningia araneosa
ISGTNGEVMPGQWEFQVGPSVGIEAGDHIWCARYLLERITEQAGVVLSLDPKPIEGDWNGAGCHTNYSTKSMK

SEQ ID NO: 11370 - protein, 153 aa, Oryza sativa
MAPKAEKKPAAKKPAEEEPAAEKAEKAPAGKKPKAEKRLPAGKAEKSSGEGKKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 11371 - protein, 208 aa, Unknown
  marine gamma proteobacterium HTCC2080
MVKKRSSSRAWLKEHREDLYVQRAVKEGYRSRACYKLKEINDRDRVIKPGMTVLDLGAAPGGWSQVAVEMVGARGRVIASDILPMDSLADVEFILGDFTEEAVFEALLNLLGESAVDVVLSDMAPNMSGVSAVDQPRSMYLVELALDLATQTLEKGGTLVSKVFQGEGFEAVMSTARQNFDRVLTRKPEASRPRSREVYLVASGFKGQ

SEQ ID NO: 11372 - protein, 665 aa, Glycine max
MCISKSSSTHLLLLSLFNLLTSASQAAPTYSAHACSDEGSHYRPNTTFETNLNILLSSLVSNATLHHGFYRTNVSLGTSDEVKGLFLCRGDVTPSLCLDCVTAAAKNITNFCTNQTQSIIWYDECMLRYSNSSTLDNIVPSVGMKNEQSVSDSDYARFNDVLASTLNDLKQEALNSSSSGKKFATKEANFTSSMKLYTLAQCTPDLSTSDCNTCFSSSIGGFPNCCDGKRGARVLLPGCSVRYELYPFYNVSSVSHLPSPSSGKSSISIIVAIVVPIVFVILLFIVGVYFLCKRASKKYNTFVQDSIADDLTDVGDVESLQFDLATVEAATDRFSDENKIGQGGFGVVYKGVFPNGQEIAVKRLSVTSLAGVAVEFRNEAALVAKLQHRNLVRLLGFCLEGQEKILIYEYIPNKSLDRFLFDPVKQRELDWSRRYKIIVGIARGIQYLHEDSQLRIIHRDLKASNVLLDENMNPKISDFGMAKIFQADQTQVNTGRIVGTYGYMSPEYAMRGQFSVKSDVFSFGVLVLEIVSGKKNTEFYQSNHADDLLSHAWKNWTEKTPLELLDPTLRGSYSRNEVNRCIHIGLLCVQENPSDRPSMATIALMLNSYSVTMSMPRQPASLLRGRGPNRLNRGMDSDSSTSNQSTTCSIAWSVNEVSITDLYPR

SEQ ID NO: 11373 - protein, 209 aa, Rickettsiella grylli
MSHYKSSSQRWLNEHFKDPYVKRAKKEGFRSRSAYKLLEIQEKTKLIKPGMVIVDLGAAPGGWSQIASRLVGTTGKVYALDILPMETLTPVEFLQGDFREESVIKQLLQRIQSKPIDLVISDMAPNFSGIRSVDQPRAIFLAELALDFAKKVLKPKGYFVVKAFQGKGFEAFLKELRSLFANVTIRKPSASRGRSTEVYLVAIGYYQGK

SEQ ID NO: 11374 - protein, 630 aa, Glycine max
MVPENLKKQLALAVRSIHWSYAIFWTDSTTQPGVLSWGEGYYNGDIKTRKTSQGVELNSDQIGLQRSEQLRELFKSLKTVEVTPQTKRPSAAALSPEDLTDAEWYYLVCMSFIFNIGQGLPGRTLAKGQPIWLNNAHSSDCKIFSRSLLAKSASIETVVCFPFREGVIELGTTEQVPEDLSVIELIKTSFLNSLHANVPNKSVATLKSRNQEGLSYAAFDHNDYNVKSIPEVGYEIANTTSPDGSSNAFQANQPLDETFMIESITNGTSQVQNWQVIDDELSNCVHNSMNSSDCISQTFACPENIASAPKSNNPSDPCARNFQKCNNPKMTLVDPRSDDLHYQRVLSTLIKSSDQLLMGMHLQKFPQESSFVSWRKEQPMDCKWPRAGTSQKLLKKVLFEVPQMHLDGLHESQEENDYKEGMRVEADENGMNHVMSERRRRAKLNERFLTLRSMVPSISKDDKVSILDDAIDYLKKLERRVKELEAHRVVTDIETGTRRSPQDTVERTSDHYFRKNNNGKKPGMKKRKACGVDETEKEINSDALKGSYANDVTVSTSDNEIVIELKCPSKAGRLLEIMEAINSFNIDFSSVQSTEADGNLYLTIKSVLTGPSVATTKRIKQALQKLASKC

SEQ ID NO: 11375 - protein, 847 aa, Unknown
  Azoarcus sp. BH72
MSMDRRDFIKANAVAAAAASAGIGIPVVAQAQPNGANTKVRWDKAACRFCGVGCSVLVGVQNGRVVATQGDPDAPVNRGLNCIKGYFLSKIMYGEDRLTKPLLRMKNGKYDKNGEFTPISWDQAFDIMAEKWKAALKEQGPDSICMFGSGQWTIWEGYAASKLWKAGFRTNNIDPNARHCMASAVTGFMRTFGIDEPMGCYDDIENADAFVLWGSNMAEMHPILWTRITDRRLSREGCEVHVLSTFEHRSFELSDNGMIFTPQTDLAILNYICNYIIQTKRVNTAFVNTNVKFKAGETDIGFGLRPTHALEQKATSNGYPGADGKPKGDVNAAKDISFEEFAKFVSDYTLEKTAKLTGVPAERLKRLAEVYADPNKKVMSFWTMGFNQHTRGTWVNNMIYNVHLLVGKISEPGNSPFSLTGQPSACGTAREVGTFAHRLPADMVVANPMHRAIAEEIWKLPEGTIPAKIGLHAVAQSRALKDGKLKCYWTSTTNNMQAGPNVNEEIYPGWRNPNAFVVVSDVYPTVSALSADLILPSAMWTEKEGAFGNAERRTQFWRQQVTAPGEAKSDLWQYIEFSKRFKVEEVWPADLIAKKPEVKGKTLFDVLFANGTVNKFPLSDVEKANAHAIPGYMNLESKALGFYLQKGLFEEYAQFGRGHGHDLADFDVYHKARGLRWPVVEGKETLWRFREGYDPYVKQGEGVKFYGHKDGKAVVFALPYQDPPEMPDKEFDMWLCTGRVLEHWHTGSMTRRVPELHRAVPEALVFMHPEDATQRGLQRGMVVKIASRRGEVVARLETRGRNKPPKGLIFVPFFDEGRLVNKLTLDATCPISKETDFKKCAVKVMKA

SEQ ID NO: 11376 - protein, 158 aa, Triticum aestivum
  misc_feature (52)..(52): Xaa can be any naturally occurring amino acid
MESKGGKKSSSSRSSLMYEAPLGYSIEDVRPAGGIEKFRSAAYSNCSRKPSXIIPLQSLFSLYQPSETMAVSAIGFEGYEKRLEITFSEAPVFTDPNGRGLRALSRAQIDSVLDLAKCTIVSELSNEKFDSYVLSESSLFVYPYKVVIKTSPGHQDLS

SEQ ID NO: 11377 - protein, 430 aa, Staphylococcus aureus
MKTTIKQAKDHLNQDVTIGAWLTNKRSSGKIAFLQLRDGTGFMQGVVVKSEVDEEVFKLAKEIAQESSLYVTGTITEDNRSDLGYEMQVKSIEVISEAHDYPITPKNHGTEFLMDHRHLWLRSKKQHAVMKIRNEVIRATYEFFNKDGFTKVDPPILTASAPEGTSELFHTKYFDQDAFLSQSGQLYLEAAAMAHGKVFSFGPTFRAEKSKTRRHLIEFWMIEGEMAFTNHAESLEIQEQYVTHVVKSVLENCKLELKILERDTSKLEKVATPFPRISYDDAIEFLKAEGFDDIEWGEDFGAPHETAIANHYDLPVFITNYPTKIKPFYMQPNPENEETVLCADLIAPEGYGEIIGGSERVDDLELLEQRVKEHGLDEEAYSYYLDLRRYGSVPHCGFGLGLERTVAWISGVEHVRETAPFPRLLNRLYP

SEQ ID NO: 11378 - protein, 559 aa, Unknown
  Synechococcus sp. WH 5701
MAPLRFLGGPSTDKFSLGSRFVKPARMTTLPDYSFHEPQVQWQRFCDLLWHHDDLGIWVDVSRMELNQAHLEALEPAFDRAFTAMQALEAGAIANPDEGRQVGHYWLRTPDLAPDPEAAAHIKAEVERIDAFGQQVIGGACPAPSGTPFTDVLWIGIGGSGLGPLLILRALKEEGLGLPFHFFDNVDPQGMSRTLSALGERLLTTLVVVVSKSGGTPEPRLGMEQARARLEALGGSWAQQAVAVTMVGSQLDQRAEAEGWLARFDMFDWVGGRTSITSAVGLLPAALIGADLHGFLEGAARMDAATRAANLRENPAALMAAAWHVAGGGAGGRDMVVLPYRDRLEVFSRYLQQLVMESLGKRLDRDGREVHQGIAVYGNKGSTDQHAYVQQLRDGVDNFFVTFIEALDDPADVAPVDGDYPGDFLDGFLQGTRSALTEGGRQSLSISLRRFDARSLGALVALFERAVGLYGELVNVNAYDQPGVEAGKKAAATILDLQGRVEALLADGQARSVAAIGEELQLPSPEAAFWILRHLCGNDRGFSAEGDWGDPAGLVFRKV

SEQ ID NO: 11379 - protein, 456 aa, Glycine max
MDPCPFSRLTVRNLALKIPVASKPARSVVHPSSSPCFCKIQLKNFPLQSAVVPFIPPDSLFPDSLVHPIAATFHLSKSDLDKLAGKSIFSAKLCLKISIYTGRRGSTCGVSSGRLLGRVSVPLDLTGTVAKTTVFHNGWIRIGKDAKGSSAQFHLNVKAEPDPRFVFQFDGEPECSPQVFQIQGNISQPVFTCKFSFRNNGDRNHRSRSLQSEPGGSRSWLSSFGSERERPGKERKGWSITVHDLSGSPVAAASMVTPFVASPGSDRVSCSNPGSWLILRPSDGTWKPWGRLEAWRERGGSDGLGYRFELIPDTNGGMSAAGIVLAESTLSNNKGGKFVIDLSCRNGNGSGNGGSNGRATPGSATSPACSPRSSGDYGYGLWPYCMYRGFVMSASVEGEGRCSKPTVEVSVPHVNCTEDAAAFVALAAAVDLSVDACRLFSQRLRKELCQQLDLIG

SEQ ID NO: 11380 - protein, 765 aa, Triticum aestivum
  misc_feature (558)..(558): Xaa can be any naturally occurring amino acid
  misc_feature (569)..(569): Xaa can be any naturally occurring amino acid
MDTPDRPRAGAAAGFEDSPVFNFINNLSPIPPPKPQDTSHNVHLFKSSDLAPVSSIFASPHVNPPKESKLLIRDDSVQLSQDSNSPNSVRTRLGSAIRLIKCKNIVSENCSFTCHLNQGPIDSSANRSNSTSKLPQTIQFVGDSSECGKNQSADGKKDLARDQESIELEGVLLDHTGPDKIDSSQPGRIVHENQQCEQQKDGFTAYDGDYLITHESSMDMLRLAPPCEADTQLVNETLNADNVFSGNSLLTDGPSGSYINNAAHDPNLYWDGTVEGPTTDYTPQLLPGACQSQSVSNDQICNAVEEPSDHIPIDQSALSQNMRGMRRRCLFNEKAGAVNKAAKKTSDRHSANTTTPRCKTNSGDKPVRTPPCALPGIGLHLNALAPISTDKIVPQAAQSSINQASNFPCAVSSSTSESNIANEDSSQAIVVANADESGQGSPKKKRHKFDDGDGTSCKRCSCKKSKCLKLYCECFHAGVFCSEPCSCQGCLNKPSNMEIVLSTREQIESRNPLAFAPKVIRTSEPGQELGEYSNKTPASARHKRGCNCKKSSCLKKYXECYQGGVGCSXSCRCEGCKNAFGRREGLGPLSIEEAKQGNEENSACVKEEKKEDDNNQLVICPAANPAPAENVLTTPSAMDVRPLASRPPSSSKRPRSTTKVLGHPSRLCNSQAPLKTDTLLSPFENYAEIMFGVGTSDSLKGGLSPQTSVKVVSPNKKRVSPPRIGTGLSPICKSGRKLILKSIPSFPSLGGDVNNADTKTTLPAP

SEQ ID NO: 11381 - protein, 283 aa, Zea mays
  misc_feature (112)..(112): Xaa can be any naturally occurring amino acid
  misc_feature (160)..(160): Xaa can be any naturally occurring amino acid
MRLRGRSGRARAGDHRKELRRAAAAAATPPPAATRPLRRAAARLRRLDSTVEKRLLIPFREIQAECTIPKDDAPLASVGGLPVQDDAARTTMHGGPRNHPAAATDGVNPLAXLMTLRSGLAAVPYGGSQGGLGCSPGGLSWSELERLTRVFTPQCHPRIXIHTDIPAPDMGTNSQTMAWILDEYSKFHGHSPAVVTGKPIDLGGSLGRDAATGRGVMYATEALLAEYGKSISGSTFVIQGFGNVGSWAAQLIHEKGGKVIALGDVSGTIRNKAGIDVPALMKH

SEQ ID NO: 11382 - protein, 356 aa, Unknown
  Streptomyces sp. FR-008
MDYVDVAVIGGGQSGLAAAHALRQRGLVPVVLEASGQAAGSWPGYYDSLTLFSPARFSSLPGLPFGGDGDRYPHRDEVVDYLTRYADRLDAEIRTHTRVESVESDGAGFVVHTVDGRLGAAGIVAASGAFGNPLLPGLPGRQGFAGEVLHVADYRSPEPYAGKRVVVVGGGNSAVQVSYELAEVAEVTLATRTPIRFLAQIRDGKDLHHWLTDTGFDHLPPHWLIHYVGGTLVLDTGRYQDALESGRLQRRPMFTALDGDEVIWDDGSRERADVVLLATGYRPHLDYLAKLGALDEQGAPRHAGGLSLTHPGLVYLGLEFQRSFASNTLRGVGRDAAYVIDPLAAHVRKTPAAAGL

SEQ ID NO: 11383 - protein, 644 aa, Gibberella zeae
MASAKLVGMGFELLKRATDEEETDPEEGDSAQKELFAAWALFISIMLLIVAFFTSYMLQMKKVTAIHETVISIFAGMVVGLVLMIFGGDSIRTMISFDYQIFFNLLLPPIILSSGYELHQANFFRNIGTILTFAFAGTFLSAVVIGFILYLFTLIPGSLEMSFVDAISVGATLSATDPVTILAIFNAYKVDPKLYTIIFGESILNDAIAIVIFETAQKYKKGEAAGLSIISFFEGTGIFLLVFFCSLFIGFLVGVATALLLKFTYLRRTPKIESCLMVLIPYATYFFSHGLHMSGIVSLLFCGITLKHYAYFNMSRRTQLTTKFIFQILSQLSENFIFIYLGLALFTDNHLQFQPPLIIVTILAVCAARWVAVFPLSKAINWFIRYRAGRRGQEVGDELPYNYQAMLYWAGLRGAVGVALAALLTGENSPALRATVLVVVVLTVIIFGGTTARMLEILGIRTGVVEEVDSDDEFDIETFGGGLQVKRSGTGIGYNPRRNGSVALGSLEAGQSASYVSGASSPHTGGRPTSKVRKNSIPERSDLLRHNDDSDIGSDIDVSDLPPPARRSPLPRSNTATPSRVDSAYATPISETPGGQPITASNAIRQLWTSEDPASVFHHLDEDFIKPRLLLQGDSSRGGNGGPS

SEQ ID NO: 11384 - protein, 371 aa, Ashbya gossypii
MSSIVANYKLVKAPIYSHCFNADRTLLAITCDTDCYVYRIGAGHPKLVAILADHDKTVTAVDISIHGRIVTCSQDRNAIVWEPLSDGSYKPTLVLLRINRAATCVSWAPNGYKFAVGSSARIISVCYYEHDNDWWVSKHIKKPIKSTINALSWHENGVLLAAGGTDGYLRVFSGYIKGLDQKEQVAGSPWGDKFPFGAVIREWYHGAWIHDVQWRSQQERLAYVTHDGLLAVVDHAGEHAMVENPGGLPFKTLLWASDRSILCGGFSCHPVLFAETATGWKFAKNLDEAAPVPRSQRATPDDGDDDDDGTFGMSALKKFKELDLKGKISAQQDRSTHENTITRFFPFAEVAGQLSQVSSSGLDGKIVIYQL

SEQ ID NO: 11385 - protein, 515 aa, Porphyromonas gingivalis
MLDKDTLAQVGSYFAQLKKSYTLRLNAHTSHPSYNEAKEMLDGLASVSDHVRAEYNAADDFRIDLLVDGADSGIGFRGIPGGHEFSSLLLAILNNDGIGRNIPDEGVQDRIRRINGPIELKTYVSLSCTNCPDVVQTLNMIAILNPTINHTMVDGSFFPDEVESLGIASVPTVMAGDEVIHVGRGDMAALLNKIEAKYGSVPAESADKTLRPFDLLVVGGGPAGSAAAIYSARKGLKVAIVAERVGGQVNETVGIENLISVPYTTGSELASNLNSHIKANTISLFEARTVSSITQQEGISRVEVTSGEVFTAPALIMATGASWRKLGVPGEKEYTGNGVAYCAHCDGPFFKGKRVAVVGGGNSGLEAAIDLAGICEHVTVVEFLDVLRADEVLQKKARETANIDILLSTATKEIMGNGQKVEGILLTDRNTGEEKQIALSGVFVQIGLAANTSLVKDLVETNSRGEVLIDTSCRTNTPGIYAAGDCTTVPYKQIVIAMGEGAKAALSAFEDRIRG

SEQ ID NO: 11386 - protein, 66 aa, Oryza sativa
GGDLIGGEGCNVQMYPKAKFLSWGGVAVFWAAGEEVDRDYLSFGEPPPVFPEEGWDDLGGKFCKAP

SEQ ID NO: 11387 - protein, 402 aa, Medicago truncatula
MAADDEPMPTRWSFEEFKKYYDVRLGRKKLVENGENAVSNGNSSGIASNGNSHGKVTSDRAIYDQFQSQGQNPTHTNGFGPNGVDEKPKKSLLPPFESAEMRTLAESLSRDIIRGSPNVKWESIKGLENAKRLLKEAVVMPIKYPKYFTGLLSPWKGILLFGPPGTGKTMLAKAVATECNTTFFNISASSIVSKWRGDSEKLVKVLFELARHHAPATIFLDEIDAIISQRGEGRSEHEASRRLKTELLIQMDGLARTDELVFVLAATNLPWELDAAMLRRLEKRILVPLPEPEARRAMFEELLPLQPDEEPMPYDLLVDRTEGYSGSDIRLLCKETAMQPLRRLMTQLEQEPDVVPEEELPKVGPVVPEDVEAALRNTRPSAHLLAHKYDTFNADYGSQILQ

SEQ ID NO: 11388 - protein, 183 aa, Erwinia carotovora
MSTEIYAIPLTTIDGKATTFEAFKGQVALVVNVASKCGLTKQYDALEKLYETYRDKGLVVLGFPSNEFAGQEPGSEEEIQEFCRGTFGVQFPMFSKIEVNGENRHPLYQLLIRQQPEANGTWKSDFFARLVNKGRKPKNPEDILWNFEKFLVDREGRVIERFAPDMSPDHDTIVKAIEAALAK

SEQ ID NO: 11389 - protein, 356 aa, Unknown
  Streptomyces sp. FR-008
MNQHADVVVVGGGQAGLAAGYYLRRQGGLDFVVLDADPVPGGSWQHMWDSLHLFSPAEHSSLPGRLMPAQAGETYPDARHVVDYLTDYEKRYDLPVQHGTRVDAVRRDAGRLLVEADTGTWRARAVISATGSWSRPFLPAVPGREVFTGRQLHTVNYRSPADFTGQRVIVVGGGNSGAQVAADLALDGRVELTWVTQRPPRFLADDIDGRALFDVATARRRALEEGRSDTGGVASLGDIVAVPPVRQARDAGLLKASPMFVRLEGDGVVWADGTRAEADAVVWCTGFRPALSHLAPLGLRGTRGHIPTAGTRAVDEPRLHLLGYGDWTGPASATLIGVGRPARDAAREIADLLASR

SEQ ID NO: 11390 - protein, 134 aa, Oryza sativa
MADSGARRQPSFTKVDQLRPGTHGHNLLLKVVDSKMVLQRGGGPQGRHMRIAECLVGDETGIIVFTARNDQVDVMKAGASVDLRNAKIDMFKGSMRLAVDKWGIVKAAESPADFTVKEDNNMSLIEFELVTVVE

SEQ ID NO: 11391 - protein, 309 aa, Streptococcus pyogenes
MIYLAGGCFWGVEEYFSQVDGVLDAVSGYANGRGDTTNYQLIHQTGHAETVEVAYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 11392 - protein, 255 aa, Thermoplasma acidophilum
MYIIGAGPGDPDLLTVKARRLIESCDVIIYAGSLVNPEILKLARPGSEIHNSAELNINQIMDIIKDAYERGLDVARIHSGDPHIYGALKDQTSYLEALGIPYEVVPGVSVLTSAAASLGIELTMDGISQAVIIARGSLRIPVPDREQIRKLAEHGSTMVIFTGIHIIDSIVKDLIDGGYSPDTPVGVVYRSTWPDEIVIKGRLSNIATLVHERRIYRTALIIVGDVVDPKFVKHSKLYDPEYVHSFRGVKNGHDR

SEQ ID NO: 11393 - protein, 179 aa, Haemophilus influenzae
MKKHYVDVLISENDVHARIAELGAQITKFYQEKQIDSLVVVGLLRGSFMFMADIVRQINLPVEIEFMTTSSYGTGMTTNHDVRITKDLDGDIKGKHVLIVEDIIDTGYTLEKVRDILNLREPASLTICTLLDKPSRREVEVPVEWVGFQIPDEFVVGYGIDYAQRHRNLGYIGKVVLEE

SEQ ID NO: 11394 - protein, 436 aa, Prochlorococcus marinus [sequence omitted]

SEQ ID NO: 11395 - protein, 333 aa, Triticum aestivum
  misc_feature (241)..(241): Xaa can be any naturally occurring amino acid
  misc_feature (309)..(309): Xaa can be any naturally occurring amino acid
MAAMATTASSLLKPSFSGVRLPAAARTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKEDRVAGVVTNWALVSMNHDTQSCMDPNVMEAKVVVSSCGHDGPFGATGXVKRLQDIGMIQAVPGMKALDMNTAEDAIVRLTREVVPGMIVTGMEVAEIDGAPRMGPTFGAMMISGQXKAAHLALKALRPARTGIRRDAQRT

SEQ ID NO: 11396 - protein, 446 aa, Triticum aestivum
  misc_feature (180)..(180): Xaa can be any naturally occurring amino acid
  misc_feature (249)..(249): Xaa can be any naturally occurring amino acid
MSQFVPDWGNMGDISRPLGEDDDLMELLWCNGNVVMQSQGHRKLPPRPEKVPAPPVVQEDEAGLWFPFALADSLDKDIFQDLFCEEPPGAAGVDGAPRLRSMSLADCGDNAGGVLSDLVQARAGKAAMEEGASSTLSAMGASFCGSNQVQVQGAVSDHGRAGHATAYGGGGAGSALPSAXWGAEMQTPEAGATRPPWPPRRAGPTTASASPPPLAPSRRARATGAASASGGWTRRTRRAPARTPSRSRXALERKPPQKLTTARRSRAAEVHNLSERRRRDRINEKMRALQELIPHCNKTDKASMLDEAIEYLKTLQMQVQMMWMGSGMAPPAVMFPGMQMHQYLPQMGPPSMARMPFMAPPQQGHGVSLPEQYAHFLGVNPHHLQPPAHHHHHQHFAQGLGYYPLGAKALQQSPALHHVSNGNAGGGTPAATANATPGNAIHPNKR

SEQ ID NO: 11397 - protein, 385 aa, Flaveria bidentis
SVTSSDQIQAPLPAKQKPECFGVFCLTYDLKAEEETKSWKKIINVAVSGAAGMISNHLLFKLASGEVFGPDQPISLKLLGSERSFAALEGVAMELEDSLYPLLRQVSIGIDPYEIFQDAEWALLIGAKPRGPGMERADLLDINGQIFAEQGKALNAVASPNVKVMVVGNPCNTNALICLKNAPNIPPKNFHALTRLDENRAKCQLALKAGVFYDKVSNVTIWGNHSTTQVPDFLNAKIHGIPVTEVIRDRKWLEDEFTNMVQTRGGVLIKKWGRSSAASTAVSIVDAIRSLVTPTPEGDWFSTGVYTNGNPYGIAEDIVFSMPCRSKGDGDYEFVKDVIFDDYLSKKIKKSEDELLAEKKCVAHLTGEGIAVCDLPEDTMLPGEM

SEQ ID NO: 11398 - protein, 84 aa, Zea mays
MGRRPARCYRYCKNKPYPKSRFCRGVPDAKIRIFDLGRKKAKVDEFPLCGHMVSDEYEQLSSEALEAARICANKYMVKSCGKDG

SEQ ID NO: 11399 - protein, 246 aa, Saracha punctata
SGTIVCGKGMSLIFVGTEVGPWSKTGGLGDVLAGLPPALAARGHRVMTISPRYDQYKDAWDTSVAVEVKVGDSIEIVRFFHCYKRGVDRVFVDHPMFLEKVWGKTGSKIYGPKAGQDYLDNELRFSLLCQAALEAPRVLDLNCSKYFSGPYGEDVLFIANDWHTALIPCYLKSMYQSRGIYVNAKVALCIHNIAYQGRFAFSDFSLLNLPDEYRSSFDFIDGYEKPVEGRKINWMKAGILESHRVV

SEQ ID NO: 11400 - protein, 123 aa, Thermoactinomyces vulgaris
MATFGAGCFWGVEETFRQVPGVIDTAVGYMGGTTENPTYEEVCTDKTGHAEVVQVEYDPEQVSYEELLNVFWDNHNPTTLNRQGPDVGTNIARLFFTTLKSKEIPQKNPKRKWIKAGVGKIRL

SEQ ID NO: 11401 - protein, 356 aa, Aggregatibacter actinomycetemcomitans
MKKSKLVVALAAILSCAAIPTTVMAESNVQQTMEKSNMSEAKKDLHEIYLAGGCFWGIEAYMERIYGVEDAISGYANGKSDKTNYQKIGITDHAETVKVTYDRNKVSLDKLLKYYFQVIDPTSVNKQGNDRGRQYRTGIYYQDTADKSIIEKEITALQGKYKNKIQIEVEPLHNYIVAEEYHQDYLKKNPNGYCHIDLEQANYVIIDEKDYPKPSDAELKAKLTPLQYSVTQNKNTEHSFSNEYWDNFKPGIYVDVTTGEPLFSSKDKFESGCGWPSFTKPITKEVVTYQDDHSFNMLRTEVISRSGKAHLGHVFDDGPKDKGGLRYCINSAAVKFIPLEDMVKENYGYLTNAVKE

SEQ ID NO: 11402 - protein, 317 aa, Oryza sativa
  misc_feature (276)..(276): Xaa can be any naturally occurring amino acid
MATAGDEQQQQAAAAQTAEVTEAAAKEVVSVEMPAPEGWTKKKLVKCPLKVPFLKLFTPQRGGRFEIVFVSPTGEEIKNKRQLSQYLKAHPGGPASSEFDWGTGDTPRRSARISEKVKAFDSPEGEKIPKRSRNSSGRKGKQEKKEATENEEAKDAEADKEAPSEDAPKETDVETKPAEEAKEAPSEDAPKDTDVEMKTAEDASKTADADTPAPAPAGTEKEDAKPAESEAAPPAPSEGGEKKEDAKPAEPEAAAAPPSNPTEPSAPKAAAAAPVXTPRTKALIQDSQPPSAAAPAKESSPVNNGQLPAGASAVKCT

SEQ ID NO: 11403 - protein, 217 aa, Corynebacterium melassecola
MAWFFAPEPVMVTADEALKGGRHTVLENPAPHTVLGTPVTGPWKEGQQRIWIGLGCFWGVEQMYWQMDGVEGTSVGYAGGFTPNPTYREVCSGRTGHTEIVEVVYDPSKISLEQLVARGLEAHDPTQGFRQGNDVGTQYRSAYYTENEEGAARVKAVVDAYGETLKQHGFGEITTEIGVISPSEYFLAEDYHQQYLDKNPDGYCPHHSTGIPCGVEA

SEQ ID NO: 11404 - protein, 487 aa, Methanococcoides burtonii
MHKQIKKCLLMMPPATTSKDNIDINPLPPIGLGYIASVIEKLGVEVKIIDCLMEGWNQREEIGDGLIRIGLSENQIRDIISDYQPDLVCVNNQFSKQYENAHLIYRLVKEVDSNIITQAGGGHPSVMPKETLQDQNLDFVVLGEGEIVVECFLRCLLNKDDDYSKIDGLGYKIDGQIIINPKTTYIEDLDSLQFPALHLMNLEHYFGLDMSHGKRHSKRFYPIITSRGCPAKCTFCTAYRVWGRKYRHRSPENVIEEMKYVKEKYNIEELLIEDDNFTANPKRAEKICDLMIENKFNFKWDTPNGIAAFALNEKLIRKMKNAGCYKINIAVESGNQNTLNNIIKKPLKLEKVEEIVNICRKVDIDFGIFLILGMPGDNLEAMWDNYKFARKIKVFDPFISVATPYPGSEIFDICESKGYFSEEFKLENLFIRSFPIRTEQWTPEDIQKLMKKGYIYLKFYQFLDNPFNFTRLFAGFVLEKAKRTLNL

SEQ ID NO: 11405 - protein, 496 aa, Unknown
  Mycobacterium sp. JLS
MRVERLQTFASTLPADDDHPYRTGPWRPQVTEWRADDLEVVAGEVPADLDGMYLRNTENPLHPAATAYHPFDGDGMIHIVEFGGGKAAYRNRFVRTDGFLAENEAGGPLWAGFIEMPSAAKRTDGWGARTRMKDASSTDVVVHRGTALTSFYMCGDLYQVDPYTADTLGKETWHGDFPDWGVSAHPKVDPVTGELLFFSYSKEAPHLRYGVVDKDANLVHHTDVALPGPRMPHDMAFTENYVILNDFPLFWEPSLLKQDIHAPVFHRDMPSRFAVLPRRGDQSQVRWFETDPTYALHFVNAYEDGDEIVLDGFFQDNPSPSTKGAKSLEDAAFRYLALDGFESHLHRWRFNLATGAATEERLSDSLTEFGMMNGDYQTRRHRYVYAATGKPGWFLFDGLVKHDLRDGTEERITFGDGVFGSETAMAPRQDGTAEDDGYLVTLTTDMNDDASYCLVFDAARIADGPVCKLRLPERICSGTHSTWVSGAELRRWHSPR

SEQ ID NO: 11406 - protein, 556 aa, Unknown
  Synechococcus sp. WH 7805
MPKQQRWWNGAVIYQLIVRSYADGNGDGVGDLQGLSSRLPYLRWLGVEAIWLTPVYPSPLQDGGYDITDFKAIHPDLGDLAAFHRFLTAAHGHGLKVVMDLVLNHTSALHPWFQRARWAPQGTPEREVYVWSDDPHRYADAPVLFRHFESSNWEWDDVAGQYYLHRFLRHQPDLNYANPLVQDEMLEVVDFWIERGVDGFRLDAVPFLCEEENSRCEGLPETHAFLKRLRERVDSHGRDVLLLAEAIQPVQEAAPYLADDELHGAFNFVLTAHLFAAIASGSTEHLRQCLQDAQDAVCGCRWALPLRNHDELWLGDGHLIPEEVIQIIRAGLHQGQGHWLNWGINRRLAPLLNGDPGSNRVLHGLLYSLPGMPCLYYGDELGMGDWPGLRDRDPNRTPMAWTPARNGGFSSAPDPLLVLPPITAPGYDYRVVNVEVQKQLPGSLLNWHRRMLTCRRLLPALRHGDFELLPSVHPSVISYVRCDGSMTVLVAANLSAAGASLQLDLSRWEGERTREVMWGCEYPPASAGWFVYLPAHGFNWWLLGEVEEQNEALQDS

SEQ ID NO: 11407 - protein, 73 aa, Sinningia canescens
ISGTNGEVMPGQWEFQVGPSVGIEAGDHIWCARYLLERITEQAGVVLSLDPKPMEGDWNGAGCHTNYSTKSMR

SEQ ID NO: 11408 - protein, 442 aa, Unknown
  Sphingomonas sp. KA1
MTPEQNDLLCRVEGNAPMGRLMRQHWLPACMIEEVAEPDGTPLRVRLLGENMVVFRDSEGRIGALDELCPHRRASLAFGRNEECGLRCLYHGWKFDVNGNALDMSSEPADAKLRETMKTKAYPVREAGGFVWVWMGDTDNVLPFDPPNWTAAPADKISIVKMHGACNWAQILEGSIDSAHSSSLHSTNMPTATEVSGSTATDSAWLRPSADKAPRIEVQKTPFGFRYVAIRKPIVEPDKQDYVRMTLFVAPYTVHIPSNDQYHLSQMLVPVDDENTMFYWIAWHPEKGISQDAWRKFCGAELGQDVEPVTFKKIRNAENNYLQDRAAMKAGDFTGIYGIPAQDMAMWESMGPIADRSEDRLGSSDKAIFTFRTLMYRAAQAVERGEPAIGTGESRIPHAKLMSFEGMVPKGDDWRLLNVSDEERRLSSAAEDKGDLVEDLAG

SEQ ID NO: 11409 - protein, 289 aa, Lycium fremontii
EKVWGKTASKIYGPKVGQDYADNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGV

SEQ ID NO: 11410 - protein, 381 aa, Photobacterium profundum
MNKHIVIIGSGFAAYQLVKSLRKQNELTPITVITADNGDDYSKPDLSHVFSQQQTANDLIKQEADDFARSNNITLMPNTRVKAIDSTKQVVHFNDQCIGYSELVLATGATSFVPPFSGNGTDEIVTLNSLMEYEEQQDKLATAKSVLVLGAGLIGTEIAMDLATSGKKVTLLDRATSLMPTLLPSFISANLYQTMQEKGVDIKLGKEVKTITRHHQELIVTLQDDSYQHADVIIAAMGLAPNTQLAQESGIDVAKGILVNQHMQTSINNIYALGDCAELNGKVRAFLQPTMLSAMALAKTLLGSPTPVQLPASLVKVKTPWLPLHLSGDTTSDNLMWEVKQEPEGLVAKAFNQTTGDLAGFIVSHNQLKAAFPLLRLLPVE

SEQ ID NO: 11411 - protein, 356 aa, Triticum aestivum
  misc_feature (142)..(142): Xaa can be any naturally occurring amino acid
MASPATPRPALIRPRASRSRSQLGAVSLASDHAAATASSGRRRDYVFVVNPSGANGRTGKQWKQLLPFLHTRLADQCNICECITSGPSHAIDVTREAIKDGADAVIAVGGDGTLHEVVNGFFWKGSPVRALDRGPDHLTALXGLFPFGEGSNFAWKFGWSNPRVRAIDRIVRGVKSKLDIGMMEGPNGDPHFFINVADIHLSAKAGYFASMYKRFGNLCYVLGALRGFWGHTNRDLRIKVNGGEWRTVDKVTALCVGNAKYFGGGMKITPTVDPFSGDLQLVIIQDFKWYSFLLKLHRLYGGTHLTVNGVSSIRVQSVEVAEVVPNGDVFVQSDGEHFGFLPTKFSVLPGAVDFFS

SEQ ID NO: 11412 - protein, 153 aa, Oryza sativa
MAPKAEKKPAAKKPAEEEPAAEKAEKAPAGKKPKAEKRLPAGKGEKGSGEGKKAGRKKGKKSVETYKIYIFKVLKQVHPDIGISSKAMSIMNSFINDIFEKLAGESAKLARYNKKPTITSREIQTAVRLVLPGELAKHAVSEGTKAVTKFTSS

SEQ ID NO: 11413 - protein, 514 aa, Photobacterium profundum
MSIHVKNNIHWVGQRDWEVRDFHGTEYKTLKGTSYNSYLIREGKNVLIDTVDHKFSYDFVQQLEQEIDLNEIDLIVINHAEEDHAGALSVLLSKIPNTPIYCTENAIDSITGHHHHPEWNFNVVKTGDSIDIGNGKSLVFIETPMLHWPDSMMTYMTGDAVLFSNDAFGQHYCDERLFNDEVEQNELMEQCLRYYANILTPFSPLVTAKIHEVLSFNLPVDMVATSHGVIWRDNPTQIIEQYLEWANEYKEDKITIFYDSMSNNTRMMADGIAQGITETDPNVAVKIFNVSRHDKNEILTNVFGSKGILVGSSTMNNVMMPKVAGMLEEITGLRFKGKKAGAFGSYGWNGGAVDRIHSRLTDAGFFTTVGLKTKWRPDSNAMEECREHGRKIAREWALQPLTVATTRAVINELNVAPRSVVASQSVVTPQPVVETVTPATNEAAVVQQEVTSTTTASSTDQKQKQICTVCQWIYNPELGEPNQGVEPKTAWEEVPDSFLCPECGIGKQVFEPTN

SEQ ID NO: 11414 - protein, 332 aa, Myxococcus xanthus
MRSYVDAFSPYWHPVAFSSELTAVPLPVHLLGTELVLWRTGSGVAVTHRRCAHRGADLSVGVVTPEGLRCGFHGWTYGSDGRCVRVPSQPAAPIPARARVSAFQATERYGLVWVCLSPEPAAPLPEWPELEDGALATVPLPVLEWDVAAGRMIEVVLDVAHLSFVHEGTFGNPEQPEVLPYEVERRATGVGARIVYPALAPATDGMPPRVDRTTLTYDVTLPFAAKLAFKPTLFYVHTVYAIASPLSEEKMRCFYFASYHPRLRNHFPDMFVKSELAILEQDRRTLEGVRPRAQPLDFASEVHTPADRLPIEYRRGVIALRLGKPVDGPAPE

SEQ ID NO: 11415 - protein, 269 aa, Saccharum arundinaceum
MAVLQVAAAAPPPVSAIGFEGYEKRLEISFSEAPVFADPNGRGLRALSRAQIDSVLDLARCTIVSELSNEDFDSYVLSESSLFVYPYKIVIKTCGTTKLLLAIPRILELAKELSLPLAAVKYSRGTFIFPDAQPSPHKNFADEVTFLNRFFGGLKSGGNAYVIGDSAKPGQKWHVYYATEHPEEPVVTLEMCMTGLDKKKASVFFKTSADGYTSCAKEMTKRSGISDIIPEMEICDFDFEPCGYSMNAAHGPAFSTIHVTPEDGFSYAS

SEQ ID NO: 11416 - protein, 318 aa, Rickettsiella grylli
MNKVQNHRLIILGSGPAGYTAALYAARANLKPVLITGLQKGGQLMTTTDVDNWPGDEEGLQGPALMERMYQQVQRFNSHIIFDHINQVDLSKNPFSLKGDGTLYHCDALIIATGASAKYLGLPSEKEFMGRGVSACATCDGFFYKGQKVAVIGGGNTAVEEALYMANIAEQVFLIYRKSKFFRPEEILLDKLMAKVNAKKISLMFDTEIDKILGDEKGVNGIKLFNNKTKATSQLDVQGVFIAIGHNPNTTIFKNQLDMENNYILVRGGNKGFATATSKKGVFAAGDVMDSVYRQAITSAGTGCMAALDAEKYLSENP

SEQ ID NO: 11417 - protein, 308 aa, Trichodesmium erythraeum
MAGTNINTDLYFTEQITPWDIYKHGIDQVLVYQKTKYQEIYIVKGVYGKALILDGKWQSCTADEFLYHEGLVHPAMICHGSPRKVLVFGGAEGATIREVLRWKTVEQVVMVDIDEKVVEACKKYLPEMHQNSFEDPRVELIIDDAQNFLDSSNETWDVIISDLTDPIEHGLSFPLFTQEYFQKISQVLSALGSFIIQGGSISPAEMYLHARVVKTLQSVFNCVYSLIPYSTSYGCPLGFVVCSEQKFSSTPNPEKVDRLLAEKTTGGFKFMDGVSLLGMLQIPLNLRQAIATETQIYTLKTPPKSIQV

SEQ ID NO: 11418 - protein, 316 aa, Haemophilus influenzae
  misc_feature (42)..(42): Xaa can be any naturally occurring amino acid
MAIYADNSYSIGNTPLVRLKHFGHNGNVVVKIEGRNPSYSVXCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 11419 - protein, 923 aa, Avena sativa
MASKGAGGGGGGHEEPQRPKQQLPRDSRGSLEVFNPSSSSAAVEPPSAFRPAARSASPFIEEATGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALANGSNYCGRVLNYKKDGTAFWNLLTIAPIKDEEGRVLKFIGMQVEVSKYTEGNKDTVVRPNGLPESLIKYDARQKDQARSSVSELLLAIKNPRSLSESTNSTFKRKSQESVGALTGDRPGKRSSESGSRRNSKSGARTSLQKISEVPERGSKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPIFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDDTDKGMGDAAAADTHTDMF

SEQ ID NO: 11420 - protein, 267 aa, Methanocaldococcus jannaschii
MVNLMNIKDIKLNADETKTTKAILKASFDMWLDIVEADVVIVGAGPSGLTCARYLAKEGFKVVVLERHLAFGGGTWGGGMGFPYIVVEEPADELLREVGIKLIDMGDGYYVADSVEVPAKLAVAAMDAGAKILTGIVVEDLILREDGVAGVVINSYAIERAGLHIDPLTIRSKVVVDATGHEASIVNILVKKNKLEADVPGEKSMWAEKGENALLRNTREVYPNLFVCGMAANASHGGYRMGAIFGGMYLSGKLCAELITEKLKNKE

SEQ ID NO: 11421 - protein, 927 aa, Avena sativa
MASKGAGAGGGGGGGDGYDEPQRPKQQLPRDSRGSLEVFNPSSSAVEPPSAFRPAARSASPFIEEVAGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALADGSNYCGRVLNYKKDGTAFWNLLTIAPIKDEEGRVLKFIGMQVEVSKYTEGNKDTAVRPNGLPESLIKYDARQKDQARSSVSELLLAIKNPRSLSESTNSTFKRKSQESVGPLTGDRPGKRSSESGSRRNSKSGARTSLQKISEVPERGNKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPVFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDGTDKGLGDATAAADNHTDMF

SEQ ID NO: 11422 - protein, 398 aa, Unknown
  Nocardioides sp. JS614
MSPTPSSARALDRGTPPERFARGWHCLGLKSTFADGKPHGVEAFGGKLVVWQDSKGEINALDGYCRHMGGDLTQGSVKGDEVACPFHDWRWGGDGRCKAIPYARRVPLRARTERYPVVVRNGQVLVWHDVEGSEPDLDILPPELPGIGTDEYTDWTWEVLDVANAHCREIIDNVVDMAHFFYIHFAFPTSFRNVFEGQVATQFMESTGRPDVDGAGYGDEGLMLKSEASYYGPSYMINWINVDYKGFETEVILINCHVPTSQNSFKLQYGLCVKKPDGIDDATAEYIGKRYSETFKEGFEQDVAIWLNKAPVQNPLLCEEDGPVYQLRRWYEQFYVDQDDVTPEMTERFEFEVDTTKANEHWRAEVEENLARKSAEDAASQDAGAQDTDVTPPIMTGT

SEQ ID NO: 11423 - protein, 366 aa, Unknown
  Nocardioides sp. JS614
MATEESFELKVVDVVEETADAHSVSFEAPAGAEEQFAYKPGQFLTLAVPSDQTGVAARCYSLSSSPVDGGPLTITVKRTAEGFASNWICDNVREGDTVRALPPSGIFTPASLSADLLLFAAGSGITPIMSITRTALQQGTGRIVLLYANRDERSVIFADALTRLSAEHPDRLVVVHWLESVQGLPTQEQVEAFAGGFLSYDAFVCGPAPFMKLVVGALKELEFPRERRHQEKFISLGGNPFGDLHDQEAAQHEIEDAETDAEDVGADGDAGQPEGPVRLEVELDGEEYAFDDWAPGTKLLEHLEAKGIKAPYSCREGECSACAVRLLEGEVKMLHNDVLDADDLADGIRLGCQSVPVTDVVKVTYH

SEQ ID NO: 11424 - protein, 324 aa, Unknown
  Streptomyces sp. FR-008
MSEIREVVIIGSGPAGYTAALYTARAQLRPVLFGSSIFVGGSLTTTTEVENFPGFPEGVDGPVLMENMRAQAEKFGAEMIDDDIVAVDLTGDIKLLTDSAGTVHRAKTVIIATGSGFRKLGLPNEDELSGRGVSWCATCDGFFFRDRDIVVVGGGDTAMEEATFLTRFAKSVTVVHRRSTLRASKVMQDRAFSDDKISFAFDSEIAEIKDTGGMLGGVVLRDVLTGATRDLDVTGLFIAIGHDPRTELFTGQVELDDEGYIKVDSPSTRTNLPGVFAAGDVVDHIYRQAITAAGTGAAAALDAERYLAARGVAQTEPATAAVPV

SEQ ID NO: 11425 - protein, 339 aa, Prochlorococcus marinus
MSSFQSAPGTVLITGTTSGVGLYATKALIDLGWKVITANRSPERAEKAAVKLGLPFRCPKQLQHISIDLSDLDSVSKGVKDLLDKLDEPLDALVCNAAVYMPRLSKPRRSPQGYELSMATNHFGHFLMIQLLLENLSKSKRPVWKGRSWGIESSRLVMLGTVTANYKELGGKIPIPAPADLGDLSGFKEGFLDPICMASGKRFKPGKAYKDSKLCNMITIQELHRRFKDSSVVFSSLYPGCVANTKLFRNTPKIFQWLFPLFQRFVTGGFVSQPLAGKRVAQVVSSPEFGISGVHWSWGNRQKKNGEQFSQKLSERITDPETASDVWDLSMKLAEVNVK

SEQ ID NO: 11426 - protein, 1031 aa, Unknown
  x Tritordeum sp.
MERARRLASRALLRRLLAASSSATSPAPSRGVSTLAPKPAAGSRPRARPAHQYTPGCPVSVSALQPSDTFPRRHNSATPAEQAVMASECGFNTLDALIDATVPAAIRAPPMQFTGKFDAGFTESQMLEHMAHLASMNKTYKSFIGMGYYNTHIPAVILRNLMENPAWYTQYTPYQAEIAQGRLESLLNYQTMVADLTGLPMSNASLLDEATAAAEAMAMCLGIVKSKKKTFLIASNCHPQTIDICQTRATGFDINVVVSAAKDFDYSSGDVCGVLVQYPGTEGEVLDYAEFVKDAHAHGVKVVMATDLLALTTLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPAGLKAIADRVHGLAGTFAHGLKKLGTVTVQELPYFDTVKITCADANAIAEEARKNEMNLRVVDANTITVAFDETTTLEDVDKLFKVFSGGKPVDFTAESIAPEVSSSIPPSLVRDSPYLTHPIFSMYHTEHELLRYLHKLQSKDLSLCHSMIPLGSCTMKLNATVEMMPVTDPKFANMHPFAPIDQAAGYHEMFDNLGDLLNTITGFDSFSLQPNAGASGEYAGLMVIRAYHKARGDHHRNVCIIPVSAHGTNPASAAMCGMKIVAVGTDAKGNINIEELRKAAEANKDNLSALMVTYPSTHGVYEEGIDEICRIIHENGGQVYMDGANMNAQVGLTSPGFIGADVCHLNLHKTFCIPHGGGGPGMGPIGVKKHLAPFLPSHPVIPTGGFPLPEKTDPLGSISAAPWGSALILPISYTYIAMMGSQGLTEASKIAILNANYMAKRLEKHYPVLFRGVNGTVAHEFIIDLRGFKATAGIEPEDVAKRLMDYGFHGPTMSWPVPGTLMIEPTESESKAELDRFCDALISIREEIAEVENGKADAHNNVLKGAPHPPQLLMGDAWTKPYSREYAAFPAAWLRGAKFWPTTCRVDNVYGDRNLICTLQQASQVAEEAAAATA

SEQ ID NO: 11427 - protein, 250 aa, Brassica juncea
MTKSYPTVSEDYQKAIEKCKRKLRGLIAEKNCAPIMVRLAWHSAGTFDCASKTGGPFGTMRFDAEQGHGANSGIHIALRLLDPIREQFPAISFADFHQLAGVVAVEVTGGPEIPFHPGREDKPQPPPEGRLPDATKGCDHLRQVFTKQMGLSDKDIVALSGAHTLGRCHKDRSGFEGAWTSNPLIFDNSYFKELLTGEKEGLLQLVSDKALLDDPVFRPLVEKYAADEEAFFADYAEAHLKLSELGFADA

SEQ ID NO: 11428 - protein, 347 aa, Unknown
  Fragaria x ananassa
MDFSYTTLKNTFMAPILLLLVLFMPALQITGAQSAGVCYGRNGNNLPSDTEVVDLYKSNGIGRMRIYEPNQATLEALRGSNIELMVTILNNNLQALTDAAAATDWVQKNVQPYSADVKFKYIAVGNEVHPDAAEAKYLLPAIQNIQNAVTAANLQGQIKVSTAIDTTFLPPDFVLPSNGAFSDAANSFITPIITFLSNNGAPLLVNIYPYFAYIGDPVNIKLEYALFTSPGVELQDGSNGYQNIFDALLDTHYSALEKAGAPNMAIVVSESGWPSEGGDAATTGNAGTYYSKLINHVKTGTPKRPNGAIETYLFAMFDENLKDGAEVEKHFGIFSPNKQPKYQLTFG

SEQ ID NO: 11429 - protein, 637 aa, Unknown
  Petunia x hybrida
MMESCDCIEALLPHDDLLVKYQYLSDFFIAFAYFSIPLELVYFVHKSSCFPYRWVLMQFGAFIVLCGATHFISLWTFFMHSKTVAVVMTITKMLTAVVSCITALMLVHIIPDLLSVKTRELFLKARAEELDKEMGLIIRQEETGRHVRMLTHEIRSTLDRHTILKTTLVELGRTLDLAECALWMPCQGGLNLQLSHNLNNLLPLGSTVPTNLPIVNEIFSTTQAIQIPHTNPLARMRTTAGRYIPPEVVAVRVPLLHLSNFHINDWPELSARSYAVMVLILPMNGLRKWRDHELELVQVVADQVAVALSHAAILEESMRAHDQLMEQNIALDVARQEAEMAVRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPVLAVGDAKRLIQTLLNVAGNAVKFAKEGHISIEASVAKPEYARDSHPPEVYPMPSDGQFYLRVQVRDSGCGISPQDIPLVFTKFAEAQSTSNRSTGGAGLGLAICRRFIQLMKGNIWIESEGLGKGTTVTFVVKLGVCNHPNAMPLLPTVPRSRLNQGSDDLFRYRQFHGDDSAMSVTVQRYQRSL

SEQ ID NO: 11430 - protein, 250 aa, Brassica juncea
MTKSYPTVSEDYQKAIEKCKRKLRGLIAEKNCAPIMVRLAWHSAGTFDCASKTGGPFGTMRFDAEQGHGANSGIHIALRLLDPIREQFPTISFADFHQLAGVVAVEVTGGPEIPFHPGREDKPQPPPEGRLPDATKGCDHLRQVFTKQMGLSDKDIVALSGAHTLGRCHKDRSGFEGAWTSNPLIFDNSYFKELLTGEKEGLLQLVSDKALLDDPVFRPLVEKYAADEEAFFADYAEAHLKLSELGFADA

SEQ ID NO: 11431 - protein, 138 aa, Unknown
  Fragaria x ananassa
MDFSYTTLKNTFMAPILLPLVLFMPALQITGAQSAGVCYGRNGNNLPSDTEVADLYKSNGIGRMRIYEPNQATLEALRGSNIELMVTILNNNLQALTDAAAATDWVQKNVQPYSADVKFKYIAVGNEVHPDAAEAKYL

SEQ ID NO: 11432 - protein, 317 aa, Unknown
  Acidovorax sp. JS42
MSTTQHAKVMILGSGPAGYTAAVYAARANLNPVLITGLAQGGQLMTTTEVDNWPADVHGVQGPELMQRFQEHAERFKTQIVFDHISQVDLSKRPFTLTGDSGTYTCDSLIIATGASAKYLGLPSEEAFMGKGVSACATCDGFFYREQDVCVVGGGNTAVEEALYLSNIARKVTLVHRRDKFRAEPILIDKLMEKVAAGKIELKTFFTLDEVLGDATGVTGIRLKHTEDGHTEDIALQGCFIAIGHAPNTDIFQGQLAMENGYIVTQGGLKGFATQTSVPGVFAAGDVQDHVYRQAITSAGTGCMAALDAQRFLEQQE

SEQ ID NO: 11433 - protein, 531 aa, Shigella flexneri
MMMFKAQEINMLDTNMKTQLKAYLEKLTKPVELIATLDDSAKSAEIKELLAEIAELSDKVTFKEDNSLPVRKPSFLITNPGSNQGPRFAGSPLGHEFTSLVLALLWTGGHPSKEAQSLLEQIRHIDGDFEFETYYSLSCHNCPDVVQALNLMSVLNPRIKHTAIDGGTFQNEITDRNVMGVPAVFVNGKEFGQGRMTLTEIVAKIDTGAENRAAEELNKRDAYDVLIVGSGPAGAAAAIYSARKGIRTGLMGERFGGQILDTVDIENYISVPKTEGQKLAGALKVHVDEYDVDVIDSQSASKLIPAAVEGGLHQIETASGAVLKARSIIVATGAKWRNMNVPGEDQYRTKGVTYCPHCDGPLFKGKRVAVIGGGNSGVEAAIDLAGIVEHVTLLEFAPEMKADQVLQDKLRSLKNVDIILNAQTTEVKGDGSKVVGLEYRDRVSGNIHNIELAGIFVQIGLLPNTNWLEGAVERNRMGEIIIDAKCETNVKGVFAAGDCTTVPYKQIIIATGEGAKASLSAFDYLIRTKTA

SEQ ID NO: 11434 - protein, 773 aa, Cryptococcus neoformans
MNTHLAARLQHLASSYPPHTALFYARIWHTLAPTTDSNHDSLHALALAFLQAAEPYSAIHLVRDHTGLDNLDLDLEIRFERTDKVCGGCAMIVARCCEKLGRYSEGQAVLARALKRGANISRFGCNVDEYPVLTLDRFSIACTLIECCNGISTPGQPVTQRKALDEDPWMWEAFTNLCDVGRLKSFDVSLFQPIRELTKHSQGAPPPIESLFPAGAGLSLSRHASRSSRPPLSPNIHRQKSPIEPAPGVLRLHQAQAGAGNSGGLFTPDVEGIGGKTGLGMMGNPSSWDSSSIIGDTTFAVPEQPTKRPFPSFMSTATSFLPSSLRGGTSTPAGSDSPPKLPTMKRPRGKDPVKRPMETPQSQMSSGLPLAKELRPNGAKYEDSDAPRRSSRLKTTTSKPAPKIPRDPHATRSRSVTSSNSNNEVPSPPSLTSQDAILQREADEYLKDIVKKCARVYKSLSRYQCQQAIKEVDALPGELKTSPWAMEILGRAFYEIANYAMARRAFTFLQQQEPYRIQSMEQLSTLLWHLTDLPALSHLSQSLISISRSSPQAWIAVGNCFSLQKDHDEAMRCFRRATQVDEGCAYAWTLCGYEAVEMEEYERAMAFYRTAIRTDARHYNAWYGMGLVYLKTDRPRYAEHHFRRAVEINPTNPVLLCCVGMALEKSDDVVQALHFYERASKYAPTSAMVQFKRIRALVALQRYDEAISALVPLTHSAPDEANVFFLLGKCLLKKERRQEATVAFTNARELEPKLEGVINAVLAANGEEGEDEE

SEQ ID NO: 11435 - protein, 216 aa, Vassobia breviflora
  misc_feature (10)..(12): Xaa can be any naturally occurring amino acid
  misc_feature (187)..(187): Xaa can be any naturally occurring amino acid
  misc_feature (200)..(200): Xaa can be any naturally occurring amino acid
GKGMSLIFVXXXVGPWSKTGGLGDVLAGLPPALAARGHRVMTISPRYDQYKDAWDTSVAVEVKVGDSIEIVRFFHCYKRGVDRVFVDHPMFLEKVWGKTGSKIYGPKAGQDYLDNEVRFSLLCQAALEAPRVLDLNCSKYFSGPYGEDVLFIANDWHTALIPCYLKSMYQSRGIYVNAKVAFCIHNXAYQGRFAFSDFSXLNLPDEYRSSFDFIDG

SEQ ID NO: 11436 - protein, 204 aa, Fulvimarina pelagi
MIRRFTPVLFAAAATTSFAFSVPSSAQNTETAIFAGGCFWCVEADFDHVDGVSETISGYIGGQSENPTYQNHSGHVEAVRITYDPSKVSYDELLEVFWHSIDPTDGGGQFCDRGPSYTTAIFATNSEQMQKAQATKAEASQDLGSIATEIREASTFWTAEGYHQDYYKKNPVKYKFYRNGCGRNDTVRRVWGDKAFMGIKEAVS

SEQ ID NO: 11437 - protein, 525 aa, Ralstonia solanacearum
MPTPPPDALDASPQPVNRGNALLVLAVFVVASCGLAYELIAGALASYLLGDSILQFSSIIGAYLFAMGIGSWVSRYVADDALLARFVDLELLVGLFGGVSAAALFLLFALESAPFRLVLYALVTVIGVLVGMEIPLVMRMLHRRQAKFSDLVSRVLTFDYLGALAVSLLFPLVLAPRLGLVRTGFLFGLCNTAIAVWTLWHFRAELGLSARLRGAMAWRAGMVGAALLAGFAASDRLTHWSERALFGDEIIHAISSPYQRLVVTRWKDDLRLYINGNLQFSSRDEYRYHEALVLPALESVRGARRVLVLGGGDGLALRQILKYPQVEHVTLVDLDPRMTSLFSHAEALVALNQHAFSDPRVTVVNADAGQWLQTAADMFDVAIVDFPDPSNFSIGKLYSVPFYRLLSRHVADTGLVVIQATSPYFAPRSYWCVDATLKEAGYRTWPYHALVPSFGEWGFILAAPGRADFRPPTTYRVPTRFLDADTTHQMFSFAPDMPRPQVEPNRLNNQSLVRYFEEDWHGVLR

SEQ ID NO: 11438 - protein, 352 aa, Arabidopsis thaliana
MGSNFHYTIDLNEDQNHQPFFASLGSSLHHHLQQQQQQQQHFHHQASSNPSSLMSPSLSYFPFLINSRQDQVYVGYNNNTFHDVLDTHISQPLETKNFVSDGGSSSSDQMVPKKETRLKLTIKKKDNHQDQTDLPQSPIKDMTGTNSLKWISSKVRLMKKKKAIITTSDSSKQHTNNDQSSNLSNSERQNGYNNDCVIRICSDCNTTKTPLWRSGPRGPKSLCNACGIRQRKARRAAMATATATAVSGVSPPVMKKKMQNKNKISNGVYKILSPLPLKVNTCKRMITLEETALAEDLETQSNSTMLSSSDNIYFDDLALLLSKSSAYQQVFPQDEKEAAILLMALSHGMVHG

SEQ ID NO: 11439 - protein, 164 aa, Glycine max
  misc_feature (94)..(94): Xaa can be any naturally occurring amino acid
MAAASASSMISTPALSPTIQKHHHLKPSNVCFQGLRPLARFTKASSTKVSTTTKRVIPKGGVRAELNSALVISLSTGLSLFLGRFVFFNFQREXNVAKQVPEQNGLTHFEAGDTRAKEYVSLLKSNDPVGFNIVDVLAWGSIGHVVAYYILATTSNGYDPAFFG

SEQ ID NO: 11440 - protein, 378 aa, Lycium macrodon
ISPRYDQYKDAWDTSVAVEIKVGDSIETVRFFHCYKRGVDRVFVDHPMFLEKVWGKTASKIYGPKVGQDYVDNELRFSLLCRAALEAPRVLNLNCSKYFSGPYGEDVLFIANDWHTALIPCYLKSMYQSKGIYLNAKVAFCIHNIAYQGRFSFSDFSLLNLPDEYRSSFDFIDGYEKPIKGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSRFEPCGLIQLHAMRYGT

SEQ ID NO: 11441 - protein, 291 aa, Unknown
  marine gamma proteobacterium HTCC2080
MLTVLSAIPKHIVITGPTAGIGRATALSLALQGAQLTLLCRNLNKGLAVSEVIESAGGLKPHLVQVDMASLQSVRIAAASVLDLGLPIDVLLNNAGLINSYRRETPDGFEETLAVNHFAPFLLTGLLLPAILNAAPGARIVNVASGAHSFVKGMGFDDIQLQQSYKMFEAYGRSKLANILFTRTLSQRLAEKGVTVNCLHPGAVATDIGKQHGELIAKIIPILLKPFFRGPQKGAETSIYLCTDDKVADQTGGYWYNCKLTKVKPWAKDDAQAQRLWNYTQDTLGYQYPQL

SEQ ID NO: 11442 - protein, 575 aa, Clostridium thermocellum
MKLEAIYHKPYSEFAFPVAPDTLVIRLRTAKNDVNTCILIYHEKYDTSQRGKVKMDKVASDGMFDYYEVELNVGIKRIKYMFYLEDNYSIKWYSSDGFFDYMPQWGHFTYSYICKDDIFHEVEWFRNSTIYQIFPDRFAKFPPDTENSGKRTIHGGNIKGIIDRFDHLVKLGVDVVYLNPIFKSESYHRYDVVDYYEIDPMFGSKEELRELMDLCHKNGIKVIFDGVFNHSGDKFFAFRDVVEKGEKSKYANWYFINSFPVQGYPRPNYECFSFYGGMPKLNTGNPETAKYFLDVVKYWTVEFGVDGWRLDAADEVDRKFWRKLRDMLKDLNKDVVLIGEIFDEASSWLWGDQFDSVINYPLKAMINDLFAYRSIDVETFRNRISGYIMKFNKKVLSSLVNIISTHDTPRFLTLCNGDEKRFEMAVVFQFTFPGVPLIYYGDEIGMEGEGDPDCRRPMIWDEAKWNKKTLELYKFLIGLRKRFDALRTGEYGELPVTGCNGILAYRRGRGENGIIVAMNTLDRKENVVVETGDSFDTVKAFESLKDEERLNVDKKRINICLNPFEWRIYKACGEL

SEQ ID NO: 11443 - protein, 138 aa, Cucurbita ficifolia
MGMGMLEVHLISGKGLHAHDPLNAPIDPYVEINYKGQERMSKVAKNAGPNPIWNEKFKFLAEYPGSGGDFHILFKVMDHDNIDGDDYIGDAIIDVKDLLAEGVIKGWSELAPRMYQVLAHKLYFKGEIEVGVSFKRQA

SEQ ID NO: 11444 - protein, 72 aa, Photobacterium profundum
MAKEDVIEMQGTVQDTLPNTMFRVELENGHVVTAHISGKMRKNYIRILTGDKVTVELTPYDLSKGRIVFRAR

SEQ ID NO: 11445 - protein, 257 aa, Prochlorococcus marinus
MIIKRDNSLSKIDLRDWIWTPFFNDLVDKLSVFEIEPYPVSHDFLSKESITGSRRNPVHVTTLTWAAKFEKIKQVRLACIKGGESLSVFNLLIHPLNDYDLPFFGADFVTLPNGHLLALDLQPALKLDNIHTENVWPRLIPLHDHWQSLLPSGGEIPKEAEPYFSPGFLWSRLPLSKESDNIISEILRPAFGEYLSLYIELLHIAKPLKKERALKILEGQKAYINYRSTKDPARAMLCRFYGKEWTEDYIHKVLFNI

SEQ ID NO: 11446 - protein, 150 aa, Cucurbita maxima
MGMGMLEVHLISGKGLQAHDPLNKPIDPYVDINYKGQERMSGVAKNGGPNPLWDEKFKFLAEYPGSGGDFHILFKVMDHDAIDGDDYIGDVKIDVKDLLAEGVRKGWSEIPPRMYHVLAHKIHFKGEIEVGVSFKLQGGGGCGGCNPWEN

SEQ ID NO: 11447 - protein, 320 aa, Rickettsia typhi
MNKFKNIAVYGGGSFGTSLASVVARNCNNVTLFLRNETILKEILYKKTNVQYLGDIKLPTNLQATTNLSVIKDFDLIIIAVPSYAFVDAIKLLKTYGISKDNTLLVATKGFAHNPTELLSDRLNTLLPDNPIGFLSGPNLAKELAKNLHTSASIASLDIDIANKIAHNLSSKTFTTNTTIDIVTLQVAGALKNIFAIKSGIDLAREQGANSRAMLIVAALKEITTLSKVLGGMQKNSDILLEAGVVGDLVLTCYSLGSRNTKFGYEFEISMDKKKFLREYKELVEGREALKLVLDLIKKYNLHMPIVSEVASLIHCGIYI

SEQ ID NO: 11448 - protein, 138 aa, Cucurbita maxima
MGMGMLEVHLISGKGLQAHDPLNKPIDPYVDINYKGQERMSGVAKNAGPDPVWNEKFKFLAEYPGSGGDFHILFKVMDHDVIDGDDYIGDVKIDVKDLLAEGIRNGWSELPPRMYQVIAHKRYFKGEIEVGVFFQRQG

SEQ ID NO: 11449 - protein, 622 aa, Burkholderia thailandensis
MCGITGWIDFSRDLRNEAPIVGTMTDTLARRGPDARGVWLDTHAALGHRRLSIIDLERGAQPMLTPERGPRGLPRAVISYAGETYNFRELRAELGALGHRFDTHCDTEVVLRAYLEWGAAFVDRLNGMYSIAIWDTARDELLLVRDRLGVKPLFYYPTADGVIFGSEPKAILAHPDVRARTSSEGLCDALLFLRTPGQVPFSGMREVKPGHLLRVRRGGLVEERYWALEARPHTDDLPTTIATIRALLDDIVSRQMISDVPLCALLSGGVDSSTVAALAQKQRRANGGGALATFCVDFTGHTRNFRADPIRPTADAPFALEVARHIGSDHHTIELDQAGLLDPQVRETVLRAWDLPFNFADLDVSLYRLFAEVRQHASVALSGEAADEIFGGYLWFSDPVARRAQTFPWLKLGAHRGLDPRALFHRAFIDELKLGEYEAQLYRAALAEVPRLDGESAEDRRTRELHYLTLTRWLPVLLDKKDRMGMASGLEGRVPFCDHRLVEYVFNIPWSMKTFSGQEKALLRAAAADLLPDSVLSRKKAAYPSIQTPGYDRGLIERLNRAIAAGRAPLEPFIDAGALRNLTAKTATGSLSEFERILLESSSRLNDWLDLYRVELDGVPAG

SEQ ID NO: 11450 - protein, 310 aa, Rickettsia typhi
MKITTKVLIIGSGPAGLSAAIYTARSSLKPILINGMQPGGQLTMTTDVENYPGFAKTIQGPWLMEQMSIQAKNVGTEIINDYVERVDLSKRPFKIFTGTGNKYEADSIIICTGAESKWLGITSEQEFRGFGVSSCAICDGFFFKNQDIVVVGGGNSALEEALYLTNHANKVTVVHRRNSFRAEKILQDRLFKNPKISVIWDHVIDEIVGSNQPKTVTGVKIKNVYTNEINLVNCSGVFIAIGHTPNTTLFNGQIAIDDDNYIITQTGSTRTSVEGVFAAGDVQDKIYRQAITAAASGCMAALEVAKFLNK

SEQ ID NO: 11451 - protein, 1955 aa, Ustilago maydis
MSFHLDSFVNSPASADQAPAWQLHSSTDSYLEWDANPKSLIEQQPSSTTTSPPPSMSRLRSTSSTVATLAPGAQTPAEPPSTDSASVLSHNGHTTSPERSVSPSYFTKLYFHPPDRTTSATSPTITFTSAIEPSLVAHAQPSPLLPTDAQSASHLPSPARESHTGRRPSISAVGSSSTTSPLTTPLSPTLSSRSSAAGGGFFASLRPSSPGNLPISTSKPQDGDNLGKPRRPSSVFDHVGNVWERFGRKVHHTRTATSEHHSSSSSHTRRSASQASPPIGLTPESADPFDTARNSPSGSFISQASPSQSTTTDSECRTPATPGGEPPAQLSTPQPLPSAPAYTSVSALDSSVNAPQQEEAEELPYLAPESPRPQPQSFNTIGSPRIPSGQRSATSHRRTSSLLERVLIQVTDDNERFSVVDISGVDSADAIKERMFAKLHLFDADHSSFQLFRTEIGQSEATGPVVSDDALLVLCLQMGDDRGTLKFLVQQIAPPPNSTVRALPPPTSTIVSQRAINNIRRTSGTGSAPGQHLRTESQSSKSSLSDALVYPEMIGADAAHEGSNRNSGSSLTRSKAQTRRALPSAPPVDDLRSPTHSCISSTTQSAVQDRRSIASSGDGSANESWARHGASASDGAPSAIPTQRSSSVNANASAAQSSSSGSAGRHPSNLEDDRQRYDAEPGVNRSLHAPATGSSHWQERSDEGARESLRVQTTAQLPGLTLHNAKSMDDLHRPSQSASQPSTLTTQAEVRKQAGMDRDGRYPTPAIMRPSTAAPAGAGARESASSHRQYSSDALGSSRSPQEPTLGLDPRMLQRNRSAQAAIPSGQQLVNHGPTRMSSTPQIRSPPMQHVYLGQGQIDPRFNTQPPHSAHPMQAHPSNMVARPPYSAAPSFASQPAYQSQSFGQAALRPMGHGFVNEFGARAPAASVNFNTYHGHDPRMNASAMQGSLTPRPYSYYEQPSMHQQQPMYRPYAQPSLVTASPYRTREDPFTTRYFPASSSRQVSEFQMQAGRLEPGMTVQQTLRTQEAIWGHTSAGSPGQAYQSAHAHPPGPSYGPRDPRQPGQSNQYTGMQAYPNASAAPQMQQRPSYQGSAMPNLHHVPPPRPQSYPSAQPQPQPPRNAHDRHPAPPAGHSGPQMMPQSSGSSAGRAPMQPQQNQQLSQPSQPSQREQPGHAQAMPGSESHRRDPPVRTNASERSSGSSFSSQGSFQHGRPHNDDCNSRNSIEESFSAPTSARSSQSEAASAKPVNVEHRSSYADQERDLADDELEHVRPLPKLPHSSATTRTDAFKSSSCDASGATVGGSVRRSEDEDTLRAGEWAQLWRALDPKSDGTVSGTAISGSSGGDGDTVRAEPSTPGASRPQTKDGATLPISLEPPRIPSPSLAPEENGTVSSFGTFDDDETESGTWAQPLDSDVNAPRLPLRLDADSEALSDDHATLLPGQDTLLQASTRGTRGFSAASNSPKRPELRLTIDPAAGPTVMTWTASQASTNSPRASTSHLSSALNSGGITRSNSFARRDDDWAFRPPPEQLYENLDDFFPKHDLDKPLLDTTAGPESGLVSSPRAEASVPSVASVGAQQGLSQRSRHKKSIRLVAEDRKRILERADTRRAAQGAELSSGLVRRRSTKLWGTKVVEMTPGQELATPASATSAESPWSDTASTTGQPVFKWVKGDLIGKGTYGRVYLALNATTGEMIAVKQVELPRTASDREDSRQKGVVAALKSEIETLKDLDHPHIVSYLGFEETRQFLSIFLEYVPGGSVGSCLRKHGKFEESTIKSFLHQILEGLAYLHSKGILHRDLKADNILVDFEGTCKISDFGTVRRSDDIYGNVENMSLQGSIFWMAPEVVSLSKKGYSAKIDIWSLGCVVLEMFAGRRPWSDDEAVQAMFKIGAQRKAPPIPADVKLTKQAAHFLKNCFEIDPAKRPTAQRLLDHVFTVPVPGWQFSHSALCRSLHR

SEQ ID NO: 11452 - protein, 714 aa, Unknown
  marine gamma proteobacterium HTCC2080
MNVVKKTFQYGDHEITLETGRIARQASGAVMVTMGNTSVLCTVVAAREMRAGQDFFPLSVHYIEKRYAVGKIPGGFFKREARPSEKETLTSRLIDRPVRPLFPNGFMNEVQVVCTVMSADSETDPDIPAMIGTSAALAISGCPFNGPIGGARVGFTEAKGYLLNPNYSALKNSQLDMVVAGTSEAVLMVESEAQELSEDQMLGAVLFAHQEMQTVIKAISELVEEAGKPRWDWTAAPVDEALKAAVEGEAKSGLGEAYRITEKAARYERVGEVRDATIAALAVEGGPSKDDIKDQFKALEKNIVRQRIISGEPRIDGRDGRTVRPIVCEVDVLDKAHGSALFTRGETQAIGAVTLGSSRDAQIIDALEGERRDPFMLHYNFPPYSVGEAGRIGFTSRREIGHGRLARRGLAATLPTEEEFPYTVRVVSEITESNGSSSMASVCVGSLAMMAAGVPVKAPVAGIAMGLVKEGNQFAVLTDILGDEDHLGDMDFKVAGTSGGITALQMDIKIEGINEQIMEIALEQAMQARLHILGQMNSVLAAPREIVSENAPSMVQLKIDSDKIRDIIGKGGATIRSITEESGATVDIEDDGTVKVFGVTKESRDHAVNAIMAITAEAEVGAIYEGTIARIVDFGAFVTILPGKDGLVHISQIAEERVENVTDYLKEGETVRVKVLDVDQRGRIKLSIKEVAADEGTDAADPAVDAESEDLSGE

SEQ ID NO: 11453 - protein, 104 aa, Bacillus cereus
MAIVNANDQSFAAETSEGVVLLDFWAPWCGPCKMIAPVLEEIDAELGEKVKVVKVDVDENQETARQFEVMSIPALFVLKDGKVVDQALGYKPKEALVELVSKHF

SEQ ID NO: 11454 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVETLLKQIEYLIRNGWVPCLEFSLEGFVSRDNNKSPGYYDGRYWTMWKLPMFGCTDAAQVVKEAAECKKEY

SEQ ID NO: 11455 - protein, 147 aa, Fritillaria agrestis
TMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 11456 - protein, 261 aa, Hyphomonas neptunium
MTNVIVYEHPLSPYAQKVKISLREKGVPFETRLPEGIGTGATAGGFAKANPRGEVPALIHGDVEIFDSTIILEYIEDVWPDPAMLPKSPADRARVRMIEDVMDTQFEAITWGLGELNFFRRAEGAKKEEMEAKARTQAEAFFKVLEGYLGDREWFNGASFGWGDLSVVPYLNGAAGFDIRPAESSRLGAWAKRANARESVALARRESEASIGGMNQVDQAVKAGLFKRQYRDHRLEWMMKTGGTEIVLKGLEAGNIRFTGP

SEQ ID NO: 11457 - protein, 332 aa, Staphylococcus aureus
MTKITVFGMGSFGTALANVLAENGHDVLMWGKNQDAVDELNTCHTNKKYLKYAKLDVNIIATSDMTKAIQFADIYLMALPTKAMREVATQINDKLTSKKTFIHVAKGIENGTFKRVSEMIEDSISPEYNAGIGVLSGPSHAEEVVVKQPTTVAASSKDKSVSKLTQDLFMNDYLRVYTNDDLIGVELGGALKNIIAVASGIVAGIGYGDNAKAALMTRGLAEISRLGEKLGADPMTFLGLGGIGDLIVTCISTHSRNFTLGYKLGQGESMDQALSEMNMVVEGIYTTKSVYHLAKEKNVDMPITNALYRVLFENISVKECVKDLMERDKKSE

SEQ ID NO: 11458 - protein, 175 aa, Nicotiana tabacum
MGSKMSDPLVIGRVIGEVVDYFTPSVKMSVTYNSSKHVYNGHELFPSSVTSKPRVEVHGGDLRSFFTLIMIDPDVPGPSDPYLREHLHWIVTDIPGTTDCSFGREIVGYEMPRPNIGIHRFVFLLFKQKKRQTLLSAPLSRDRFNTRKFSEENELGSPVAAAFFNCQRETAARRR

SEQ ID NO: 11459 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 11460 - protein, 391 aa, Staphylococcus aureus
MTEEFNESMINDIKEGDKVTGEVQQVEDKQVVVHINGGKFNGIIPISQLSTHHIDSPSEVVKEGDEVEAYVTKVEFDEENETGAYILSRRQLETEKSYSYLQEKLDNNEIIEAKVTEVVKGGLVVDVGQRGFVPASLISTDFIEDFSVFDGQTIRIKVEELDPENNRVILSRKAVEQEENDAKKDQLLQSLNEGDVIHGKVARLTQFGAFIDIGGVDGLVHVSELSHEHVQTPEEVVSIGQDVKVKIKSIDRDTERISLSIKDTLPTPFENIKGQFHENDVIEGVVVRLANFGAFVEIAPGVQGLVHISEIAHKHIGTPGEVLEPGQQVNVKILGIDEENERVSLSIKATLPNEDVVESDPSTTKAYLENEEEDNPTIGDMIGDKLKNLKL

SEQ ID NO: 11461 - protein, 760 aa, Unknown
  Petunia x hybrida
MLRTLASVLLISSFLVYLSAADDGFPRCNCEDDGFWSIESILECQRISDFFIAIAYFSIPIELVYFVSCSNFPFKWVLFQFIAFIVLCGMTHLLNFWTYYGQHTFQLMLSLTIFKVLTALVSFATAITLITLFPMLLKVKAREFMLTKKTWDLGREVGLIKKQKEAGLHVRMLTQEIRKSLDRHTILYTTLVELSKTLNLHNCAIWKPNENRTEMNLIHELKGRSFSSMYSLPIPTSDPDVKAIKGSDGVKLLDVDSPLAAASSGGSSQPGAVAAIRMPMLKVSNFKGGTPELVPECYAILVLVLPSEQGRSWSNQEIEIVRVVADQVAVALSHAAVLEESQHMRETLEEQNRALPQAKQDALKASQARNASQMVMSHGLRRPMHSILGLLSLLQDDKLGNEQQLLVDAMAKTSNVVSTLINDVIDTSTKDNGRFPLEMKHFQLHSMIKEAACLAKSLCAYRGYKISIEVDKSLPNHVMGDERRVFQVILHMVGNLLKDPNGGYLTFRVLAESASREDIEGAWRTRRSNSSRDNAYIRFEVGTRNIHSGITSTLPHCSQRRCSREVEESLSFAVCKKLVKLMQGDIWVIPNPDGFDQSMAVVLGFQLWPSISIGIPEYRELSDHSHPHLLLQGVKVLLADYDDVNRAVTRKLLEKLGCSVSAVSSGHDCLGALGPAASLFQIVLLDLHLPDLDGFEVTMRIRKYRSRSWPLIVGLTASADEDVSGRCVQIGMNGIIRKPVLLPGIADELQRILLQATRIM

SEQ ID NO: 11462 - protein, 727 aa, Salmonella typhimurium
MSTTDDTHNTLSTGKCPFHQGGHDRSAGAGTASRDWWPNQLRVDLLNQHSNRSNPLGEDFDYRKEFSKLDYYSALKGDLKALLTDSQPWWPADWGSYVGLFIRMAWHGAGTYRSIDGRGGAGRGQQRFAPLNSWPDTVSLDKARRLLWPIKQKYGQKISWADLFILAGNVALENSGFRTFGFGAGREDVWEPDLDVNWGDEKAWLTHRHPEALAKAPLGATEMDLIYVTPEGPNHSGEPLSAAAAIRATFGNMGMNDEETVALIAGGHTLGKTHGPAAASHVGADPEAAPIEAQGLGWASSYGSGVGADAITSGLEVVWTQTPTQWSNYFFENLFKYEWVQTRSPAGAIQFEAVDAPDIIPDPFDPSKKRKPTMLVTDLTLRFDPEFEKISRRFLNDPQAFNEAFARAWFKLTHRDMGPKARYIGPEVPKEDLIWQDPLPQPLYQPTQEDIINLKAAIAASGLSISEMVSVAWASASTFRGGDKRGGANGARLALAPQRDWDVNAVAARVLPVLEEIQKTTNKASLADIIVLAGVVGIEQAAAAARVSIHVPFPPGRVDARHDQTDIEMFSLLEPIADGFRNYRARLDVSTTESLLIDKAQQLTLTAPEMTVLVGGMRVLGTNFDGSQNGVFTDKPGVLSTDFFANLLDMRYEWKPTDDANELFEGRDRLTGEVKYTATRADLVFGSNSVLRALAEVYACSDAHEKFVKDFVAAWVKVMNLDRFDLQ

SEQ ID NO: 11463 - protein, 191 aa, Unknown
  Bradyrhizobium sp. BTAi1
MIDRRTVLFGIGASMAGSAFISPAARAENAVSKTTAYRFSFPALSGDPIRLAEFTGKPVLVVNTASQCGYTPQYTGLQQLWSEFHERGLSIIAVPSNDFNQEPGVAGDIAELANKQFGVTFPMTAKAVVTGSNAHPFYRWAAEARPKDTPRWNFHKYLIGRDGYIADVFASSVEPTDTRVKTAIARNLADG

SEQ ID NO: 11464 - protein, 566 aa, Erwinia carotovora
MVAVNDGVSAHPVWWKEAVFYQVYPRSFKDSDGDGIGDLKGLTEKLDYLKALGINAIWINPHYDSPNTDNGYDIRDYRKIMKEYGTMDDFDRLIAEMKKRDMRLMIDVVVNHTSDEHEWFVESKKSKDNPYRDYYIWRDGKDGTQPNNYPSFFGGSAWQKDNATQQYYLHYFGVQQPDLNWDNPKVREEVYDMLRFWIDKGVSGLRMDTVATFSKNPAFPDLTPKQLQNFAYTYTQGPNLHRYIQEMHQKVLAKYDVVSAGEIFGVPLEEAAPFIDQRRKELDMAFSFDLIRLDRAVEERWRRNDWTLSQFRQINNRLVDMAGQHGWNTFFLSNHDNPRAVSHFGDDRPEWRTRSAKALATLALTQRATPFIYQGDELGMTNYPFTSLSEFDDIEVKGFWQDFVETGKVKPDVFLENVKQTSRDNSRTPFQWSNTAQAGFTTGTPWFRINPNYKNINAEEQTQNPDSIFHFYRQLIELRHATPAFTYGTYQDLDPNNNEVLAYTRELNQQRYLVVVNFKEKPVHYVLPKTLSIKQSLLESGQKDKVEPNATTLELQPWQSGIYQLN

SEQ ID NO: 11465 - protein, 106 aa, Thermosynechococcus elongatus
MTMATTRQFSSFSDLLATTDKPLLVDFYADWCGPCRMMAPILEQVKKYLKSEVEVVKIDSERYPQLTSQHHVQALPTLILFHRGRELQRWEGVQPPEVLIDAIRRL

SEQ ID NO: 11466 - protein, 694 aa, Zea mays
  misc_feature (117)..(117): Xaa can be any naturally occurring amino acid
MGHTSSGNEVPLKYSSGKAFPLGVSQVDDGLNFAIFSQHASSVTLCLNFPERGNQDDVDIVEFALDRQRNKTGDIWHVSVEGLPASGVLYGYRINGPQGWQQGHRFDDSVILLDPYXKLVYGRKHFAVEKEKPSQLFGTYDFDSSPFDWGDNYKLPNLPETDLVIYEMNVRAFTADESSRLAPAIRGSYLGVIDKIPHLLELGVNAVELLPVFEFDELELKRFPNPRDHMVNTWGYSTINLFAPMSRYASAGGGPVAASKELKQMVKAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKEIAKGSVLSRCKIIAEPWDCGGLYLVGRFPNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 11467 - protein, 994 aa, Oryza sativa
MAAARAPWLWWWVVVVVGVAVAEAASGGGGGGDGEGKALMGVKAGFGNAANALVDWDGGADHCAWRGVTCDNASFAVLALSLDISEAILFVMLKRIFVMRVFPCVKNRNLSNLNLGGEISPAIGELKNLQFVDLSGNLLYGDIPFSISKLKQLEELILKNNQLTGPIPSTLSQIPNLKTLDLAQNQLTGDIPRLIYWNEVLQYLGLRGNSLTGTLSPDMCQLTGLWYFDVRGNNLTGTIPESIGNCTSFEILDISYNQISGEIPYNIGFLQVATLSLQGNRLTGKIPDVIGLMQALAVLYLHGNKLTGVIPPELGNMSKLSYLQLNDNELVGTIPAELGKLEELFELNLANNNLQGPIPANISSCTALNKFNVYGNKLNGSIPAGFQKLESLTYLNLSSNNFKGNIPSELGHIINLDTLDLSYNEFSGPVPATIGDLEHLLELNLSKNHLDGPVPAEFGNLRSVQVIDMSNNNLSGSLPEELGQLQNLDSLILNNNNLVGEIPAQLANCFSLNNLNLSYNNLSGHVPMAKNFSKFPMESFLGNPLLHVYCQDSSCGHSHGQRVNISKTAIACIILGFIILLCVLLLAIYKTNQPQPLVKGSDKPVQGPPKLVVLQMDMAIHTYEDIMRLTENLSEKYIIGYGASSTVYKCELKSGKAIAVKRLYSQYNHSLREFETELETIGSIRHRNLVSLHGFSLSPHGNLLFYDYMENGSLWDLLHGPSKKVKLNWDTRLRIAVGAAQGLAYLHHDCNPRIIHRDVKSSNILLDENFEAHLSDFGIAKCVPSAKSHASTYVLGTIGYIDPEYARTSRLNEKSDVYSFGIVLLELLTGKKAVDNESNLHQLILSKADDNTVMEAVDSEVSVTCTDMGLVRKAFQLALLCTKRHPSDRPTMHEVARVLLSLLPASAMTTPKTVDYSRLLASTTTAADMRGHDVTDIGDNSSSDEQWFVRIAQRLSLGICSDILVLFMVFKRDVRLFAAAAAAAAASETLNLHA

SEQ ID NO: 11468 - protein, 251 aa, Prochlorococcus marinus
MDKKISFIGVGPGDPDLLTLKALKKIKIADVIIWTDSLIPEKILDFSKEGSENIKTSSLNLEQITSIMIKKFQEGKTVIRLHDGDPCLFGAIREQIEILKKEKIEIEVIPGVSAFQVAAAYHEAELTIPDVTQTIILTRAGGRTGMPEKESLKDLAKHNSSLCLYLSARHVKRSQETLLEFYPSETKVIVGYRVSWDDGWTSLIELKDMEDFSIEKKLIRTTIYIISPAINNSQKRSNLYNPSYRHLFRNK

SEQ ID NO: 11469 - protein, 681 aa, Volvox carteri
MALRFCPTAAPPRGCGTPIQHPVLLLPHKALLPYSTAASRQAARPARVCVTAYAKLADGSARRMQSEEVRRAKEVAQAALAKESPADWVDRFGSEPRKGADILVQCLEREGVDNVFAYPGGASMEIHQALTRSDRITNVLCRHEQGEIFAAEGYAKASGRVGVCIATSGPGATNLVTGLADAMMDSIPLVAITGQVPRRMIGTDAFQETPIVEVTRAITKHNYLVLDIKDLPRVIKEAFYLARTGRPGPVLVDVPKDIQQQLAVPDWDSPMSITGYISRLPPPVEESQMIPVLRAIQSASKPVIYYGGGCLDARDELREFAARTGIPLASTFMGLGVVPAEDPNHLQMLGMHGTVAANYAVDQADLLVALGVRFDDRVTGRLDAFASRARIVHVDIDAAEISKNKTAHVPVCGDVKQALRHLNRMLEAEPLSDRFVAWRAELAAKRAEFPLRYPQRDDAIVPQYAIQVLGEETKGEVIITTGVGQHQMWAAQWYPYKEPRRWISSGGLGSMGFGLPAALGAAVAFDGKQGREKRIVVDIDGDGSFLMNVQELATVFIEKLDVKVMILNNQHLGMVVQWEDRFYKANRAHTYLGKREAEWHATGDEEDIYPNFVGMARSFGVPSMRVIRKEDLRGAIRTMLDTPGPYLLEVMVPHIEHVLPMIPGGATFKDIITEGDGSVKY

SEQ ID NO: 11470 - protein, 85 aa, Deinococcus radiodurans
MARRKMPEQREKKKKDESDSVRAEGVVEEALPNTTFRVKLDTGHDILAYISGKMRIHYIRILPGDRVVLEISPYDTSRGRIVYRR

SEQ ID NO: 11471 - protein, 658 aa, Physcomitrella patens
MVLLSSVEAYQQDRLGLLKRSEPLREPTGLRSWIDIPLGLEDYRHCASTFACNKDDQNFDMRGLSRIGFPNPTINLEIQGIGDFYSQARSPVASYSSGTSNDCNSAGTSTVDSTEDASLSSYLMDGNVRAMLKKVTVNEGVLNQTIQSLGGGEKGLKELMAYIMAWVKEQNGENCDKLFLSQNLEKLNPPQMNPTFGFAPSLANNIPTCNLTLGTAACDQRSDNLRRTFDTVQSSDDTQDLNQVIQCSKSRRLMVEGEVDSSYRADAYPRQGTFLNARGSVSEDFHSTKLESNMTNPSPIDAVVLQGMSSELGTLTQQAPCSQFGLSFNPGQNELNRTLAASTRAARRNRLSRQRQSVQQSHRRSPTSGTTVTSGGCGLWSASPPALDFMNTRWNHPGTQMPLGASVKSEKKGNTTDMLTFLLQKELRPSDVGNLGRIILPKKEAEVHLPILALREGVSLLMEDFDSGYCWNIRYRFWPNNKSRMYLLENTGEFVKSHHLKEGDLLILYRNEQGNYVLRGKKKVPSETRVAYGSQHRTAHSLACRFSEGIPNKIEESFKDRDFGGGLTETASGKLKIEVKAEPLVVQPSTDGDKFEDVMSNIGSSFATEGPLQPLERFPSLNLDFPLDEIMAGIPKEEDNDLTIEPHMDSKVKTEPAG

SEQ ID NO: 11472 - protein, 615 aa, Oryza sativa
MAASSSSTSFSSSSSHEGDAGSSYIECFKYSRRATLRSVVGRPDGGAGLVGERAVVGGWVRSSAVVRARRAAAGPASPSRKPEVEATGLTCTEVLMSRVPLIRCIARLMAGGITAAASAGGSARRPAVGTALVRINDGSCVADLQIVVDSALLPLDQITATGACVLVEGKIEQVEGTLPQYVVQMKVEKILHIGPVDSEKYPRSNAHSSPDLVRGYPHLAARTATVASTARVRSELVHAVHAFFQSNGFFHVNTPTITTTTATSAGNRGKMLRLTRLFSKSDNGNRITPEAVRAAIKEKTKQVEALKRSESNKEALEAAEQDLQRANALSRQLEQGASAESSQDEFFHRPAYLTPCHTLHLETYACALSSVYTFSPVFQAESESLDSDRSLAERWTVDVELAFAELEDAISCAEDCVKSLCSTVSKDCSDELKFLSSNQAGDATSSVIEAAVSSPWQKIKYTEAVNTLLQVTDKTFESKLELGMPLSRVHLSYLADDLYKKPVIIYDYPKQLKPFYARLKEDLKTVSAFDLVVPKVGIVACGAQKEERMDNLTSRIEESGLQVEQLEWYLDTRRHGTVKHSGFSIDLESLILFVTGLKDVRDAIPFHRTKGHAKC

SEQ ID NO: 11473 - protein, 58 aa, Metrosideros excelsa
LVMTDPDVPGPSDPYLREHLHWMVTDIPGTTDATFGKEVVEYEMPRPNIGIHRFESLV

SEQ ID NO: 11474 - protein, 515 aa, Physcomitrella patens
MDGNVRAVLKKVTVNEDSLSQAIQALGGGEKGLKELIGHIMLWVKQHNGEMDYGKTSLSQKLEKLHPPQMNHALEFASGKGISGTVYNPNLASEGYDQRNEKSPCPFVRVQSSEDLQDMNHLFQCIKSRRLMGEGGLDINFPRDVHSGSGTFVDVRGSVPDVLHFPSGGMGPRSPNHIGPAMLQGMPCELDIQRPLIPCAQAGLSFSGEHDGLSRIFTATTRAARRNQISRQRQSGLQSNSTFTPSNTVTAVSSECGLWSVAPPAWDMSVGVFLSRTQSPSCGPDISDPKMLTFLLQKELRPSDVGNLGRIILPKKEAEAHLPILALREGILLQMEDFDSGHCWKIRYWFWPNNKSRMYLLENTGEFVKSHRLEEGDLLVLYKIQEGNYVLRAQKKVHSESSGAPGSQQKNAYSLARDFPEASKTEEPLKEKDIVGFAEWSCGKVNEERNILVRDDDPLFKDDQKHKISSSFSPEPLQSLERFPSLSIDFPLDEMMPWDDPDEFNTDSELAELVG

SEQ ID NO: 11475 - protein, 412 aa, Symbiobacterium thermophilum
MDALKRYDPEVFAAIQQEVERQQRNIELIASENFVPKAVLEAAGTVLTNKYAEGYPGRRYYGGCEYVDIVENIARERLKAAFGAEHVNVQPHSGANANTAVYFAFLQPGDTVLGMNLAQGGHLTHGSPVNFSGRTYNFVPYGLDPETERINMDQVAELARQHRPKLIVAGYSAYPRVLDFKRFREIAEEVGAILMVDMAHFAGLAATGYYPNPVEHAHVVTTTTHKTLRGPRGGAILCKKEFAKEIDKAVFPGMQGGPLMHIIAAKAVAFKQLSDPDYRAYCGQVVKNAKALAQALLERGYRLVTGGTDNHLMLVDLRPKGITGRDAEHLLDRVSITVNKNAIPNDPEKPMVTSGIRIGTPAMTTRGMKEAEMVQIADLIDRAITHRNDEAELDRIRAEVHELTARFPLYAD

SEQ ID NO: 11476 - protein, 400 aa, Arabidopsis thaliana
MRFRSFFFSSSIFSLSHSRSPSLSSSRFSSLSAAMSPALEKSRQGNGGCNDDSKSKVTVVGSGNWGSVAAKLIASNALKLPSFHDEVRMWVFEEVLPNGEKLNDVINKTNENVKYLPGIKLGRNVVADPDLENAVKDANMLVFVTPHQFMDGICKKLDGKITGDVEAISLVKGMEVKKEGPCMISSLISKQLGINCCVLMGANIANEIAVEKFSEATVGYRGSREIADTWVQLFSTPYFMVTPVHDVEGVELCGTLKNVVAIAAGFVDGLEMGNNTKAAIMRIGLREMKALSKLLFPSVKDSTFFESCGVADVITTCLGGRNRRVAEAFAKSRGKRSFDELEAEMLQGQKLQGVSTAREVYEVLKHCGWLEMFPLFSTVHQICTGRLQPEAIVQYRENKL

SEQ ID NO: 11477 - protein, 332 aa, Unknown
  Burkholderia sp. 383
MKVAVLGAGAWGTALAGHLAARHDTLLWARDAALIAGLQARHENSRYLDGIALPDALRYDADLGAALAHGAADDALCVIAAPVAGLRTLCHAMRDAGCVPAHVVWVCKGFEADTHLLPHQVIAAELPEQHSNGVLSGPSFAREVGQSLPVALTVASTSAECRERTLAAFHHGAMRIYTGDDVVGVEVGGAVKNVLAIATGIADGLGLGLNARAALITRGLAEMSRLGVALGGRAETFTGLTGLGDLILTATGDLSRNRTVGLQLAAGRTLNDILGALGHVAEGVRCAQAVLAIARAQSIEMPITEAVCGVLFDGIAPRDAVSGLLRRDARAE

SEQ ID NO: 11478 - protein, 58 aa, Metrosideros collina
LVMTDPDVPGPSDPYLREHLHWMVTDIPGTTDATFGKKVVEYEMPRPNIGIHRFESLV

SEQ ID NO: 11479 - protein, 378 aa, Vibrio cholerae
MKRLFAWGAPLFALVALTLSLFSQADTKPSTIDSTSANYQQATLAGGCFWCTESDMEKLPGVVDVISGYAGGDVDNPTYKQVSSGKTGHIEVIQVTFDPKIVTYEQVLDNFFRHIDPTDDQGSFVDRGEQYRPAIFYHNAEQLEVAKRFMMEIDQLGIFKKPLKTELIEFKKFWPAEDYHQDYYKKNKVRYNYYRYASGRDQYLDEIFGADRNTHPKTLRQWIDEKNGQANVKAYVRPSDEQIRAKLTSLQYKVTQRDGTERPFDNEYWDNKEEGIYVDIVSGEPLFSSTDKYDSKTGWPSFTQPLNSSYIVTKDDNSLFYTRTEVRSRFADSHLGHVFNDGPAPTGLRYCMNSAAMRFIPKQEMAAQGYGEYLALFK

SEQ ID NO: 11480 - protein, 486 aa, Symbiobacterium thermophilum
MALVPLLFEKSTPGKRAVTFPAPDVPTVELSEAIPADLIRQTPAALPELSEVEVVRHFTQLSRLNHGVDVDFYPLGSCTMKYNPKVNEEAARIPGFALTHPLQPEETVQGNLQLLHTLEGWLCEVTGMDRMTFQPAAGAHGELTGILLIRAYHESRGDTERNEVIVPDSAHGTNPATAAMAGYRVVPVKSRPDGSIDVDALRQIVGPKTAALMMTNPSTLGLFDPHVREITEIVHQAGGLCYYDGANLNAIMGYARPGDMGFDVVHLNLHKTFSTPHGGGGPGSGPVGVKSHLVPFLPVPVVEKQGDRYALDWDRPQSIGKIHGFWGNFGVIVRAYAYVLAHGPALKEVSEHAVLNANYVLARLKPYYEPYVDRYCMHECVLSARTLKQETGVRTLDVAKRLLDEGVHPPTIYFPLIVEEALMIEPTETEDKATLDRFIEAMIRIHDEARSNPEYVKSAPHKTPVGRLDEALAARRPNLRYRANPS

SEQ ID NO: 11481 - protein, 458 aa, Symbiobacterium thermophilum
MRYVPITQADKAAMLREIGVSSTEELFAANIPAEVRLNRPLNLPPALTEMELLAHLRELAAQNAHTGEYACFLGGGAYDHYVPAAVDAVIRRGEFLTAYTPYQPEISQGVLQAIYEYQSLMCELTGMDLSNASMYDGASALAEAAGMVVNQTGRSKLLVARSVSPLYRRVVQTYMHGIGVELIEVPLDGVTLDLNRLEALMTEEVGGLLLQTPNYLGYLEKVREIEALVHAKNGLFVVAVDPISLGLLEAPGSYGADIVVAEGQGLGVPLSYGGPYLGVLATRDRFARRMPGRIAGATVDNRGQRGFVLTMQAREQHIRREKATSNICTNQALIALAATVYLALVGKEGLREVANLSLQKAHYAAQQIARLPGWRLAGDAPFFKEFTVLAPAAAAEVSRRLVDRKILGGLDVGADYPELLGGAAGSAGGPAAALSFAVTEKRTRAEIDRLVAALGEVK

SEQ ID NO: 11482 - protein, 311 aa, Streptococcus gordonii
MAEIYLAGGCFWGLEEYFSRIEGVKKTTVGYANGQVESTNYQLIHQTDHAETVHLIYDEKRVSLREILLYYFRVIDPLSVNKQGNDVGRQYRTGVYYTNQADKAVIEQVFAEQEKQLGQKIAVELEPLRHYVLAEDYHQDYLKKNPGGYCHINVNDAYQPLVDPGQYEKPTDAELKEQLTQEQYQVTQLSATERPFHNAYNATFEEGIYVDVTTGEPLFFAGDKFESGCGWPSFSRPIAREVLRYYEDKSHGMERIEVRSRSGNAHLGHVFTDGPESAGGLRYCINSAALRFIPKEKMEAEGYAYLLQHMK

SEQ ID NO: 11483 - protein, 539 aa, Physcomitrella patens
MVNQGSGDFSSQDGSLPSCSSTSSERNQSSGSGLGEGCSLLMDDEVRAMLKKVTVNEAVLNRAIQSLGGGEKGLKSLMGYIMIWVKQQKECKSARSNSGEQSSGSPFNFSMLGAEAAAEAEAIVLQHTSDAFQSLNGILQPSATQSPVNLPDTQHQQRFKSRRLMMEDAEVDAGLKVDAGFCPSNFMAVGVPPGDYSMYMPAMAGPAVSPYMPRLNYDSGMQQPVCNMQSMIPSTTSQNSMQPIEQTPAMATKAARRNRMARQRQSMMKQHARATNQANPVSVGFWVWNGAPPAGGTKKTEISHSGAQPAQGTAVNAEQKGRNMDSLTFLLQKELRPSDVGSLGRIILPKKEAEQHMPFLSMRGGVCIQVEDFDSGHIWNLRYRFWPNNKSRMYLLENTGDFVKSHRLVEGDLLIIYRSQQGDYVMRGKKRKTQRLETESVKIQFAHSSARDSNEEHTSPKGNGLPMERLYGGGPPEKFVKEEPPNLDDDPFLKDMMMSMGPSFGSDATSLQPLERFPSLNLDFPLDEIMAVNPKTELE

SEQ ID NO: 11484 - protein, 344 aa, Lycium pallidum
  misc_feature (195)..(195): Xaa can be any naturally occurring amino acid
VEIKVGDSIETVRFFHCYKRGVDRVFVDHPMFLEKVWGKTASKIYGPKVGQDYVDNELRFSLLCQAALEAPRVLNLNCSKYFSGPYGEDVLFIANDWHTALIPCYLKSMYQSKGIYLNAKVAFCIHNIAYQGRFSFSDFSLLNLPDEYRSSFDFIDGYEKPIKGRKINWMKAGILESHRVVTVSPYYAQELVSGXDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPS

SEQ ID NO: 11485 - protein, 320 aa, Photobacterium profundum
MSNVRHCNLLILGSGPAGYTAAVYAARANLNPVMITGMQQGGQLTTTTEVENWPGDAEGLTGPALMDRMKEHAEKFETEIIFDHINETDFSQSPFRLKGDNAEYTCDALIISTGASAKYLGLESEEAFKGRGVSACATCDGFFYRNQKVAVVGGGNTAVEEALYLSNIASEVHIIHRRDTFRSEKILIKRLMDKVENGNIVLHTDRTLEEVLGDEMGVTGVRIKDTQSNATEDLEVMGAFIAIGHQPNTAIFEGQLEMANGYISVQSGTQGNATQTSVEGVFAAGDVMDHTYRQAITSAGTGCMAALDAERYLDALEQQK

SEQ ID NO: 11486 - protein, 431 aa, Mycobacterium smegmatis
MTDQPETFRRRIFSRSSWPEWQRVSELLRTETVGGALLLVAALAALVWANSPWSAGYDQVSDFVVGPHSLHLDLSISAWAADGLLAIFFFVVGVELKREFVVGDLRDPAKAALPIAAAVGGMIVPAVIFVGVNLVAGHTENLGGWAIPVATDIAFALAVLAVIATHLPSALRIFLLTLAVVDDLLAIIVIAVFYTTQLSFGPLAGALVTIAVFGLAVQRGVRTPFLLLPLAVVAWALMHASGVHATVAGVLLGFTIPVLGRHACADRMEHRLRPLSAGFAVPVFAFFAAGVTVGGLSGFASALSHPVTYGVIAGLVLGKPIGVFLTTYVLARFTNASLDEDLAWRDVLGLALLAGIGFTVSLLIGELAFENSPIAHDDAKIAVLTGSVLAGLLAAVVLLSRNAVYRRIHEAETVDADDDGVPDIYQPRQDQ

SEQ ID NO: 11487 - protein, 148 aa, Triticum aestivum
GSVGFLSSSSAVAETHPPPWAKYNVVQKSKRESSHDRKRRAHGDPNSGKLKHHNAPIAISGKRKRKLLRRLNRDQKEAVMVKALENNMGDVDMVSAEASSETAKDKSQMKFNVKKNSRIQIKRLKGKGRKKAKNVKPPTKEKADAMVE

SEQ ID NO: 11488 - protein, 73 aa, Sinningia glazioviana
  misc_feature (55)..(55): Xaa can be any naturally occurring amino acid
ISGTNGEVMPGQWEFQVGPSVGIEAGDHIWCARYLLERITEQTGVVLSLDPKPIXGDWNGAGCHTNYSTKSMR

SEQ ID NO: 11489 - protein, 338 aa, Pseudomonas fluorescens
MNSHAGWWPVALSRQLHKQPLACTLHGVPLVLFRDADGAAAVLPDRCPHRFAPLSAGRVRDGQLQCPYHGWRFDPQGRCTQLPGQEQQRCSQPLLQPLHSCEAQGLVWASLASERPNAPPVAAAEQAQALDVFWISDRVQCSLQDAAENFLDGFHTHFVHAGWIRHDRQRQRIRAWVHQLEDGVEAQYSEEGTQSGLISRLFEGERGLSMGRFRLPGLAEIEYRDRQGRLNLLVSAWLTPAAEGELRLFARIATARGRLPGWLKRAVLQPLFKVILKQDRQILEKVSANQQRFAQVPLRWHRPTPLDSSLDLLGPWIRQLLEQGELKDFQECREEFWL

SEQ ID NO: 11490 - protein, 138 aa, Ostreococcus tauri
MTRREPARELTGNDEVARACTPIRHNLTRKPAQKKPSGAKKGGRKSKTETYKIYIYKVLKQVHPDTGISSKAMSIMNSFINDIFEKIATEAAKLARYNKKPTVTSREIQTAVRLILPGELAKHAVSEGTKAVTKFTSA

SEQ ID NO: 11491 - protein, 376 aa, Lycium pilifolium
PRYDQYKDAWDTSVAVEIKVGDSIETVRFFHCYKRGVDRVFVDHPMFLEKVWGKTASKIYGPKVGQDYVDNELRFSILCQAALEAPRVLNLNCSKYFSGPYGEDVLFIANDWHTALIPCYLMSMYQSKGIYLNAKVAFCIHNIAYQGRFPFSDFSLLNLPDEYRSSFDFIDGYEKPIVGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPSRFEPCGLIQLHAMRYGT

SEQ ID NO: 11492 - protein, 966 aa, Cytophaga hutchinsonii
MKIDLTQRGSFQERHIGTSLSEKETMLKAIGVGSLDQLIDETVPANIRLANPLQLPKALSEEEFLVEFKKVVSQNEIFKTYIGLGYYNTLTPTVILRNILENPGWYTAYTPYQAEIAQGRLEALINYQTMVCELTGMEIANASLLDEATAAAEAMTLIYSLRKGTKKNATVFVVSKYTFPQTIDVLLTRSEPLGIKLEMVDPATADFTRTDIFGALVQSPDCNGNVADYTALISAAHANDTLVAFGSDLLSLTLIKSPGEMGADVVFGSSQRFGVPMGFGGPHAGFFATKEEYKRQLPGRIIGVSIDAEGKKAYRMSLQTREQHIRREKATSNICTAQVLLSVIAASYAVYHGPEGLKQIANRVHGFAAALSAIVTEFGFEQTNAAFFDTISIKAPGKGLAIKSAAEKRKINLRYEGDSVFVALDESVTVADLDQLIEVFAEAADKKVVAIDISNKYLRVEGALSGALLRTSAYMTHPVFNTYHTEHEMLRYLKHLENKDLSLTHSMISLGSCTMKLNATTEMIPVTWPEVGQIHPFVPASQVKGYHQLFNNIELWLSEITGFAGVSVQPNSGAQGEYAGLLVIRAYHESRGDTHRNIALIPTSAHGTNPASAVMAAMQVVLVKCDDAGNIDVADLKLKAEQHSKNLSCLMVTYPSTHGVFEESIIEICEVIHRHGGQVYMDGANMNAQVGLTSPGSIGADVCHLNLHKTFCIPHGGGGPGVGPIGVAAHLTPFLPGHAVVKAGGEKAISAVSAAPWGSASILPISYAYIAMMGSEGLTNATKNAILNANYIKSRLEKFYPILYTGTHGHCAHEFILDCRAFKTTIGIEVEDIAKRLMDYGFHAPTVSFPVAGTLMIEPTESESKHELDRFCDAMIAIRAEIAEIENGTADKLDNVLKHAPHTASVITADAWTRSYSRQKAAYPLPYLKTTKFWPSVSRIDSAYGDRNLFCSCIPTEEFAEAELAN

SEQ ID NO: 11493 - protein, 274 aa, Thlaspi goesingense
SYAPAIFRHSSSSSAQLLRPAALGSIRQRTSIASSVTPSLRFLRMASQSQHHESVSCASVPGDNGFPAIISPPIESARIGEVKRETKETNVSVKINLDGNGVADSSTGIPFLDHMLDQLASHGLFDVHVRATGDTHIDDHHTNEDVALAIGTALLKALGERKGINRFGDFTAPLDEALIHVSLDLSGRPYLGYSLEIPTQRVGTYDTQLVEHFFQSLVNTSGMTLHIRQLAGKNSHHIIEATFKAFARALRQATESDPRRGGTIPSSKGVLSRS

SEQ ID NO: 11494 - protein, 175 aa, Nicotiana tabacum
MGSKMSDPLVIGRVIGEVVDYFTPSVKMSVTYNSSKHVYNGHELFPSSVTSKPRVEVHGGDLRSFFTMIMIDPDVPGPSDPYLREHLHWIVTDIPGTTDCSFGKEIVGYEMPRPNIGIHRFVFLLFKQKKRQTVLTAPLSRDRFNTRKFAEENELGSPVAAVFFNCQRETAARRR

SEQ ID NO: 11495 - protein, 239 aa, Candida albicans
MAKAEFGTAKYQSKKLRAAGLQKLKFYCQLCSKQCRDSNGFKNHLSSPSHIKKVSEIHESGDSSKLIETYSTKFQDEFIKLLRINHGTKFINANKFYQEYIRERDHIHMNSTRWRSLTSFIKHLGKNGIVKVQTNDESNEEEEGFNLEIKLIDRTQTLNAYQIKSGGNSLEDNDEMNDDKLLQRQIKRGQEMEKDKDAEKSKTLEQLVPTSAPVKLTLKKKKTATTKKLVNAFDENESE

SEQ ID NO: 11496 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMLKLPMFGCTDAAQVVKEAAECKKEY

SEQ ID NO: 11497 - protein, 112 aa, Unknown
  marine gamma proteobacterium HTCC2080
MKLVTAIIKPFKMDDVRAALSDVGVQGVTVTEVKGFGRQRGHTELYRGAEYVVDFLPKLKLEVACAGDQVDGVVEAIISAAGTGKIGDGKIFVSELEQVIRIRTGETGTEAI

SEQ ID NO: 11498 - protein, 174 aa, Nicotiana tabacum
MASRVVEPLVVARVIGEVVDSFNPSVKLNVIYNGSKQVFNGHELMPAVIAAKPRVEIGGEDMRSAYTLIMTDPDVPGPSDPYLREHLHWIVTDIPGSTDSSFGREIVSYESPKPVIGIHRYVLLLYKQSGRQTVKPAATRDHFNTRRYTAENGLGSPVAAVYFNAQRETAARRR

SEQ ID NO: 11499 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 11500 - protein, 236 aa, Eragrostis unioloides
  misc_feature (235)..(235): Xaa can be any naturally occurring amino acid
RDRHGMDVGEWDPSKDKYIAMKYDAETVMEAKALNKEALQAAVGLPVDRKIPLVAFVGRLEEQKGPDVMAAAIPEILEQDVQIVLLGTGKKKFERLFKSAEAKYPDKVCAVVKFNAPLAHHIMAGADLLAVTSRFEPCGLIQPQGMRYGTPCACASTGGLVDTVVEGKTGFQMGRLSVDCKVVEPADVKKVATTIKRAIKIVGTPAYKEMVMNCMAQDLSWKGPAKNWENVLLSXG

SEQ ID NO: 11501 - protein, 316 aa, Triticum aestivum
  misc_feature (51)..(51): Xaa can be any naturally occurring amino acid
MGANGALEGEEERPRADGEEEEEGGATVFRGTNYSLPRTIAALALLDYDAXVVALQLVFMFIPLNDEDKLGRKIGRFICKYAMGYFPISLHVEDYNAFDSSRAYVFGYEPHSVLPIGVAALANHVGFMPLPKLKVLASSAVFHTPFLRQIWTWIGLIAATRKNFYSYLAAGYSCVVVPGGIQEILHMDHDSEVAFLNSRKGFVKIAMQAGCPLVPVFCFGQSKAYRWWRPGGKLFVNIARALKFTPIIFWGRYGTPIAFSSPMHVVVGRPIELKKNPLPTIDEINEVHGQFVGALQELFEKYKTKAGYPGLHLRVL

SEQ ID NO: 11502 - protein, 428 aa, Medicago sativa
MAQILAPSIQCQTRITKTSPLATPISSKMWSSLVMKQNKKVARSAKFRVMAINSGTINRVEDLLNLDITPFTDSIIAEYIWIGGTGIDVRSKSRTISKPVEHPSELPKWNYDGSSTGQAPGEDSEVILYPQAIFKDPFRGGNNILVICDAYTPQGEPIPTNKRHKAAEIFSNPKVEAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYILERITEQAGVVLTLDPKPIEGDWNGAGCHTNYSTKSMREDGGFEVIKKAILNLSLRHKVHIEAYGEGNERRLTGKHETASINTFSWGVANRGCSIRVGRDTEKNGKGYLEDRRPASNMDPYVVTALLAESTLLWEPTLEAEALAAQKIALKV

SEQ ID NO: 11503 - protein, 106 aa, Oryza sativa
MKADEDVRMIAAEAPVVFARACEMFILELTHRGWAHAEENKRRTLQKSDIAAAIARTEVFDFLVDIVPRDEAKDAEAAAAVAAGIPHPAAGLPATDPMAYYYVQPQ

SEQ ID NO: 11504 - protein, 112 aa, Unknown
  marine gamma proteobacterium HTCC2080
MKLVTAIIKPFKLDDVREALSHIGIQGITVTEVKGFGRQKGHTELYRGAEYVVDFLPKVKIEAAVTTEQADAVIEAITTASHTGKIGDGKIFVTAIDQIIRIRTGETGEAAI

SEQ ID NO: 11505 - protein, 235 aa, Eragrostis sessilispica
GIVNGMDVSEWDPSKDKYIAVKYDAETGIEAKALNKEALQAAVGLPVDRKIPLVAFVGRLEEQKGPDIMAAAIPEILEQDVQIVLLGTGKKFERLFKSAEEEYPDKVRAVVKFNAPLAHHIMAGADLLAVTSRFEPCGLIQLQGMRYGTPCACASTGGLVDTVVEGKTGFQMGRLSVDCKVVEPADVKKVATTIKRAIKFVGTPAYQEMVRNCMAQDLSWKGPAKIWENVLLSMG

SEQ ID NO: 11506 - protein, 153 aa, Triticum aestivum
  misc_feature (152)..(152): Xaa can be any naturally occurring amino acid
MDPCPFSRLTVRNLALKIPVASKPARSVVHPSSSPCFCKIQLKNFPLQSAVVPFIPPDSLFPDSLVHPIAATFHLSKSDLDKLAGKSIFSAKLCLKISIYTGRRGSTCGVSSGRLLGRVSVPLDLTGTVAKTTVFHNGWIRIGKDAKGSSAXF

SEQ ID NO: 11507 - protein, 236 aa, Eragrostis sessilispica
  misc_feature (235)..(235): Xaa can be any naturally occurring amino acid
GIVNGMDVSEWDPSKDKYIAVKYDAETAIEAKALNKEALQAAVGLPVDRKIPLVAFVGRLEEQKGPDVMAAAIPEILEQDVQIVLLGTGKKKFERLFKSAEEEYPDKVRAVVKFNAPLAHHIMAGADLLAVTSRFEPCGLIQLQGMRYGTPCACASTGGLVDTVVEGKTGFQMGRLSVDCKVVEPADVKKVATTIKRAIKFVGTPAYQEMVRNCMAQDLSWKGPAKTWENVLLSXG

SEQ ID NO: 11508 - protein, 321 aa, Bacillus thuringiensis
MVVNEKVELATFAGGCFWCMVSPFEEMEGIIKVVSGYTGGHKENPTYKEVCSETTGHYEAVQITFDANKMPYEELLNIYWRQIDPTDVGGQFHDRGQSYETVIFYHNEEQHKKAEASKEELAKSGRFSKPIATKILPAATFYPAEEYHQGYHKKNTFRYELYRKGSGRDAFIKQHWPKDNAHLKEKLNEMQFYVTQENGTEPPFRNEYWNHKEEGLYVDIVSGEPLFTSLDKFDSGCGWPSFTKPVMSASVKEKMDVSHNMTRTEVRSKEGDSHLGHVFPDGPGPNGLRYCINSAALRFIPKEELEKEGYGDFLILFGNKK

SEQ ID NO: 11509 - protein, 147 aa, Fritillaria agrestis
TMLSSVATAARAAPAQASMVAPFVGLKSTFAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 11510 - protein, 375 aa, Unknown
  Synechocystis sp. PCC 6803
MTMAMQPQTLVIKIGTSSLARPETGQLALSTIAALVETVCKLIGQGHRVVLVSSGAIGVGCSRLGLTERPKKMALKQAIAAVGQGRLMRTYDDLFSSLRQPIAQILLTRRELIERTAYVNAYNTFQALFELGVIAIVNENDTVAIDELKFGDNDTLSALVASLVEADWLFLLTDVDRLYSSDPRLDPDAYPIPLVKAAELAQLQVRTDSTGSAWGTGGMATKITAARIATGSGVRTVITHGQKPEQILAILQGANLGTQFEAQPRSDNARKRWIAYGLVPTGKIFIDAGAVQALKARGKSLLAIGVVALEGEFSATDAVIICDPQGQELGRGLVNYNCNELEKIKGLHSEAIAAVLGYVGPDTVIHRDNLVLQEN

SEQ ID NO: 11511 - protein, 385 aa, Isochrysis galbana
IFMKCAFVLAMAAPASALNLFGGAKKPGRGTLYSDITQTIGNTPVVKISKKLNPTQCDVYAKCEFFNPLSSVKDRLALAIIQDAEERGALKPGDTVVEATSGNTGIAVAMLCAQRGHKCVICMAEPFSVERRRLMRMLGAKVIVTPKAGKGTGMVRKAEELCEKHGWFLCHQFENEANWKYHEATTGPEILTDFSGKRLDYWVTGYGTGGTFHGAGRAIKKERPEVKIILAEPEDAGLLASGIPTERKADGAPVGSHPAFKPHPIQGWTPDFIPRCWRTPLDNLSDELVPIPGAHAIATAKALAAKEGILTGISGGGTMWAALEIAKKAPAGSIILAMLPDTGERYLSTPLYADIEADMNDEELDIARSTPSFQLIPGKEPVLAA

SEQ ID NO: 11512 - protein, 841 aa, Lotus japonicus
MAMAFVQDRESSIDRHLDSSGKYVRYTAGQVEALERVYTECPKPSSLRRQQLIRECPVLANVEPKQIKVWFQNRRCREKQRKEASRLQAVNRKLNAMNKLLMEENDRLQKQVSQLVCENGFMRQQLQAPSAAGTTDGNGDSVATTSRNSMRDANSPAGFLSIAEETLAEFLSKATGTAVDWVQLPGMKPGPDSVGIFTISQSCSGVAARACGLVSLEPNKVAEILKDRLSWFRDCRSLEVFTMFPAGNGGTIELVYTQTYAPMTLSPARDFWTLRYTTTLENGSLVVCERSLSGSGAGPNAAAAHQFVRAEMLPSGYLIRPCEGGGSIIHIVDHLNLQAWSVPEVLRPLYESSKVVAQRMTIAALRYVRQIAQETSGEVVYGLGRQPAVLRTFSQRLSRGFNDAVNGFNDDGWSVLNCDGAEDVIISVNSTKNLSGTSNPASSLTFAGGVLCAKASMLLQNIPPAVLVRFLREHRSEWADFNVDAYSAASLKAGSYAYPGMRPMRFTGNQIIMPLGHTIEHEEMLEVIRLEGHSLAQEDAFASRDVHLLQLCSGIDEDAVGACCELIFAPIDEMFPDDAPLVPSGFRIIPLDSKPGDKKDTMTTNKTLNLTSGLEVGASTNHTAGDASSCHNNRSVLTIAFQFPFESSLQDNVAVMARQYVRSVISSVQTVSMAISPSGTNPAAGAKLSVGSPEALTLARWVCQSYSYYLGTGLLRSDSLVGDLVLKHLWHHQDAILCCSLKSVPMFIFANQAGLDMLETTLVALQDITLDKIFDESGRKALFADFAKLMQQGFAYLPAGICMSTMGRHVSYEQVIAWKVLAEEDNSVHCLAFSFINWSFV

SEQ ID NO: 11513 - protein, 836 aa, Medicago truncatula
MSCKDGKGVMDNGKYVRYTPEQVEALERLYHDCPKPSSIRRQQLIRECPILSHIEPKQIKVWFQNRRCREKQRKEASRLQAVNRKLSAMNKLLMEENDRLQKQVSHLVYENGYFRQHTQNTNLATKDTSCDSAVTSGQRSLTAQHPPRDASPAGLLSIAEETLAEFLSKATGTAVEWVQMPGMKPGPESIGIIAISHGCHGVAARACGLVGLEPTRVAEILKDRPSWYRDCRAVDILNVLPTANGGTIELLYMQLYAPTTLAPARDLWLLRYTSVLEDGSLVICERSLKNTQNGPSMPPVQHFVRAEMLPSGYLIRPCEGGGSIIHIVDHMDLEPWSVPEVLRPLYESSTMLAQKTTMVALRHLRQISHEVSQSNVTGWGRRPAALRALGQRLSRGFNEALNGFTDEGWSMIGNDGVDDVTILVNSSPDKLMGLNLSFANGFPSVSNAVLCAKASMLLQNVPPAILLRFLREHRSEWADNNMDAYSAAAIKAGPCSFSGSRVGNYGGQVILPLAHTIEHEEFLEVIKLEGIAHSPEDAIMPREVFLLQLCSGMDENAVGTCAELIFAPIDASFADDAPLLPSGFRIIPLDSGKEVANNPNRTLDLTSALDIGPAGNKASNDYSGNSGCMRSVMTIAFEFAFESHMQDHVASMARQYVRSIISSVQRVALALSPSNLNSQGGLRTPLGTPEAQTLARWISNSYRCFLGAELLKSNNEGSESLLKSLWHHTDAILCCTLKALPVFTFANQAGLDMLETTLVALQDIALEKIFDDHGRKILCSEFPLIIQQGFACLQGGLCLSSMGRPISYERVVAWKVLNEEENAHCICFMFVNWSFV

SEQ ID NO: 11514 - protein, 245 aa, Cistanche deserticola
MTIRYWNINLEEMLEAGVHFGHGTRKWNPKMALYISAKRKGIHIINLTRTARFLSEACDLVFDAASRGKQFLIVGTKNKAADSVAWAAIKARCHFVNKKWLGGMLTNWSTTEMRLHKFRDLRMEQKMGRFNRLPKRDAAVVKRQLSRLQTYLGGIKYMTGLPDIVIIVDQHEEYTALRECITLGIPTICLIDTNCDPDLADISIPANDDAISSIRLILNKLVFAICEGRSSYSSSYIRNPGLIIR

SEQ ID NO: 11515 - protein, 415 aa, Ralstonia eutropha
MFERSRYTIDQIDPEVFAAIQKENQRQEDHIELIASENYTSPAVMAAQGSQLTNKYAEGYPGKRYYGGCEYVDIVEQLAIDRVKQLFGAEAANVQPNSGSQANQGVYFAVLKPGDTIMGMSLAEGGHLTHGMALNMSGKWFNVVSYGLNAQEDIDYDALEKLAQEKKPKLIIAGASAFALRIDFERIGKVAKSIGAYFMVDMAHYAGLIAAGVYPNPVPHADFVTTTTHKSLRGPRGGVILMKAEHEKAINSSIFPGIQGGPLMHVIAGKAVAFKEALTPEFKAYQEQVVKNAAVLAETLIARGLRIVSGRTESHVMLVDLRAKNITGKEAERILGEAHLTVNKNAIPNDPEKPFVTSGIRVGSPAMTTRGFKEEEARIVGNLIADVLDNPHDAGNIASVREQVSALTKRFPVYG

SEQ ID NO: 11516 - protein, 518 aa, Medicago truncatula
MACKDGNKHLMDNGKYVRYTPEQVEALERLYHECPKPSSIRRQQLIRECPILSNIEPRQIKVWFQNRRCREKQRKESFRLQGVNRKLTAMNKLLMEENDRLQKQVSHLVYENGYFRQNTQNATKDTSCDSVVTSGQHNMTSQHPPRDASPAGLLSIAEETLAEFLSKATGTAVEWVQMPGMKPGPDSIGIVAISHGCTGVAARACGLVGLEPTRVAEILKDRPLWFRDCRAVDIVNVLPTANGGTIELLYMQLYAPTTLAPARDFWLLRYTSVVEDGSLICERSLKNTQNGPSMPPVPHFVRADMLPSGYLIRPCEGGGSIIHIVDHMDLEPWSVPEVLRPLYESPMVLAQKTTMAALRHLRQISHEVSQPNVTGWGRRPAALRALSQRLSRGFNEALNGFTDEGWTMMGNDGVDDVTILVNSSPDKLMGLNLSFGNGFPSVSNAVLCAKASMLLQNVPPAILLRFLREHRSEWADHNMDAYTAAAIKVGPCSLTGSRVGNYGGQVILPLTHTIEHEE

SEQ ID NO: 11517 - protein, 224 aa, Arabidopsis thaliana
MYVITGYIGIEYSSPTLASAINNITPALTFILAIIFRMEKVSFKERSSLAKLMGTILSLIGALVVIFYHGPRVFLASSPPYVNFRQFSPPLSSSNSDWLIGGALLTMQGIFVSVSFILQAHIMSVYPAAFRVSFLYTVCVSIVTSTIGLVVEKNNPSVWIIHFDITLITIVTMAIVTSVYYVIHSWTVRHKGPLYLAIFKPLSILIAVVMGAIFLNDSLYLGWY

SEQ ID NO: 11518 - protein, 470 aa, Colwellia psychrerythraea
MLLWLRNDLRTHDNPALHYFLSRNALSQHDSAVPAKAIFFICEQQWQQHDWSPIKIDFIKRHAHALVKELALLNIELELIELDNFTQQKTYLHSYCQLHNITEVVANSEVEFNEQQRDKALYLELKASGIPLTLLEADVIVPKGKVLNQSGIMYKVFTPFKRAWLTYIQQGGFEYLGKVSVKSSAVNKADNQEEDQGSISSTWPLATVFEQQILPKFYQQKISTYKLNRDIPSIKGTSGISPYLAAGVISPRFVLRLLLNKHPDLLVASDSEEFSWLNEIIWREFYRHLLFHEQRLCKHQCYKENYQEMLWHNDAALFDAWCQGRTGYPLVDAAMRQLNQTGWMHNRLRMVVASFLTKHLLIDWRLGEKYFMQHLIDGDLASNNGGWQWAASTGCDAQPYFRIFNPIRQSERFDPKGVFIRKYIPELNNISDKAIHFPHQYIKDNELNIYWPAIVEHKEARLKALAFYKV

SEQ ID NO: 11519 - protein, 397 aa, Oryza sativa
MSNPESNPPPPSATSCPPPGSAAHAGHAPLCRSCGAPTTTPVPPPWSASSDSPPPAYRPIRMPAINAPTNTAAIVLSPVPQPLPVPPASPPFAFQVPAKRITSPDDIARFHDSVHGRHFLGFVAALSASVHGRKLSDPLPSPPSPVVSALLELISALSAFVASTPPLPHNSRYGNPAFRLWHEKLSDSANQLIAPIMATAGSPDLAGAEAELAPYLLDSFGNATRIDYGTGHETNFAAFLYCLARLGLITEADYPAVVLRVFAAYLDLMRTLQDTYLLEPAGSHGVWGLDDYHFLPFIFGAAQLIDHKYMKPKSIHNPDILDNFSKEYMYLACVAYVKKVKKGPFAEHSPMLDDISGVPHWKKVNSGLLKMYKAEVLEKVPIMQHFLFGSLIKWYGS

SEQ ID NO: 11520 - protein, 585 aa, Oryza sativa
MSPHAVMANVPEKTWWKEAVVYQIYPASFNDSNGDGLGDIPGIVSKIPYIKSLGVNTIWLSPIFASPQHDMGYDISDYRAIHEPYGTVEDVQSLIDQLHSNDMRLLMDLVVNHTSDEHAWFKESRSSKDNAKRDWYFWRDPKYDSEGNRKEPNNWKSIFGGSAWHFDEQTGQYYLALFLPSQPDLNWACEEMRQASYDDIRFWLDRGVDGFRIDSMNLMSKHPDLPDGKIVDDEPYQSGAEFFASGPKMHDYIREMRAIFDEYDAMTVGELGFTKDEQSVSEYVAKDRHELNMVFTGDIVDMDFGPDGKYGRDDFHPRKIRNITNMWQRVMPKVNGWNSVYLDNHDSGRSLSRYASDAPEHRATAAKMLATYLLTLSGTPFMLAGQEIGTANLGKDYGTEAYIDVEGRNHYDAVLKTRGGDHSKMGDVMREIQLKARDHGRLPMQWDSSANAGFSAEGTTPWMTINKDYVDWNVASQIDVPDSVLAYWRKMLALRKEHTDLLTYGSYKPLSELDTGEWVLGYERESFETGKKAVVLLNFSDKEQRVHVESPSREEYEVLVSNQEAGIKGGYVTLMPYGAVVLVSK

SEQ ID NO: 11521 - protein, 110 aa, Methanococcoides burtonii
MKKITAIIRPGKLETVKEELVTAGLNAMTIFDVKGRGEQKGICLQFRGKRNLIDMIPKIQIDIVVKNDEVVTVIQTIKHAVRTGKIGDGKIFGPPVEMMIGIRTGECITE

SEQ ID NO: 11522 - protein, 171 aa, Mycobacterium smegmatis
MGNHATAILAGGCFWGMQDLIRKQPGVVSTRVGYTGGQNDHPTYRNHPGHAEAVEIVYDPAQTDYRALLEFFFQIHDPTTKDRQGNDVGSSYRSAIFYLDEEQKRIALETIADVDASGLWPGKVVTEVTPASDFWEAEPEHQDYLVHYPNGYTCHFPRPGWKLPRRETASQ

SEQ ID NO: 11523 - protein, 154 aa, Unknown
  Populus tremula x Populus tremuloides
MQIFVKTLTGKTITLEVESSDAIDNVKAKIQDKEGIPPDQQRLIFAGKQLEDGRTLADYNIQKESTLHLVLRLRGGTMIKVKTLTGKEIEIDIEPNDTIDRIKERVEEKEGIPPVQQRLIYAGKQLGDDKTARDYNIEGGSVLHLVLALRGGCL

SEQ ID NO: 11524 - protein, 165 aa, Lycium sandwicense
RGVDRVFVDHPMFLEKVWGKTASKIYGPKVGQDYVDNELRFSLLCQAVLEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIKGRKINWMKAGILESHRVVTVS

SEQ ID NO: 11525 - protein, 220 aa, Arabidopsis thaliana
MGRRPARCYRQIKGKPYPKSRYCRGVPDPKIRIYDVGMKRKGVDEFPFCVHLVSWEKENVSSEALEAARIACNKYMVKSAGKDAFHLRIRVHPSHVLRINKMLSCAGADRLQTGMRGAFGKALGTCARVAIGQVLLSVRCKDAHGHHAQEALRRAKFKFPGRQKIIVSRKWGFTKFNRADFTKLRQEKRVVPDGVNAKFLSCHGPLANRQPGSAFLPAHY

SEQ ID NO: 11526 - protein, 136 aa, Unknown
  Burkholderia sp. 383
MRVAEKSPLQHSNQFDGTTQREDFMKLITAIIKPFKLDETREALSALGVSGITVTEVKGFGRQKGHTELYRGAEYVVDFLPKMKIEAAVSDDLVDQAVEAIERAARTGKIGDGKIFVTAIEQVIRIRTGETGADAL

SEQ ID NO: 11527 - protein, 368 aa, Arabidopsis thaliana
MSSLPDDLLLSIFARISRLYYPTLSLVSKSFRSLLASPDLYKARSLLGHTESCLYVCFHFDSGPNTHWFTLCRKPDGTLTNDTSKKKKSNGYVLATVPIPHSPPANFSSLVAVGSDIYNIGGSIYLGPSSSSVSILDSQSHMWREAPSLRVELMSHSASVLDRKIYVAGSYKDGNGDSNSCKNLFEVFDTKTQVWHPEPIPCSKTKGIFYSKSACIDGKFHVETTHGVVYAYKEGRWDKAIPTMFGMRASYSFCEINNVLFYIHRGVFRWYDTKLRMWRILKGLLGLPSLPENMFVRLADYGGKMAVLWEEDRPSCGAGGRDEMMIWCAVIALKRHLNFSFWGKVEWFDHVLTVPKQHVFVKALTASL

SEQ ID NO: 11528 - protein, 318 aa, Unknown
  Rhodococcus sp. RHA1
MTDIGISVAAAEFGRDMEQAYRTIGELIEQARAAGSSLLVLPEACLGGYLPSLGGGDETEEQRQRRLRSLPPALELDGPEIRRVVDMAGDLVITLGFCEADGADRYNAAVTVHGDGILGSYRKVHQPLGENLCYRAGDKYEAFDTPVGRMGMQICYDKAFPEAARTLALDGAEIITSLSAWPTARTNRVENPEDDRWKQRFDIYDRARATENQVVWVASNQAGTFGSLRFVCSAKIVGPGGEILATTGVEPGLASATLNVQAELDAIRSGGMYNLRDRRPELYGDVVADNRVSGTRLDASARPSFLRTTTAELEPVDA

SEQ ID NO: 11529 - protein, 344 aa, Solibacter usitatus
MKPLLILFAAAAFTWATADVGALAEANIGLGLAREGKYELAIQHYRAAAVLDPHLQGLYLNLGLAYVKLNKFPDAVPALEQAAQADPSSFQVRVLLGMSYYGCRRFDAAAAQLKRAAQQQPDNVELRYKLAQSYLWSGQYQEAIGEFRFLLTKDPDSAPVHMLLGDVLDAANQTEPATAEFEAAVKASPAEPEAHFSLGYLYWKQKRFAEACREFQAELAQHPKHVQAMTYLGDAEMHAGDEKAAEEHLRRALSLDSNTRLAHLDLGILLAGKDDSAAAARFLSEAIRIDPSKPDAHYRLGRLLRSQGRESEAEKEFAKVKELSREEPQTPLIKLPGQGSKQVP

SEQ ID NO: 11530 - protein, 73 aa, Sinningia insularis
  misc_feature (13)..(13): Xaa can be any naturally occurring amino acid
ISGTNGEVMPGQXEFQVGPSVGIEAGDHIWCARYLLERITEQAGVVLSLDPKPIEGDWNGAGCHTNYSTKSMR

SEQ ID NO: 11531 - protein, 418 aa, Unknown
  Rhodococcus sp. RHA1
MTEQHTVVVIGGGQAGLSISWHLVQRGIDHVVLERESIAHEWRDSRWDSFTLVTPNWQCTLPGYTYSGGDPDGFMNREQTYQFVRGYADTFDPPVREGVAVVAVRQSGSGGFDVDTTEGPMHADHVVVAVGGYHTPVVPRFAERLPADITQLHSSQYRSAGALPAGEVLVVGNGQSGAQIAEDLHLAGRTVHLVTGGAPRVARFYRGRDCVAWLHDMGTYDVSIADHPGGLGKRENTNHYVTGRDGGRDIDLRAFALAGMRLYGRLLDVVDGTLRFAPTLESSLDAADAVSESIKDSIDAYIDRAGIDAPREERYVPVWRPEREVTELELPTSGITSVVWSIGFRTDYRWLHAGVFDGEGHPTHNRGVTAVPGLYFLGLPWQHTWGSGRFAGVARDAEYLADRIELEAGVLPATATLA

SEQ ID NO: 11532 - protein, 337 aa, Medicago truncatula
MPTVTWGVIQGRKEKLVSRVIIFDYLKGLGIIPDELQDLELPSTVEVMRERVEFIQKLGLTIDDINQYPLILGCSVLHASVIVELAPVIKFLRGLDVEKDDIGFVLQKYPELLGFKLEGTMSTSVAYLVSIGVNPRDIGPMVAQYPYFLGMRVGTMIKPFVDYLVNLGLPKKILARMLEKRAYLLGYVLEETMKPNVDCLISFGLRKECLPSVIAQYPQIIGLPLTAKLSLQQYFYSLKLKIDSEGFAKVVEKMPQVVSLHQNVIMKPVEFLLGRAIPLQDVASMVIKCPQLIALRVELMKNNYYFFKREMGRPVKELVEFPEYFTYSLELRIKPGY

SEQ ID NO: 11533 - protein, 282 aa, Unknown
  Rhodococcus sp. RHA1
MVTTRLAALAGHFGRDIDRALLKLQALIESAANDGVDLLVLPDACLGGYISDLRRPDTEELPPALAADSPELKAVAKMAGRMTVCLGYTELCDGVRYNAAACVTGDGVLGSHRKVHQPAGESLAYAAGDSFTAFDTPVGRIGMLIDYDKTFPESARTLALDGARIIAALSAWPASITDRAARMTQDRQSRLFDLYDSARAAENQVVLVSSNQTGIQGGLRFLGQAKVVGPGGDVLARTGTKGGLAVAELDVDYEVNRARKVLRHLEERRIDTYRRLLDRGEH

SEQ ID NO: 11534 - protein, 326 aa, Arabidopsis thaliana
METEGRRREVVVSSLQFACSDDISTNVAAAERFVSLSSSLPLSNYQSLPSSSSFKFPYALVREAHAKGANIILIQELFEGYYFCQAQREDFFKRAKPYKNHPTIARMQKLAKELGVVIPVSFFEEANTAHYNSIAIIDADGTDLGIYRKSHIPDGPGYQEKFYFNPGDTGFKVFQTKFAKIGVAICWDQWFPEAARAMVLQGAEILFYPTAIGSEPQDQGLDSRDHWRRVMQGHAGANVVPLVASNRIGKEIIETEHGPSQITFYGTSFIAGPTGEIVAEADDKSEAVLVAQFDLDMIKSKRQSWGVFRDRRPDLYKVLLTMDGNL

SEQ ID NO: 11535 - protein, 163 aa, Lycium tenue
VDRVFVDHPMFLEKVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIVGRKINWMKAGILESHRVVTVS

SEQ ID NO: 11536 - protein, 814 aa, Triticum aestivum
  misc_feature (212)..(212): Xaa can be any naturally occurring amino acid
  misc_feature (499)..(499): Xaa can be any naturally occurring amino acid
MAASVEPRQSSFGRLDAPATAPPARNGSSNGGIRRRADSPVRGCGFPPLISPPRKAIVEEEEQDEEDEEPEEDWREAYGSQLQLEVEPSTRDPRDEGTADAWIDRNPSLIRLTGKHPLNCEPPLARLMHHGFITPAPLHYVRNHGAVPRGDWATWTVEVTGLVRRPARLTMDELATASPAAEVPATLVCAGNRRKEQNMVQQTVGFNWGAGXVSTSVWRGARLRDVLLRCGIMSPKKGQALNVCFEGAEDLPGGGGSKYGTSVTREWALDPSRDILLAYAQNGDPLLPDHGFPVRVLIPGCIGGRMVKWLRRIVVTPAESDNYYHFKDNRVLPSHVDAELANAEAWWYRPEYIINELNTNSVITTPGHDEILPINAFTTQRAYTMKGYAYSGGGKKITRVEVTLDGGESWMLCTLDIPEKPNKYGRYWCWCFWSVEIEVLDLLGAKEVAVRAWDQTHNTQPEKLIWNLMGMMNNCWFKVKVNVCRPHKGEIGLVFEHPXQPGNQTGGWMARQKHLETAEAAAPGLKRSTSTPFMNTVADKQFTMSEVRKHGSKESAWIVVHGHVYDCTAFLKDHPGGADSILINAGSDCTEEFDAIHSDKAKALLDTYRIGELITTGTGYNSDNSVHGGSSLSHLAPIREATKVAGAPIALSSPREKVPCRLVDKKELSHDVRLFRFALPSSDQVLGLPVGKHIFVCATIDGKLCMRAYTPTSMVDEIGQFELLVKVYFRDEHPKFPNGGLMTQYLESLQLGSCIDVKGPLGHVEYTGRGNFVINGKQRRAPPQAWAIGSWGGGRGNHPPMPGNRPGAWAEPNP

SEQ ID NO: 11537 - protein, 120 aa, Arabidopsis thaliana
  misc_feature (10)..(10): Xaa can be any naturally occurring amino acid
  misc_feature (17)..(18): Xaa can be any naturally occurring amino acid
  misc_feature (22)..(22): Xaa can be any naturally occurring amino acid
  misc_feature (26)..(26): Xaa can be any naturally occurring amino acid
  misc_feature (31)..(31): Xaa can be any naturally occurring amino acid
  misc_feature (36)..(36): Xaa can be any naturally occurring amino acid
  misc_feature (40)..(42): Xaa can be any naturally occurring amino acid
  misc_feature (46)..(46): Xaa can be any naturally occurring amino acid
  misc_feature (51)..(59): Xaa can be any naturally occurring amino acid
  misc_feature (62)..(64): Xaa can be any naturally occurring amino acid
  misc_feature (70)..(70): Xaa can be any naturally occurring amino acid
  misc_feature (76)..(77): Xaa can be any naturally occurring amino acid
  misc_feature (80)..(80): Xaa can be any naturally occurring amino acid
  misc_feature (82)..(82): Xaa can be any naturally occurring amino acid
  misc_feature (87)..(87): Xaa can be any naturally occurring amino acid
  misc_feature (89)..(89): Xaa can be any naturally occurring amino acid
  misc_feature (91)..(91): Xaa can be any naturally occurring amino acid
  misc_feature (93)..(97): Xaa can be any naturally occurring amino acid
  misc_feature (100)..(103): Xaa can be any naturally occurring amino acid
  misc_feature (106)..(106): Xaa can be any naturally occurring amino acid
  misc_feature (108)..(110): Xaa can be any naturally occurring amino acid
  misc_feature (112)..(112): Xaa can be any naturally occurring amino acid
  misc_feature (114)..(115): Xaa can be any naturally occurring amino acid
MASSMLSSAXVVTSPAXXTMVXPFTXLKSSXAFPVXRKTXXXITSXASNGXXXXXXXXXPPXXXKKFETXSYLPDXXDVXLXKEVDXLXRXKXXXXXSNXXXXHGXVXXXHXNXXGKPLA

SEQ ID NO: 11538 - protein, 369 aa, Unknown
  Polaromonas sp. JS666
MKAEKPSFPLNAWYAAAYDVEVVRALLPRTICKQKLVMFRKTDGTVAALEDACWHRLLPLSMGRLDGDELTCGYHGLVYNAQGRCTHMPSQETLNPSACVRAYPVLEKHRFVWVWPGDPAKADPALVPDLHWNDDAEWAGDGKMIKVKCDYRLVVDNLMDLTHETFVHSSSIGQRAVAEAPFVATHGDRTATVTRWMENIDAPPFWAGQINHSLGYQGPVDRWQVIKFEAPCTVTIDVGVAEAGTGAVPPGGNAGDACLSNRSRGVNGFVLNTITPETDGTCHYFWAFARNYCLGEQRLTHQLREGVASIFREDEHVLEAQQIAMDEHPDHQFYNLNIDAGSMWARKLIDKMISKEARPSAVIPIRSAA

SEQ ID NO: 11539 - protein, 201 aa, Isochrysis galbana
GGAVRKAEQIVAALGSKGKLLQQFENSDNPKIHRETTGPEIWADTDGSLDIFVAGVGTGGTLTGCAQYIKPLKPEVKFVGLEPVSSPVLSGGKHQGPHKIQGIGAGFIPGNVDLSMIDEVMQISDDDAIATARELAAHEGLMCGISSGASVFAAKQLAKRPENKGKTIVCIIPSFGERYLSTILYANLWEEAAAQTAEPLD

SEQ ID NO: 11540 - protein, 308 aa, Vigna radiata
PVVDMKNLNNEERGATMEKIKDACENWGFFEVVNHGISIELMDSVDRLTKEHYKRCMEERFKEMVASKGLECAESEINDLDWESTFFLRHLPVSNISEIPDLADDYRKVMKDFAVELEKLAELVLELVCENLGLEKGYLKKAFYGSKGPNFGTKVSNYPPCPKPELIKGLRAHTDAGGIILLFQDHKVSGLQLFKDGHWIDVPPMRHSIVVNLGDQLEVITNGKYKSVMHRVITQTDGNRMSIASFYNPGNDAVIAPAEALVKEDESSKVYPKFVFDDYMKLYAGLKFQAKEPRFEAMKAIDGPIATV

SEQ ID NO: 11541 - protein, 289 aa, Unknown
  marine gamma proteobacterium HTCC2080
MSHGVATAASAGAAIVFLPELTLSRYPADTLPSGPADSTAEVLLGGPTHQFAAQLARDNDVMVHCSIFEHTDAADHRGFNTAMVVDTSGEIVAQTRKLHIPVTTGYYEDHYFSPGPADNPYPVHALSLDSGEMAVGLPTCWDEWFPEVPRCYALGGAELLCYPTAIGSEPDYPNFDTEPLLRQVVVGHAIANGLFIVIPNRFGSEGTLEFYGSSFIVDPLGRVLAQAPKDEEATLVVDIDLGLREDWLTLFPFFGTRRPDTYSALTEAVQNPRQPTGEGLHGGIPGLTS

SEQ ID NO: 11542 - protein, 288 aa, Ostreococcus tauri
MGNDECVTDDGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGVHAPLGAPLARWPVSLVIHFVLADHYYSRCS

SEQ ID NO: 11543 - protein, 823 aa, Unknown
  Arthrobacter sp. Q36
MEIWPGSAYPLGATFDGTGTNFALFSEHAEKVELCLFDDEGTETRVTLREVDGYVWHCYLPQIQPGQKYGYRVHGPYDPANGQRFNANKLLLDPYAKAVAGQIDWDPALFSYNMGDPSSKNDADSAPHMMMGVVINPFFDWDNDQNLRIPYHKSVIYEAHVKGLTELHPEIPEEQRGTYAGVAHPAVISHLQKLGVTAIELMPVHQFVNDGTLQEKGLSNYWGYNTIGFFAPQNTYSSTGDTGQQVQDFKAMVRSLHRAGIEVILDVVYNHTAEGNHLGPTLSFKGIDNEAYYRLVEDDKQYYMDYTGTGNTLNVRQPHSLQLLMDSLRYWVTEMHVDGFRFDLAAALAREFYDVDRLSTFFELIQQDPVVSQVKLIAEPWDVGPGGYQVGNFPPQWTEWNGKYRDTVRDFWRGEPATLGEFASRITGSADLYEHSGRRPVASINFVTAHDGFTLRDLVSYNEKHNEANGEDNKDGESHNRSWNCGVEGPTDDPKVLSLRARQQRNFIATMLLSQGVPMILHGDEMGRTQQGNNNGYCQDSELTWVNWDSVDQPLIEFTAAVNSLRAKHPTFRRSRFFDGRPVRRGEGERLPDIVWLDPDGNLMSPEDWDSGFGRSVGMFLNGDGIQGHDDRGRRITDVNFLLYFNAHDGDVEFTLPPDEYAPAWDVIIDTAGEGADSKPADAGTILSVAAKSLVVLRAHSAPEEEPDHSVAASLAALTQTATAETAALTAPAVPEPAKTKKPAADPVAEPADPPVADPADPVADPVADPAPEPAAEPAKSAAEPGAEPAKDPEEQPAEKPARKPAAKRGGHLRAVKPAGEDA

SEQ ID NO: 11544 - protein, 337 aa, Thermoproteus tenax
MKIGVLTGGGDAPGLNIAVYTFVKLAERKHEVYAIYHGWRGLLNKEVKRVSSRDLLDFAFSGGTYIRTSRTNPFKDEERARLLESNVKELGLDVVVAIGGDDTLGAAGEAQRRGILDAVGIPKTIDNDVYGTDYTIGFDSAVNAAIEATESFKTTLISHERIGVVEVMGREAGWIALFTGLSTMADAVLIPERPASWDSVAKRVKEAYNERRWALVVVSEGIKEYGGPKDEYGHSRLGGVGNELAEYIERSTGIEARAVVLGHTIRGVPPTAFDRILAVRYATAAYEAVENGRYGVMVAYSNGDIAYVPIVDVVGKNRLVSGYWMRLYETYWPDLAG

SEQ ID NO: 11545 - protein, 284 aa, Unknown
  Azoarcus sp. BH72
MVLRRAVLLDKGRSSHQSYEVWDTPDFGRVYLLDGRLMAAEAVANYGHEALIHPVALAHPEPRTALVLGGGDGGSARELIRHPCIEAITVVELDDAVVALARRYLPAIHDGAFQNGRVRLTIGDAHAHVLANAESVAGVRYDLIVFDLTDPDGTAAALHEASFFAACKACLRPGGAIVVQLGSPHYHRSQVVALVARLAQSFACVRPYLADVPVYGGAWAFASASDALDPSGLDPVEIERRVRARGLAVRHYNGNLHRAQFALPTDLQTALRAALSNPQFDGPT

SEQ ID NO: 11546 - protein, 598 aa, Klebsiella oxytoca
MITISSLSHSAKSADSYAYNKETLHIRFRTVKGEVAKVSLWIGDPYQWEEGGLDGGNLGGSDAHGWSGGNEVHMEKEGQSESYDHWFAAFTPCKRRSRYGFILYGNNGEKLLFGERRCVDISKPPVAETELSNLSNFFCFPYINPGDVLSTPEWVKKTIWYQIFPERFCNGDPSISPENVQPWGTPPDSKNFMGGDLQGIINKLDYLQDLGVNGLYLCPIFTANASHKYDTVDYFNVDPHFGGNDRFKELVQKAHQRGMKVMLDAVFNHIGNQSPLWLDVVKNGDKSPYADWFWIKKFPVYPSGDKNEWDFRNFNYETFGNVIEMPKLNTENPACRDYLLQVARYWIEEFDIDGWRLDVANEVDHEFWRAFRRTVKSIKPDCYILGEIWHEGMPWLRGDQFDSLMNYPLMQATTDYFALQAYDKKTFIDIVTHAYLCYPRNVNEVMFNLLESHDTSRLLSLCGNDKRKARLAYLFMFSQVGSPCIYYGSEVGMNGSRAMGSEDNRKCMIWDEQKQDLEFKSFIKDLILWRKKHSEWNDPKIHWNNVDHPAVVAFSRGEVHFLLNNSDESLAINYQGRTLSLTPFGFYIIGLDHKDIIS

SEQ ID NO: 11547 - protein, 805 aa, Capsicum annuum
MTDQAESSDSKNAKKDFSTAILERKKAANRLVVDEAVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLGIHTKNMKLAEEVDLERISKDTHGYVGADLAALCTEAALQCIREKMDVLDLEDDTIDAEVLNSMAVTNEHFQTALGTSNPSALRETVVEVPNVSWEDIGGLENVKRELQETVQYPVEPPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKHTQGFSGADVTEICQRACKYAIRENIEKDIEREKRRQENPDSMDEDVDEVPEIKPAHFEESMKYARRSVSDADIRKYQAFAQTLQQSRGFGTEFRFADTSGGATAAADPFATSNAAADDDDLYS

SEQ ID NO: 11548 - protein, 245 aa, Cistanche deserticola
MTIRYWNIDLEEMLEAGVHFGHGTRKWNPKMAPYISAKRKGIHITNLTRTARFLSEACNLVFDAASRGKQFLIVGTKNKAADSVAWAAIKARCHFVNKKWLGGMLTNWSTTEMRLHKFRDLRMEQKMGRFNRLPKRDAAVVKRQLSRLQTYFGGIKYMTGLPDIVIIVDQHEEYTALRECITLGIPTICLIDTNCDPDLADISIPANDDAISSIRLILNKLVFAICEGRSSYSSSYIRNPGLIIR

SEQ ID NO: 11549 - protein, 456 aa, Candida albicans
MVLPHEPEFQQAYDELVSAVEDSTLFKEEPQYKKVIPVVSIPERIIQFRVTWENDKGEIEVNNGFRVQYNSALGPYKGGLRFHPTVNLSILKFLGFEQIFKNALTGLSMGGGKGGSDFNPKNRSDNEIRRFCVSFMRQLARYIGPDTDVPAGDIGVGGREVGFLFGAYKQMRNNWAGVLTGKGLTWGGSLIRPEATGYGCVYYVEKMIEKATNGKETFKGKRVAISGSGNVAQYAALKVIELGGTVVSLSDSKGSIISKNGITADQVYAIAAAKLKFKSLEEIVADSVQLFSGDHSVEYLAGVRPWTKVGQVDVALPSATQNEVSGEEAKALVDAGCKFIAEGSNMGSTKEAIEVFEANRDSNGVWYAPGKAANCGGVAVSGLEMAQNSQRVQWTNEEVDAKLKEIMYTCFENCYKTAQKYSIEKNENGLPSLLKGANIAGFIKVADAMFDQGDVF

SEQ ID NO: 11550 - protein, 245 aa, Cistanche salsa
MTIRYWNINLEEMLEAGVHFGHGTRKWNPKMAPYISAKRKGIHIINLTRTARFLSEACDLVFDAASRGKQFLIVGTKNKAADSVAWAAIKARCHFVNKKWLGGMLTNWSTTEMRLHKFRDLRMEQKMGRFNRLPKRDAAVVKRQLSRLQTYLGGIKYMTGLPDIVIIVDQHEEYTALRECITLGIPTICLIDTNCDPDLADILIPANDDAISSIRLILNKLVFAICEGRSSYSSSYIRNPGLIIR

SEQ ID NO: 11551 - protein, 1112 aa, Porphyromonas gingivalis
MTAASVVFGAEAQVTESGLPYWKDIRTVSVNKEPARSSFMTYADRSEALTGKYEKSSYYRLLNGTWRFFYAESEAHLPAGITDSSANTKGWHDIQVPGNWEIQGHGVAIYTNHGYEFQPRNPQPPKLPEANPVGVYRREIEVPTDWMERDIYLHIAGAKSGLYVYINGHEAGYSEDSKNPAEFLINPYVHAGKNTLTLKVYRWSTGSYLECQDFWRISGIERDVFLFAQPKAAVKDFSIKSTLDDSYRNGIFSLKADLRNRRGEASELSLTYELLDAEGKTIATETRSTLIAAGGERTLSFEAQPGTVHTWTSEHPYLYKLLMTVREKGKVTEVIPSRVGFRRIEIKPIEEKAANGMPYVCFFVNGQPIKLKGVNMHEHNPATGHYVPEELMRRDLELMKQHNLNAVRLAHYPQDRRFYELCDEYGLYVYDEANIESHGMYYNLRRGGTLGNNPEWLKPHMDRIANMFERNKNHPCVTIWSLGNEAGNGYNFYQAYLWLKEADRDLMARPVNYERAQWEWNTDMYVPQYPDAKWLEGIGRAGSDRPVIPSEYAHAMGNSTGNLWGQWQAIYKYPNLQGGFIWDWVDQGILRTDDKGKSYWAYGGDFGVDAPSDGNFLCNGLVNPDRTPHPAMQEVKYVHQNVGFEAVDAAKGHFRITNRFYFTNLKKYRLRYTVSANGKALQSKVIGLDIDPQTSSDIIVPVDGLRPTAGMEYFVDFSVQTLQAEPLIPIGYEIAHDQFRLPIDAERTAYRATGPTLHTSTEGDELKVVSSKVDFVFNKKSGLVTSYRVDGREFFKDGFGIQPNFWRAPTDNDYGNGAPRRLQIWKESSRDFQVVEAGLSNEGNTVLLKATYLLAAGNLYRLTYKIYPDGVVNVKVQFSSTDMETDEYEWSEAARTATFSPGREALRKEASILEVPRIGVRFRLPAEMNEVRYFGRGPDENYIDRNYGATVGLYTTAADKMYYNYVRPQENGHRTDTRWLMLHGRGLGLGIVADETIGFNALRQAVEDFDSEEAKHRPYQWNNYSQTEIQNRDESKARNVLRRQHHVNDVPVRDFVEVCVDMKQQGVGGYDSWSALPEPWHRLPSNREYSWGFTLLPVRSVGQMATATRYAY

SEQ ID NO: 11552 - protein, 617 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTARMSDKFQAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 11553 - protein, 236 aa, Cistanche sinensis
MTRRYWNIDLEEMLEAGVHFGHGTRKWNPKMAPYISAKRKGIHITNLTRTARFLSEACNLVFDAASKGKQFLIVGTKNKAAGSVAWASIKARCHCVSKKWLGGMLTNWSTTEMRLHKFRDLRIEQKGGRLNRLPQRDVAAVKRQLSHLQTYLGGIKYMTGLPDIVIIVDQHEEYAALRECTILGIPTICLIDTNCDPDLADILIPANDDAMSSIRLILNKLVFAICEGRSSYIRNI

SEQ ID NO: 11554 - protein, 199 aa, Haemophilus parasuis
EEGDIIIDGGNSNYPDTNRRVKALVEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 11555 - protein, 246 aa, Unknown
  Oceanospirillum sp. MED92
MAKITMRDLLKAGVHFGHQTRYWNPKMSKFIFGARNKIHIINLEHTLPALNGALDNIQNMAANKNKVLFVGTKRAASKIVKEEASRAGMPYVNHRWLGGMLTNYKTIRQSIRRLRDLESQSQDGTFEKLTKKEALMRQREMEKLERSIGGIKEMGGLPDALFVIDVDHERIAVNEANKLGIPVIGVVDTNSNPDGVDVVIPGNDDALRAIQIYVKSAADACLEGTEATAGDKNEFVEVEENQAAAE

SEQ ID NO: 11556 - protein, 510 aa, Ralstonia solanacearum
MNRGNALLVLAVFVVASCGLAYELIAGALASYLLGDSILQFSSIIGAYLFAMGIGSWVSRYVADDALLARFVDLELLVGLFGGVSAAALFLLFALESAPFRLVLYALVTVIGVLVGMEIPLVMRMLHRRQAKFSDLVSRVLTFDYLGALAVSLLFPLVLAPRLGLVRTGFLFGLCNTAIAVWTLWHFRAELGLSARLRGAMAWRAGMVGAALLAGFAASDRLTHWSERALFGDEIIHAISSPYQRLVVTRWKDDLRLYINGNLQFSSRDEYRYHEALVLPALESVRGARRVLVLGGGDGLALRQILKYPQVEHVTLVDLDPRMTSLFSHAEALVALNQHAFSDPRVTVVNADAGQWLQTAADMFDVAIVDFPDPSNFSIGKLYSVPFYRLLSRHVADTGLVVIQATSPYFAPRSYWCVDATLKEAGYRTWPYHALVPSFGEWGFILAAPGRADFRPPTTYRVPTRFLDADTTHQMFSFAPDMPRPQVEPNRLNNQSLVRYFEEDWHGVLR

SEQ ID NO: 11557 - protein, 490 aa, Unknown
  marine gamma proteobacterium HTCC2080
MSLSVVWFKRDLRLADHAPLSAAVALGQPMLLVYIVEPELLKNPHYRRRHWHFIAQSLADLNHQLQPHGTKVWVLEGDPITLFTAINQSQRIHHLFSYEETGLEVTFARDREVITWAKSQGVCWQEFPTNGVQRGRKHRKGWNHRWGKLMAAPAETIIPAQLNALRSDLPEDLKGALCQRLGGWLPQHPNFQPGGEQQAHQTLEDFLTHRAGGYQRHISKPEGSRQHCSRLSPHLAWGNLSIRQVQQALKERQSKGGWARPLSAFESRLHWHCHFIQKFESECTMEFESINRGFLNYPRDQNSHLVAAWCEGQTGFPYVDACMRCLEATGYLHFRARAMLVSFLTHHLWQDWRLGVTWLGSLFLDFEPGIHYPQMQMQAGVTGINTIRIYNPVKQSLEHDPTASFIRRWVPEIADLPTPLVHQPWLRSPLEHVLHPVDYPEPIVNLDVSHRRARDVLWELKSDPMICQERERILNRHVERRFQSRFVERD

SEQ ID NO: 11558 - protein, 355 aa, Streptococcus thermophilus
MCYNENVKYIKGVSGIMKRIAVLTSGGDAPGMNAAVRAVVLKAISEGIEVFGINRGYAGMVEGDIFKLDAKRVENILSRGGTFLQSARYPEFAQLEGQLKGIEQLKKYGIEGVVVIGGDGSYHGAMRLTEHGFPAVGLPGTIDNDIVGTDYTIGFDTAVATATEALDKIQDTAFSHGRTFVVEVMGRNAGDIALWAGIASGADQIIVPEEEYDINEVVRKVKEGYESGEKSHHIIVLAEGVMGAEEFAAKMKEAGDTSDLRATNLGHVIRGGSPTARDRVLASWMGAHAVDLLKEGIGGVAVGIHNEQLVESPILGTAEEGALFSLTEDGKIIVNNPHKARLDFAELNRSLANLK

SEQ ID NO: 11559 - protein, 157 aa, Lycium villosum
RGVDRVFVDHPMFLERVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIMGRKINWMKAGILE

SEQ ID NO: 11560 - protein, 1100 aa, Photobacterium profundum
MKRMLINATQKEELRVALVDGQKLFDLDIESPGHESKKANIYKGRITRIEPSLEAAFVDYGSERHGFLPLKEVARDYFPANYTYQGRPNIKEVLKEGQEVIVQVDKEERGNKGAALTTFISLAGSYLVLMPNNPRAGGISRRIEGEERTQLKAALSTLELPKGMGLIVRTAGVGKSAEELEWDLNVLLNHWSAVKEAADSNSAPFLIHQESNVIARAIRDYLRRDIGEILIDSPKIFDRAREHIKLIRPDFLSRVKRYEGEVPLFSHYQIESQIESAFQREVRLPSGGSIVIDPTEALTSIDINSARATKGGDIEETAFQTNLEAADEVARQLRLRDLGGLVVIDFIDMTPVRHQREVENRLREAVRMDRARVQIGRISRFGLLEMSRQRLSPSLAEASHHVCPRCTGTGVVRDNESLSLSILRLIEEEALKDNSAQVLAIVPVAVASYLLNEKRRSVQHIEKFHTVRVVIVPNAEMETPHFEVLRIREGDQKDTLSYQMPKVIEAIKEAEAAEAPQQERVIKKHEEPVLQGFASPKTPAPVVAVKPKPAAPAKAVAAAEAKPGLFNRLFSALTNLFSASTEQVPEKKVEEKQDNRNDNRRGDRQGNRRNDTRRNDTRRNKDSSRRNNRQDSDRDNSETSGEQRQQRQQRPRRNEKPQHDKTAKQRSPRSEDKRQPRKDDVQAPKAPRRQDEQQPNVEKPVVDVVENKPNIEQEKVATVKLRRQRRQLSQKIRITDDVEKAPVEAQAIEAVEAAPLVEEQKQSSPLQEMGTAVAKEALATDTDTSEQDSEQNTEQEAGQRRNRRSPRHLRASGQRRRRIRDTREEKSDHVSHPTTDTKGYAAVETTDAINDMENVISIVEKPKAIRPVTGVASPEMAMGKVWARASKPSVETITETPVEVPTQPEAIIENVISAEQAIEAETLSGVAMPELAMGKVSPMRSTVEATTTSVETQSVTIDEPIIIEPVVAAPVVEKVEVEKVEVEAVVEKPVAEVKVIAEETTVKATTEKAVVEKPVANVEMPTPVVAAAVQGNDVATTATSPRGRHTVSPMTKAPAVAEPEIEEITVAIAPLRDAKVQSRQAGSQTATSKAMAPMTKPSYD

SEQ ID NO: 11561 - protein, 313 aa, Parvularcula bermudensis
MTDPIAPAAQNNALIKDATIETFQADVLQASMSVPVVVDFWASWCGPCRQLGPLLEAQITARGGKILMVKVDTDQNQLLAQQLRIQSLPTVMAFVGGQPVDGFQGALPDSQIGQFLDRVEQIAAQAGLGGGQGETDPEAMLDDAEALLDQGDVATAMQIFAGVADATEAGSDAQARALAGLARCALSAGNKDQASDMLKAIPEEKQSLPAVSRAQALLELGGNAPDSAALTAARDRAQQSPEDPAALFALGEAEIDNGSVDAGMDALLKSIALDKDWDEGAARQKLLKLFDALPPTHPSVKTGRRRLSSLLFA

SEQ ID NO: 11562 - protein, 686 aa, Pyrococcus abyssi
MAEKLIPVVCPWCSVGCRLYIVSVDGYPRKIEFDYNPKTPNKGKLCPKGVSSYQHYVHPDRLKKPLKRVGEKGEGKFEEISWEEAIEIIAKKFKEILESHGPEALAFLGSERCSLEDNYLLQKLARALGTNNVEFAGRLCQSSNFVARSKIFGGPAQTNPFDDIVKSKVILIWGYNPAATNPVLFGQYFEKAILDNGAKLIVVDPVKTETAKYAHIHLQPYPGTDLAIALAMLHVIIKEELYDKDFVAERVNNFDALARAVEKYTPEWAEKISGVPASLIHEAAVLFATGGNATVVLNEGINQHANGSITAMAISNLIAITGNIGKEGVFSGVIPGAHCGLCAAVPGVNCAQLPGPVPLNEETAKKFSELWGFEVPSKPGLHYQAIFDAMLEGKIKGIYIMGQNPARSLANSSKIEEALKRAFVVVADIFPTETTKYADIVLPAAAWYEKTGTVITQNRRVMRSFQAVKPPGEAKPDWEIIVMLAKSIGLGEYFNYSSVDDVLREINNVIPALKGATPERLAKNLEGCMYPCPDENTETPRLFLKGFPTKSGKAELIPVEWKPPGEVPDEEYPFWLTNFRLVGQFHTGTMSNRTKSLKKRWPGPYVMINERDAKRLGIRSGDLVRVETRRGSLVARAEVTENIREGVVAMPWHWGFNYLTKDDAIDEFSKMPELKTAACRISKVEG

SEQ ID NO: 11563 - protein, 250 aa, Unknown
  Fragaria x ananassa
MGKCYPTVSEEYKKAIDKAKRKLRGLIAEKNCAPLMLRLAWHSAGTYDVKTKTGGPFGTMKQSAELAHGANNGLDIAVRLLEPIKEQFPILSYADFYQLAGVVAVEVTGGPDVPFHPGREDKPEPPPEGRLPDAGKGSDHLREVFGKTMGLSDQDIVALSGGHTLGRAHKERSGFEGPWTPNPLIFDNSYFTVLLSGEKEGLLQLPTDKALLSDPVFRPLVEKYAADEDAFFSDYALAHQRLSELGFAEA

SEQ ID NO: 11564 - protein, 641 aa, Ostreococcus tauri
MDEVFGRASGASGDGLSMGVRAPTWAEDARAEAEQREERRFEADLAAAISASLGEKQSATDDGGRGESGMMEEERAMLEARRQSLRERFGGSAMAERFYSRYSLNFSERLADGFYSIYPNPVDGTFPKTFDLESLRAFVADDGEGEREVSIVDRSTDLLLQECDASPELARLVAERMGGPAESDETLRERWEVERRRLSKEHGGAVFPIGSIKVGLQRHRALLFKSVADFLEIPSQIVRGKYYCGHDDGVMIIVMCGGMKRMLNLMDSPGRMQQPFNSDSKTPSVYSDSGRMSPDNTADAGHFGVMPQENLPSHETKETPLRLQIAVDLTIDPSQILLGERIGIGSFGEVHRALWRGTEVAVKRFLDQDISRNLLDEVTFEIDIMRRLRHPNVVLLMGAVTVPGNLSIVTEFLHRGSLFKLLHREQPPAVAAALDNRRRMRMAMDVVRGMHYLHSFEPMIVHRDLKSPNLLVDKSFVVKVCDFGLSRMKRNTYLSSKTNAGTPEWMAPEVLRNEASDEKADVWSFGVILWELATVLEPWQGLNPMQVVGAVGFAGKQLEIPSDVDEVIANMCRDCWQTNPRERPSFEHLAESLRSVPLAPSLPSDPPSRERSRLTVPTVPPVPEEASKPNPDDWSDDRFRV

SEQ ID NO: 11565 - protein, 253 aa, Prochlorococcus marinus
MLIEDTIFYRPDWKWHNFLKYLVNNLSKYNCLEKKIPSEYSYKDSTYGSKKSKKNVNLSTWGVTHKKRIQFARAVCINSPNYSVLNFLIIPNTIYNVPFFGVDFVSLPNSHLLVLDFQPSLKIQNQYNNELLEKLIKLKNHCHSSLPLAEKMSADVARFFSPGVIWSKLPKEERSDFLIANQLYTSFKEYLDLYLEILFESQQVNLNLQKELINGQNNYLKYRIDNDPARPMLSSLFGKEFTESLIKEVLFTT

SEQ ID NO: 11566 - protein, 408 aa, Ostreococcus tauri
MPSANDASGPAAAAAERPKTLYQGVERDGFGMRLLSKMGWVEGKGLGKNKDGIATHVRAKKRMDFVGVGADARNDASGKTAVDWTMNTLAFDDVLKSLNRTHSAESLERTVTTASSSSEEELEEAPAEKKRKASKEERRAAKKEAKRAKKEAKKAKKNEIVVNRSVVSHAGRYQKRVSQKMVSNYSSQDLAQILGGGFVSVPEVRADNAGSTSASEESKEEEKTGNGEKKKLIAVERPKWVFDPPPEDWWGWRVGFRPEGHGKKDVGEDVDALERKRGFDEDDQINLFQDTHAGANKNRQGLGAKRGRDAGADFAGSKKTFGEGDEITDAERAVIAKAKQVKWQKIALKMLSKADGSMKTKKFREKVLQKCGCAESERDVYWDAAFHVLSRTEAFTSLEEDVVKLINN

SEQ ID NO: 11567 - protein, 492 aa, Mycobacterium bovis
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFGQLEIKTILHRLLRRYRLELSRPDYQPRWDYSAMPIPMDGMPIVLRPR

SEQ ID NO: 11568 - protein, 441 aa, Burkholderia thailandensis
MSDKATRIDLLDWRTPPMRAFHLTWIAFFVCFFAWFACAPLMPLIAREFRLSADQVANVNIAAVAATIAVRLVVGPLCDRFGPRRVYAGLLALGAIPVFAVTFSHDYPTFLLCRLGIGAIGASFVITQYHTSVMFAPNVVGTANAAAAGWGNAGAGAAQAAMPLLAAAALLLGLPDACAWRAALAVPGVAMLVMAIVYWRGTQDCPQGDFVALRARGVTVDSGKKGGFASFAAACANYRVWMLFVTYGACFGVEVFMHNIAALYYVNHFQLSLKDAGLAAGIFGLLALFARALGGWLSDRVAARRGLDVRATLLFALIVGEGLGLLWFAHAGSVPVAVVAMVAFGLFTHMACGATYALVPFIDRRALGGVAGIIGAGGNVGAVAAGFLMKGVGDIEQTLTLLGLFVTVSAFCALAVRFSAEHKAREAALRERALAANGFTH

SEQ ID NO: 11569 - protein, 560 aa, Mycobacterium tuberculosis
MTPQKSDACSDPVYTVGDYLLDRLAELGVSEIFGVPGDYNLQFLDHIVAHPTIRWVGSANELNAGYAADGYGRLRGMSAVVTTFGVGELSVTNAIAGSYAEHVPVVHIVGGPTKDAQGTRRALHHSLGDGDFEHFLRISREITCAQANLMPATAGREIDRVLSEVREQKRPGYILLSSDVARFPTEPPAAPLPRYPGGTSPRALSLFTKAAIELIADHQLTVLADLLVHRLQAVKELEALLAADVVPHATLMWGKSLLDESSPNFLGIYAGAASAERVRAAIEGAPVLVTAGVVFTDMVSGFFSQRIDPARTIDIGQYQSSVADQVFAPLEMSAALQALATILTGRGISSPPVVPPPAEPPPAMPARDEPLTQQMVWDRVCSALTPGNVVLADQGTSFYGMADHRLPQGVTFIGQPLWGSIGYTLPAAVGAAVAHPDRRTVLLIGDGAAQLTVQELGTFSREGLSPVIVVVNNDGYTVERAIHGETAPYNDIVSWNWTELPSALGVTNHLAFRAQTYGQLDDALTVAAARRDRMVLVEVVLPRLEIPRLLGQLVGSMAPQ

SEQ ID NO: 11570 - protein, 499 aa, Colwellia psychrerythraea
MCGFVVSVTKNLVDFNEKVGPDTLLRGLDSYNSDVFYSNGSCLYFEFSHLYITEPEVNQPLQSNSQVLVLNGEIYNYQELAARLNIDPTKFNDVSTFFKHIECYGLLDTLMRSNGMYSGFLFNKITGQCEIFTDHVGKKPLLVWNSRIGWHVGTGIDFNYVDEKTTEIKVVPPGISAFDIKTGNTFKEYSHLPIKGNESNLIDTLEDAISLRVPKNRPFAVALSGGLDSSIIAYILEARLSENAHYYVVGERYPDSVLALLEHLNICLSRVHLIKPPPADELLKLITKTCHITKSYNPSIISNGLATLLLCKAVHQDGIRVMLSGEGADEFFCGYQGMYNGRNDPTEMRANLIKDLHFTELRRLDLISASFSVEARCPFLDQRVTQIAMMLDVKNLCDIPMNIGKTLLRDTFKHLLPHSIINAPKESFDITSGLQKLVIDELQKEFKSERVALRTIFEKTLANYPIVNHHYFSHYPAFDKMIDRRDLKYRKIEFSINTQ

SEQ ID NO: 11571 - protein, 342 aa, Pisum sativum
MAAESTVELESSMKEHRDDDEKSNGFSVSAVSMDVEGGDKDPSGNGVSSVIPGWFSEISPMWPGEAHSLKIEKILFQGKSEYQKVMVFQSSTYGKVLVLDGVIQLTERDECAYQEMITHLPLCSIPNPKKVLVIGGGDGGVLREVARHSSIEKIDICEIDNMVVEVSKQFFPEVAVGFNDPRVTLRIGDGVAFLKAAPEGTYDAVIVDSSDPIGPAQELFEKPFFQSVARALRPGGVMCTQAESIWLHMDIIEDIVSNCRHIFKGSVNYAWTTVPTYPSGMIGFMLCSTEGPLVDFKHPVNPIDQKDCQKSVRPLKFYNSEIHTAAFCLPSFAKRKIGSKET

SEQ ID NO: 11572 - protein, 334 aa, Pisum sativum
MAAPENTLHSTDSPLKRQREDEVNGVSDTLSKEPQPNGLSSVIPGWFSEISPMWPGEAHSLKVEKILFQGKSDYQDVMVFQSATYGKVLILDGVIQLTERDECAYQEMITHLPLCSIPNPKKVLVIGGGDGGVLREVARHSSVEKIDICEIDKMVVDVSKEYFPDIAVGFADPRVTLNIGDGVAFLKAAPEGTYDAVIVDSSDPIGPAQELFEKPFFESVARALRPGGVVCTQAESIWLHMHIIEDIVVNCRQVFKGSVNYAWTTVPTYPSGMIGFMLCSTEGPSVDFKHPVNPIDENDSQQAARPLKFYNREIHSAAFCLPSFAKRAIASKEN

SEQ ID NO: 11573 - protein, 311 aa, Prochlorococcus marinus
MKLNSVTKNTKATVLAKIEGRNPAYSVKCRIGANMIWDAEQKGLLKQGQTIIEPTSGNTGIALAFTAAARGYKLVLTMPESMSLERRRVMAVLGAELILTEASKGMPGAIAKAKEIAQSDPQKYFMPGQFDNPANPEIHFKTTGPEIWNDCDGNIDVLVAGVGTGGTITGISRYIKGEKGKSMLSVAVEPSHSPVISQTLNGQEVKPGPHKIQGIGAGFIPKNLDLSVVDRVEQVTNEESIAMALRLAKEEGLLVGISCGAAAVAAVRLAEQEEFAGKTIVVVLPDLAERYLSSVLFADVPTGIIEGPEAT

SEQ ID NO: 11574 - protein, 405 aa, Arabidopsis thaliana
MGKECYYLSWILKFHLLLVLIQLVDSGSTIRFLPGFQGPLPFELETGISDLFELQTTTKNKNAGPIAFKAEEYNGSIPSLVSTTYAWTKVASILYLDQPVGTGFSYSRNPLADIPSDTGVAKPVNEFLHKWLDKHPEFLSNPLYVAGNSYSGIVIPTIVQEISNGNHLDSKPQINLQGFVLGNPATDTDIDLNSRIPFAHGKALISDEHYESLKRSCQGNYISVNPRNTKCLKLLEDFKKCVSGISEEYILKPDCMWLYSCMANLHSLSEYWANEKSVRKALLVNEGTVRKWIRCNTEIAYNKDIRSSVPYHKYISIEGYRSLVFSGDHDMLVPFLGTQAWIRSLNYSIVDDWRPWMVQNQVAGYTRTYANKMTFATVKGGGHTSEYKPVETYIMIKRWLSGQPL

SEQ ID NO: 11575 - protein, 579 aa, Oryza sativa
MEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRVGPFTVPPASLATFNVVAVLIWVPVYDAVLVPLARRATGNDRGLSHLQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVRSDWASAAGQTGGDLMPQESIAGDGSGVNLEIR

SEQ ID NO: 11576 - protein, 313 aa, Pyrus communis
GGLGDVLGGLPPAMAANGHRVMTISPRYDQYKDAWDTEVTVELKVGDKTETVRFFHCYKRGVDRVFVDHPLFLERVWGKTASKVYGPVTGVDFKDNQLRFSLLCQAALEAPRVLNLNNSKHFSGPYGEEVVFIANDWHTALLPCYLKAIYKPRGIYSTAKVAFCIHNIAYQGRFAFADFALLNLPDEFKSSFDFSDSSEKPVKGRKINWMKAGILESDKLLTVSPYYAEELVSAVEKGVELDNIIRKTGIFGIVNGMDVQEWNPLTDKYTIIKYDASTVADAKPLLKETLQAEVGLPVDRDIPVIGFIGRLEE

SEQ ID NO: 11577 - protein, 440 aa, Arabidopsis thaliana
MTLCSLSFGVKSLRYIGVGEEDEDQMFYYFIKSESNPKTDPLLLWLSGGPGCSSFTGLIYENGPLGFKVEAYNGSIPTLVSTTYSWTKVANIIYLDQPVGTGFSYSRNPLADIPSDTGSAKRVDEFLRKWLTKHPEYFSNPFYAGGNSYSGKMVPVIVQEISNGNCIYGKPQIRLQGYVLGSPVTDYDLDRNSRIQFAHGMALISNELYESMKRTCGGNYIFVDPLNTECLELIKDYDNCVSGIYENLILVPKCDLTSPDCHVSILVDFALATKLNHKRRIFTKLLSQSYRSMLSDYWANNESVRRALKVVEGTTGRWERCKWTLQNNKDIKSSIPYHKKNSIQGYRSLIFSGDHDMLTPYVGTQDWIRSLNYSIIDKWRPWMILDQVAGYTTTYANKMTFATVKVTPISTFSIDKNAKLFYITLLNRFVGLICRVAGTR

SEQ ID NO: 11578 - protein, 441 aa, Arabidopsis thaliana
MGSWIPKLLLLQLVLLLTKHADSSSIIKYLPGFEGPLPFELETGYIGVGDEDEDQMFYYFIKSESNPEEDPLLVWLSGGPGCSSFTGLVYENGPLGFKVEAYNGSIPTLVSTTYSWTKVANIIYLDQPVGAGFSYSRNPFADRPSDTGSAKLVNEFVRKWLAKHPDYFSNPFYVTGNSYSGKVIPAIVQEISNGNYICCKPQINLQGYVIGNPVAYYDHDKDSRIPFAHGVALISDELFESLKRSCGGSYSIVDPLNTECLKLIKDYHKCVSGIYQELILKPKCETTSPDCYTYRYLLSIYWANNEIVRRALKVVEGSKGKWERCDLSVRSNQDIKSSIPYHMNNSIKGYRSLVISGDHDMTIPFLGTQAWIRSLNYSITEKWRPWMILDQVAGYTKTYANKMTLATVKVCSFIHILIFFVNIKIESCFTSVVIGLWVWLL

SEQ ID NO: 11579 - protein, 313 aa, Eriobotrya japonica
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCRAALEAPRVLNLNSNKYFSGPYGDDVLFIANDWHTALLPCYFKAIYKPKGIYENAKVVFCIHNIAYQGRFPISDFSVLDLPEKLKGSFDFIDGYNKPVKGRKINWMKAGILESDRVVTVSPYYAQELVSGEDKGVELDNIIRKTGITGIVNGMDVQEWNPATDKYLDTKYDNTTVLDAKPLVKEALQAEVGLPVDRNIPVMGFIGRLEE

SEQ ID NO: 11580 - protein, 426 aa, Spinacia oleracea
MAIEHEDDLKDEKNPRPLDEDDIALLKTYGLGPYSASIKKVEKEIKDMSKKVNDLIGIKESDTGLAAPSQWDLVSDKQMMQEEQPLQVARCTKIINPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 11581 - protein, 313 aa, Chaenomeles speciosa
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYFKAIYKPKGIYENAKVVFCIHNIAYQGRFPISDFSVLNLPENLKGSFDFIDGYSKPVKGRKINWMKAGILESDRVVTVSPFYAQELVSGEDKGVELDNIIRKTSITGIVNGMDVQEWNPATDKYLDTKYDNTTVLDAKPLVKEALQAEVGLPVDRNIPVIGFIGRLEE

SEQ ID NO: 11582 - protein, 313 aa, Peraphyllum ramosissimum
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYFKAIYKPKGIYENAKVVFCIHNIAYQGRFPISDFSVLNLPENLKGSFDFIDGYYKPVKGRKINWIKAGILESDRVVTVSPFYAQELVSGEDKGVELDNIIRKTGITGIVNGMDVQEWNPATDKYFDTKYVITTVLDAKPLVKEALQAEVGLPVDRNIPVIGFIGRLEE

SEQ ID NO: 11583 - protein, 479 aa, Vibrio fischeri
MDYKHNLQCVWFRHDLRTIDNPALQAAVDNQQPTFALFIYSESQWKKHNKAPIQIDLIKRRLVELKNELEQLNIPLIVISSPLFSEIPAKITALFNELSVNALFANKEYEHDERLRDTQVYESLLNTNCYFFDAKCILPVGTIINRTQQPYKVFTPFKKAWKASFYQQQPHITKTGKSVLCDPKLIKKLSLNNDDSFVFSSSNESGSWPVSTKAIIDILRQFCRQKVSQYHNNRDYPEIQGTSQLSPYLAIGAISAKQCALRLHLEANYELNQGEDIWLDELIWREFYTHLLHFYPNLSKNQAFLSYDKYIEWDNNLDHFERWCKGETGFPIVDAAMKQLNTTGWMHNRLRMITASFLVKDLHIDWRWGEQYFMSKLIDGDFASNNGGWQWCASVGCDSSPYFRIFNPITQGKKFDADCTFIKHWLPELKALSNKEIHHPNPAPLLKSDNYPDQIVDHAQQRIKVIEVYKQAKQLDIAS

SEQ ID NO: 11584 - protein, 127 aa, Hordeum vulgare
MARTKQTARKSTGGKAPHKQLATTAARKSARTTGRLKKLHRYRPGTVALREIRKYQKSTELLIRKLPFQRLVREIAQDFKTDLRFQSHAVLALQEAAEAYLRGLFEDTNLCAIHAKRVTIMPKDIQL

SEQ ID NO: 11585 - protein, 472 aa, Lactococcus lactis
MAQANFGVVGMAVMGKNLALNVESRGYTVAIYNRTTSKTEEVFKEHQDKNLVFTKTLEEFVGSLEKPRRIMLMVQAGAATDATIKSLLPLLDIGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRILGLSNAEIQAIFEEWNEGELDSYLIEITKEVLKRKDDEGEGYIVDKILDKAGNKGTGKWTSESALDLGVPLPLITESVFARYISTYKDERVKASKVLSGPALDFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGTPIPTFTSAISYYDSYRSENLPANLIQAQRDYFGAHTYERTDKAGIFHYDWYTED

SEQ ID NO: 11586 - protein, 234 aa, Triticum aestivum
  misc_feature (51)..(51): Xaa can be any naturally occurring amino acid
PRVRVRMLIHEIRSTLDRHTILKTTLVELGRTLGLHASALASPSRSGSSLXLTHTMRHHIPVGSSVEINLPVVNQVFSTNRAIIVPHTSPLARIHPVQGRHVPPEVAAVRVPLLHLSNFHPELLAKSYAIMVLMLPSDSARKWLAHELQLIEVVANQVAVALSHAAILEESMRARDLLTEQNVTLDLALREAEMAMHARNVNKVGVELMQPEDADNVATINSSASAAKVHNAEP

SEQ ID NO: 11587 - protein, 145 aa, Clostridium acetobutylicum
MNSKKKIALVAHDNRKKALISWCEANSEVLSNHSLCGTGTTAKLIKEATGLEVFPYKSGPMGGDQQIGAAIVNEDIDFMIFFWDPLTAQPHDPDVKALLRISVLYDIPIAMNESTAEFLIKSPIMKEQHERHIIDYYQKIRKDNF

SEQ ID NO: 11588 - protein, 1328 aa, Alternaria brassicicola
MAAETYSSVSAIIRNLARQHDPTRDPSFSAQVSANGAKTAVNAIALPGPESDEKTQLQQELSALCSRIDFLEHKSNHAANQQGQFPLTPAQEPSDEGALYTPAGVFRGNNGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDINGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSSASRANERKLNLAYDVSYKVPDYVVGDSFRLRQIILNLVGNAIKLTEPGEVKVAISMAQEQECDPDHYVFQFAVSDTGIGIRGDKLNLIFDTFQQADGSTTRKFGGTGLGLSISKRLVTLMGGRMWVESDAGKGSVFYFTYKVRLGKPAIQAIQPQLVAYKQHTVLFVDQGNTGFSDEITEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNITLPGKGNDNGGASSSSGGLPSPGKKRPQLEARGFTERGGAQSPNLLAVDQTDNGSVERLLLRSHSS

SEQ ID NO: 11589 - protein, 358 aa, Lycium villosum
  misc_feature (28)..(28): Xaa can be any naturally occurring amino acid
  misc_feature (254)..(254): Xaa can be any naturally occurring amino acid
RYDQYKDAWDTSVAVEIKVGDSIETVRXFHCYKRGVDRVFVDHPMFLERVWGKTASKIYGPKVGQDYVDNELRFSFLCQAALEAPRVLNLNCSKYFSGPYGEDVLFIANDWHTALIPCYLKSMYQSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVXDAKPLLKEALQAAVGLPVDKKIPLIGFIGRLEEQKGSDILVAAIHKFIGLDVQIIVLGTGKKKFEQEIEQLEVLYPDKAKGVAKFNVPLAHTITAGADFMLVPS

SEQ ID NO: 11590 - protein, 277 aa, Oryza sativa
MAGGGDELKLLGMWASPFALRAKLALSFKGLSYDYVEEDFKNKSELLLSSNPVHKKVPVLIHNGKPICESQVIVQYIDEVFPDAGVTLLPADPHDRAVARFWASYIDEKLFGAWIPVFRGKTEEEKAEGVKQTFAVAEKLEGALSECCKGKPFFGGDTVGYVDVVLGGFVAWVHAIEEVFGLNQFDAAKTPLLAAWLERFDELDAAKEAMPDIGRLVELEKMRQAQAQAAFLAVRLYLLLFLQPCFISSCCRTVYVSPCVAEVANWVFYNVLRPYCL

SEQ ID NO: 11591 - protein, 242 aa, Unknown
  Polaromonas sp. JS666
MMMNKYLLTLGAVALAAWVFVGGGMGVSSAEEKAVKLPAPAMDMPATAQAGPQAGSATAVFAGGCFWGVQAVFQHTQGVLNAVSGYAGGEKATASYEMIGSGRTGHAESVQITYDPKKISYGKLLQIYFSVAHDPTTLNRQGPDSGTQYRSAVFYQDANQKKVTESYIAQLDAAKVFPNKIVTQLTPLNGFYPAEAYHQDYATLHPNQPYIARFDLPKIANLKTVMPEVYRDKPVLVSQAGK

SEQ ID NO: 11592 - protein, 150 aa, Triticum aestivum
NKFLQKSRLVPVRNSRDIVDPRVREKKKVPKQSLFGNITEALDFSQVRSEKDAELLYEARDSIKDEGRMTREQYAALRRKIGGTYKDFFKSYVEVDGEYVEEGWVDKTCKVCKKDTRGEPRQVDNLGRYMHVACAENSKPTNFFSKLFSR

SEQ ID NO: 11593 - protein, 421 aa, Ostreococcus tauri
  misc_feature (58)..(65): Xaa can be any naturally occurring amino acid
MAAAADAKAIVLASTCVLVATCATHFGAGRALWSDRGWRAWQPMRGRRAFVALQPVGXXXXXXXXGAGEPLVGVSLAFFDETRAGGRTSETMDARNVARVVQMLTVLHVVHAPHMAVFAVLGTAYALGRWRTLAAVVALYASTYVTRQKSLERGQRKWEQFQTWTLRTVEGAAKSWYGSVRVVHDGKVSEAAHSSPHVFAYHPHSMVPAGAVWFHMLPDFSARFRGIQPVTLAASVLFKAPIVRELAAWLGVRAVSREIFRSTLREQGAVVVCPGGQHEMQEHGGPMEETIVLCTKHKGFIRIAIEERARVVPVICFGESKSWTNIMAKPGRYLYRRFRFGFTPLLAVGYLGILPLPRRVPITFVIGEPMVLPDPDALTGLAKESDVDAFHASYYSQVERLFDEHKSKAGFPELCLVMKND

SEQ ID NO: 11594 - protein, 313 aa, Dryas octopetala
GGLGDVLGGLPAAMAANGHRVMTVSPRYDQYKDAWDTSVQVELEVGGRTETVRFFHCYKRGVDRVFLDHPWFLEKVWGKTGSKIYGPRAGEDYKDNQLRFSLLCKAALEAPKVLNLNSNQYFSGPYGEDVIFIANDWHTALLPCYLKTFYKPRGIYKNAKVTFCIHNIAYQGRFPFADFLRFDLPDQLRSSFDFIDGYNKPVKGRKINWMKAGILESDRVITVSPYYAQELVSGEDKGVELDNIIRKTGITGIVNGMDVQEWNPATDKYLDVKYDATTVLDAKPLLKEALQAEAGLPVDRNIPVIGFIGRLEE

SEQ ID NO: 11595 - protein, 261 aa, Prochlorococcus marinus
MSSLDFGTVYLVGAGPGDPDLLTLKAYRLLRQCGALVHDALVPKEVLELVPESCERHFVGKRRERHWVPQSKTNELLVELAQSHSCVVRLKGGDPFLFGRGGEEAAYLQSHGVSVEVVPGITAGMAAPAYVGIPLTHRCGGSSVTFVTGHEKIDKQRPSVNWKDLASASDSLVIYMGLHNLAYIVEELIAGGLDPATSAAIIQQGTVVGQRYLKAPLEQLVQRVQSEGFAAPSIVIVGAVVDEQVAECAPQPAEVVMPIKS

SEQ ID NO: 11596 - protein, 518 aa, Cucumis melo
MEIWFIFLISLSICSLLTSIFTHFQTSTKLPPGPPSIPILTNFLWLRRSSLQIESLLRSFVAKYGPVLTLRIGSRPTVFIADRSIAHKILVQNGALFADRPPALSVGKVITSNQHNISSASYGPLWRLLRRNLTSQILHPSRVRSYSEARKWVLDILLNRLQSQSESGNPVSVIENFQYAMFCLLVLMCFGDKLDESQIREVENVERAMILSFQRFNILNFWPKFTKILFRKRWEAFFQLRKNQEKVLTRLIEARRKANGNRENKAQNEEEEIVVSYVDTLLELELPDEKRKLNDDELVTLCSEFLTAGTDTTSTALQWIMANLVKHPEIQNKLFVEMKGVMGNGSREEVKEEVLGKLPYLKAVVLEGLRRHPPAHFVLPHAVKEDAELGNYVIPKNVTVNFMVAEIGRDPKVWEDPTAFNPERFVKGGKEKEEQVAEFDITGSKEIKMMPFGAGRRICPGFGLAILHLEYFVANLVWRFEWKVVDGDEVDMSEKVELTVAMKKPLKAKIHPRIHTES

SEQ ID NO: 11597 - protein, 424 aa, Parvularcula bermudensis
MTETINDLPQVMLEGAKAARAASRTMGTLSAEKRVEALEAIARHLEAAKDDILSENKKDLDAAEDNGLDAPMVDRLRLDDERLGGIIQGVRDVAALDDPVGDVLAEWERPNGLKMSRIRVPLGVIGVIYESRPNVTVDASVLCLKSGNAVMLRPGSDSFHTSRRLVECVRAGLKEAGLPEGAVFMVPTTDRAAVGHLLSGLEGNLDVIVPRGGRSLVERVSQEARVPVIGHLEGICHVYVDKGADLEKAKAIVVNAKLRRTGVCGAAETILIDKARADELVPEIAGALIDAGCEVRGDETAQARHDGIVPATEEDWSTEYLAPIVSMRVVDGVRGAIDHISHYATGHTESILTEDEDTAEAFLREVDSAIIIHNASTQFADGGEFGMGAEIGISTGRIHARGPVGCEQLTTFKYVVRGDGQTRP

SEQ ID NO: 11598 - protein, 381 aa, Ostreococcus tauri
MRSVGTRRATAVRWTRGGRRGTRARGAATEAATGTDAETARARVETVKAVVKPRGGLRKEFADERSLATPREDSKVREFWFPVMFESKFKENDDEFEFNLLDEMWVLRKLTGSEYVCESKKSRRTLSTGVKDGLVMVWPGTCEAPTEQLPSHFAPPSGYTIHAELIIDDVPVEHGLLMENLLDLAHAPFTHTGTFAKGWGVPNMVKFASSKLRKSGDGWHDMGNFLANGKSEGSWKPYPIDMKFLAPCMVDSHIGLAQAGAVGSGAQFKEGVTADECPKHLHQLHVCLPSAPGRTRLLYRMSLDFANWAQYIPGIEMIWTEMANQVLGEDLRLVVGQQDRMQRGGRVWAHPVAYDKLGLHYRRWRNVMEGRDVEECEVEMS

SEQ ID NO: 11599 - protein, 313 aa, Fallugia paradoxa
GGLGDVLGGLPPAMAANGHRVMTVSPRYDQYRDAWDTSVLVEIEVNGRVETVRFFHCYKRGVDRVFVDHPSFLEKVWDKTGSKIYGPKTGVDYKDNQMRFSLLCQAALEAPRVLNLNSNEYFSGPYGEDVVFICNDWHTALLPCFLKTIYKPMGIYKSAKVAFCIHNIAYQGRFGIEDFKLLHLPDQLGGSFDFIDGYNKPVKGRKINWMKAGILESDRVVTVSPYYAQELVSGEDKGVELDNIIRKTGITGIVNGMDVQEWNPATDKHLHVNYDQTTVLDAKPLLKEALQAEVGLPVDRDIPLIGFIGRLEE

SEQ ID NO: 11600 - protein, 953 aa, Oryza sativa
MLSLQQQGGGDPRPQQPAAAPALLGGADWLGFGRAAAELDESVASSPASFLLPPAPPVDARAQAQPEPKPKQLGAVDVERHLALAHQNYRSGKYKEALEHGNIVYEKNPRRTDNLLLLGAIYYQIRNYDMCIAKNEEALAIDPNFAECYGNMANAWKEKGDVDLAIRYYLTAIQLRPNFCDAWSNLASAYTRKGRLNEAAQCCRQALAINPRLVDAHSNLGNLMKAQGFIQEAYNCYIEALRIDPQFAIAWSNLAGLFMEAGDLDKALLYYKEAVKLKPSFADAYLNQGNVYKTMGMSQEAIISYQRAVQARPDYAMAYGNLATIYYEQGQLDIAIRCYNQAIICDPQFVEAYNNMGNALKDAGRVEEAINCYRSCLALQANHPQALTNLGNIYMEWNLISAAASFYKAAISVTSGLSSPLNNLAVIYKQQGNYADAITCYTEVLRVDPTAADALVNRGNTFKEIGRVNEAIQDYIQAATIRPTMAEAHANLASAYKDSGHVETAIVSYKQALRLRPDFPEATCNLLHTLQCVCDWENRNAMFRDVEEIIRKQIKMSVLPSVQPFHAIAYPIDPMLALEISCKYAAHCSLIASRFGLPSFVHPPPVPVKAEGKHCRLRVGYVSSDFGNHPLSHLMGSVFGMHDRDNVEVFCYALSQNDGTEWRQRIQSEAEHFVDVSAMTSDMIVRIINQDKIQILINLNGYTKGARNEIFALQPAPIQVSYMGFPGTTGAAYIDYLVTDEFVSPTCYSHIYSEKLVHLPHCYFVNDYKQKNRDCLDPVCPHKRSDYGLPEDKFIFACFNQLYKMDPEIFDTWCNILKRVPNSALWLLRFPAAGETRVRAHAAARGVRPDQIIFTDVAMKNEHIRRSSLADLFLDTMKEYEDRAVDLALNPAKLQALTNKLKEVRMTCPLFDTARWVRNLERAYYKMWNLYCSGRHREPFKVIEDDNEFPYDR

SEQ ID NO: 11601 - protein, 313 aa, Filipendula vulgaris
GGLGDVLGGLPPAMAANGHRVMTVSPRYDQYKDAWDTSVQLELEVFGKVETVRFFHCYKRGVDRVFIDHPSFLERVWGKTGSKVYGPKAGVDYEDNQLRFSLLCQAALEAPKILNLNSNEYFSGPYGENVVFICNDWHTALLPCYLKTLYKPNGMYTNAKVAFCIHNIAYQGRFGFEDFELLDLPDRLRSSFDFFDGYNKPVKGRKINWMKAGILESDRVVTVSPYYAQELISGEDKGVELDTIIRKTGITGIVNGMDVQEWNPATDKYLEVKYDKTTVLDAKPLLKETLQAEVGLPVDRDIPVIGFIGRLEE

SEQ ID NO: 11602 - protein, 320 aa, Burkholderia pseudomallei
MSTPKHAKVLILGSGPAGYTAAVYAARANLSPLLITGIAQGGQLMTTTDVENWPADADGVQGPELMQRFLAHAQRFNTEIVFDHIHTAKLHEKPIRLIGDSGEYTCDSLIIATGASAQYLGLQSEEAFMGRGVSACATCDGFFYRGQNVAVVGGGNTAVEEALYLTGIAKKVTVIHRRDKFRAEPILVDRLLEKEKEGAVEIKWDHVLDEVTGDDSGVSGVRIKHVTTGATEDVAVQGLFIAIGHKPNTDIFKGQLEMKDGYIITNSGLSGNATGTSVPGVFAAGDVQDHIYRQAITSAGTGCMAALDAQRYLESLHDHK

SEQ ID NO: 11603 - protein, 358 aa, Brassica oleracea
MVAVERVESLAKSGINSIPKEYIRPKEELESINDVFQEEKKEDGPQVPTIDLQDIESEDETIREKCIEELKKAAMDWGVMHLINHGVPVELMERVKKSGEEFFGLPVEEKEKYANDQAKGKIQGYGSKLANNASGQLEWEDYFFHLVYPEDKRDLSLWPKTPTDYIEATSEYAKCLRLLATKVFKALSIALGLEPDRLENEVGGIEELLLQMKINYYPKCPQPELALGVEAHTDVSALTFILHNMVPGLQLFYEGKWVIAKCVPDSIVMHIGDTLEILSNGKFKSILHRGLVNKEKVRISWAVFCEPPKEKIVLKPLPEMVSVESPAKFPPRTFAQHIEHKLFRNEQEELVTEKKDEV

SEQ ID NO: 11604 - protein, 812 aa, Selaginella moellendorffii
MDPQNKYARYTNEQLEILELVYNECPKPSSLRRQQLMKEAPILANIAPKQLKVWFQNRRCREKQRKETSRLHGLNSKLTALNKILVENNDHLAKQSTQLTLQKHTLRKHLYGDCSSQRPPMEASQVCRGALAAGSSEIAGTSELPNIQHLSLDHGPVGLSALAEQSLADFLAKATGTAVDWIQLLGMKPGPDSFGIVAISHGCDGIAARALGLVALEATRVSEWRIVEVLKDKTSWLWDCRRSDVIHICSSENGSTMEIMHTQLYAPTTLAPPRDFCTLRLTTSLEDGNLVVCERSISDAECLSYVPSTQYFVRAEMLTSGYLVRPCEGGSCIVHIIDHLDLKPSSVSEVLTRPLYRSSSLLAQRMTVKALRFLKHLAQEEIGEIVVGGGQQPSVLRSLSRRMARGFNDAVNGFPDDGWCTMGGDGLDNVAVSCNATINFSLSKFQSDRLSSLAGVLCAKASMLLQNVHPSYLIRFLRDHRSEWGCNMDFFQQDAASRSHGKRQAHVPLFHTAKEDFLEAVILEGHYSAEDGTILSREIYLLQLCSGIEDEDIDGCSQLIFAPVDANLSDDMPLLSSGFRVLPLCDDMDDIVKRQSDSEELRSGKRKNHKFARSILTIAFQFMYEVGTRDTVAEMARNYIRNVMDFVQRITLSLAASSLGSSSADAPFVSSKGASLIHQILQSYSVSHGVDIIPRNFTDKDAIVMLFWHYAAAIICCSLKATPEFVIANQAGLQMLETKIEELQTVSWERTIGYGLDSELAKLLREENGELPEGIAQTSKGKRVCYERGLVWRVDEQHLALMFVNWSFQAGI

SEQ ID NO: 11605 - protein, 815 aa, Ostreococcus tauri
MSAARRVDAVANHLHAAASVNAVDAAAYASDLRAMKMDIERFLDESNANPIMVRLAWHDAGTYDASKAHMPWPRAQGANGSIRHESELAHGANAGLVKAIGYLRPLKEKYARVSWADAIQLAGATAIEHAGGPRIPMRYGRADAEVGAMEGNLPDAEAPFGDGASDAATHLRNVFGRMGFNDREIVALSGAHTIGRAFKERSGTTNHGYGAKNGTKFTGCPYMNARADGKEGSIGMPGGASWTRRWLAFDNSYFHREKLTDEKDLIWLSTDDALVTDPGFAPHFKRYAHDQNAFFYDFSAAFAKLSELGSRFVVGASGITSKSLTCRRCALNALLRQSFFANSLFPNSQLKDEFPDPSVRVVLHEFCASLFSLLGNLFTVLFLRVRTRLLRQDAVESDLSSLLQALTLLGRLDVLIFGIQTQACLFERDDFPFDATVGFIRHRKVIDCGKRGVAVSLKHPLHLLNSRIHAVPLSGELRHDRIDGIRATFLRRVLLVIREVHLSVLGAATDGAGKGEAPSGRMKRARGFSRGLKSHPPLDGVATETELPGLTAEVGVLTAFTALVGVKAETLPRGFGSLLKPPRLVSHGDRGVRDRTGNAVAAAPADGLCIVPRSDLFAGSCSVSRTASSPQLADRREKRERLRSVAWHLNRRQKYYPQLRVQKRRTGHHPPRERRRQKVRHLSTERSHQIDYRPPRARKRQKVLQQAQRRSKVQIRTTLRSLASVHRTNHHQMWVRRRQTSRRPSPSSERRRRVHQTEQKPRWKHRRDRQRPQKIDQTRARRINHPRPWTALQWIQTDHRPQRERRQIQEWSPPS

SEQ ID NO: 11606 - protein, 461 aa, Chlorobium tepidum
MTGSIHTEPQAAAKRGYVYIAGAGPGDPELLTLKADRVLRGADVILFDDLVLPQMLEPYKAEKIYTGKRKDAHHFAQDEINQEIVRHALMGKTVVRLKGGDPFIFGRGGEEIETLRQHGIGYEIIPGITAAHGASAYSEIPLTMRKVSSSVAFCTGHPVNSIQVPDTDTIVYYMVASNVHDVLDKVAASGRSGETMVAVVQNATRYNQRVITSTLDEFRKREKAVYSPALLIIGQNISQYIEENWFSRKKKVLMTGEAPKKYPPADYITVPFPCQQVAGADLGAVKACIEGIDRFSMLFFQNRFAVRYFFKYLFEHGRDVRHLAHLVICTANRSVASALQEYGIIPDCCLDREGVDAIAAMLRKEELTGQRILLSGAEHVDELVAGQLREGGNEVTPLVVYVHGAQDQVEKIDLDFIDEIYFASADCVKKFRGMYDAIPARIAVTPADERTAEEMRRQFGG

SEQ ID NO: 11607 - protein, 431 aa, Daucus carota
MKPPFVPSDDYYRFGESRGVADHEADVIIVKSTPSKRKPGNYNEVESSRLSMSPAYTNTVKSPNQTPVSGKGGRVYGRSNATKSLASVPQTPMSNAGSPSPLTPAGSCRYDSSLGLLTKKFINLIKQAEDGTLDLNNAAETLEVQKRRIYDITNVLEGIGLIEKKLKNRIHWKGIDASRPGEMEDDSNVLQAEVEKLSLEEKRLDDRIREMQEKLRDLSEDEANQKWLFVTEEDIKGLECFMNKTLIAIKAPHGTTLEVPDPDEVVDYPQRRYRIILRSTMGPIDVYLVSQFEEKFDEMNSVQPSMSLPLASSTGSNDNPAAETAIVGHGLENGTMTQDGHGVNSDLYTSEDISGGIMKILPSELDNDADYWLLTDPSISMTDMWKTDAGVEWDGASLLNEEFELPCISPRPQTPPSGVADVSTVANGTQR

SEQ ID NO: 11608 - protein, 313 aa, Pyrus communis
GGLGDVLGGLPPAMAANGHRVMTVSPRYDQYKDAWDTGVPVEIKVGGRVETVRFFHCYKRGVDRVFVDHPSFLERVWGKTGSKIYGPSAGEDYKDNQFRFSLLCQAALEAPRVLNLNSNKYFSGTYGDEVVFIANDWHTALLPCYFKAIYKPKGIYENAKVVFCIHNIAYQGRFPISDFSVLNLPENLKGSFDFIDGYNKPVKGRKINWMKAGLLESDRVVTVSPFYAQELVSGEDKGVELDNIIRKTGITGIVNGMDVQEWNPATDKYLDTKYDSTTVLDAKPLVKEALQAEVGLPVDRNIPVIGFIGRLEE

SEQ ID NO: 11609 - protein, 124 aa, Oryza sativa
QGLNSYVRNVLYPWEPARHRLRLVGASEEACGRKPYASVNFITAHDGFTLNDWVSYASKHNEANGEDGKDGSDNNISANYGVEGPTDDPAINELRLRQMRNMLATLLLSQGTPMLLAAASLMLP

SEQ ID NO: 11610 - protein, 313 aa, Sorbus americana
GGLGDVLGGLPPAMAANGHRVMTVSPRYDQYKDAWDTGVRVEIEVGGRVETVRFFHCYKRGVDRVFVDHPSFLERVWGRTGSKIYGPSAGEDYKDNQFRFSLLCQAALEAPRVLNLNSNKYFSGPYGDEVVFIANDWHTALLPCYFKAIYKPKGIYENAKVVFCIHNIAYQGRFPISDFSVLNLPENLKGSFDFIDGYNKPVKGRKINWMKAGILESDRVVTVSPFYAQELVSGEVKGVELDNIIRKTGITGIVNGMDVQEWNPATDKYLDTKYDNTTVLDAKPLVKEALQAEVGLPVDRNISVIGFIGRLEE

SEQ ID NO: 11611 - protein, 238 aa, Lactobacillus paracollinoides
ESYNIMRNVLGLSVDEMADTFKEWNKGELDSYLIEITADILTRKDDLGADKTKPIVDMILDRGNNKGTGKWSSEDALNVQVPQSVITEAVYARYISMMKNERVAASKVLAAPKAQEEIGDKTEMVEKIREALYFSKIMSYAQGFEQLRFASEAYDWDLQYGELAQIWRAGCIIRARFLQNITDAYDKKPDLTNLLLDDYFKDIAAKYQESTREVVALAVKMGVPVPSFSAAITYYDSY

SEQ ID NO: 11612 - protein, 313 aa, Amelanchier laevis
  misc_feature (124)..(124): Xaa can be any naturally occurring amino acid
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSXPYGDDVVFIANDWHTALLPCYFKAIYKPKGIYENAKVVFCIHNIAYRGRFPISDFSVLNLPENLKGSFDFVDGYIKPVKGRKINWMKAGILELDRVVTVSPFYAQELVSGEDKGVELDIIIRKTGITGIVNGMDVQEWNPATDKYLDTKYVITTVLDAKPLAKEALQAEVGLPVDRNIPVIGFIGRLEE

SEQ ID NO: 11613 - protein, 287 aa, Unknown
  Lactobacillus sp. DSM 20197
PILTQIAAKADQDGKPCVTYIGPNGAGHYVKMVHNGIEYGDEELIDESYNIMRNVLGLSVDEMADTFKEWNKGELDSYLIEITADILTHKDDLGADKTKPIVDMILDRGNNKGTGKWSSEDALNVQVPQSVITEAVYARYISMMKNERVAASKVLAAPKAQEEIGDKTEMVEKIREALYFSKIMSYAQGFEQLRFASEAYDWDLQYGELAQIWRAGCIIRARFLQNITDAYDKKPDLTNLLLDDYFKDIAAKYQESTREVVALAVKMGVPVPSFSAAITYYDSYRSE

SEQ ID NO: 11614 - protein, 997 aa, Alternaria brassicicola
MAAETYSSVSAIIRNLARQHDPTRDPSFSAQVSANGAKTAVNAIALPGPESDEKTQLQQELSALCSRIDFLEHKSNHAANQQGQFPLTPAQEPSDEGALYTPAGVFRGNNGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDINGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSSASRANERKLNLAYDVSYKVPDYVVGDSFRLRQIILNLVGNAIKLTEPGEVKVAISMAQEQECDPDHYVFQFAVSDTGIGIRGDKLNLIFDTFQQADGSTTRKFGGTGLGLSISKRLVTLMGGRMWVESDAGKGSVFYFTYKVRLGKPAIQAIQPQLVAYKQHTVLFVD

SEQ ID NO: 11615 - protein, 726 aa, Salmonella enterica
MSTTDDTHNTLSTGKCPFHQGGHDRSAGAGTASRDWWPNQLRVDLLNQHSNRSNPLGEDFDYRKEFSKLDYSALKGDLKALLTDSQPWWPADWGSYVGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAAAASHVGADPEAAPIEAQGLGWASSYGSGVGADAITSGLEVVWTQTPTQWSNYFFENLFKYEWVQTRSPAGAIQFEAVDAPDIIPDPFDPSKKRKPTMLVTDLTLRFDPEFEKISRRFLNDPQAFNEAFARAWFKLTHRDMGPKARYIGPEVPKEDLIWQDPLPQPLYQPTQEDIINLKAAIAASGLSISEMVSVAWASASTFRGGDKRGGANGARLALAPQRDWEVNAVAARVLPVLEALQKTTNKASLADIIVLAGVVGIEQAAAAAGVSISVPFAPGRVDARQDQTDIEMFSLLEPIADGFRNYRARLDVSTTESLLIDKAQQLTLTAPEMTVLVGGMRVLGTNFDGSQNGVFTDRPGVLSTDFFANLLDMRYEWKPTDESNELFEGRDRLTGEVKYTATRADLVFGSNSVLRALAEVYACSDAHEKFVKDFVAAWVKVMNLDRFDLL

SEQ ID NO: 11616 - protein, 392 aa, Unknown
  Malus x domestica
MAVECMIKPSSLQTMTQPPSPKTQQTQQHKEDDQKPLVFDASVFRYQTEIPSQFIWPDHEKPCKNTPELQVALIDLGGFLSGDKEAVAKASQLVGEACQKHGFFLIVNHGVDNKLIADAHCYMDDFFGMPLSEKQRAERKAGESCGYASSFTGRFSSKLPWKETLSFSYSAEKGSTNFIQDYFCDKMGEEFKEFGRVYQDYCKAMSTLSIGIMELLGLSLGVDRAYFKEFFEDNNSIMRLNYYPPCQRPEQTLGTGPHCDPTALTILHEDQVGGLEVFVDDQWHSVTPNLNAFVVNIGDTFMALSNGKYKSGLHRAVVNSETPRKSLAFFLCPRDDKVVKPPSGLVDTSSPRKYPDFTWSMLLEFTMKHYRADMKTLQVFSNWVQQKSNQKL

SEQ ID NO: 11617 - protein, 251 aa, Prochlorococcus marinus
MDNKISFIGVGPGDPELLTLKALKKIKIADVIIWTDSLIPEKILDSAKEGSEKIKTSSLNLEQITSIMIKKFQAGKTVVRLHDGDPCLFGAIREQIEILKNEKIEIEVVPGVSAFQVAAAYHEAELTIPEVTQTIILTRAGGRTGMPEKESLKDLAKHNSSICLYLSARHVKRSQETLLEFYPPETKVIVGFRVSWDDGWTSLIELKDMEKFSIEKKLIRTTIYIISPAISNSQKRSNLYNPSYKHLFRNK

SEQ ID NO: 11618 - protein, 313 aa, Amelanchier canadensis
GGLGDVLGGLPPAMAANGHRVMTVSPRYDQYKDAWDTGVPVEIEVGGRVETVRFFHCYKRGVDRVFVDHPSFLERVWGKTGSKIYGPSAGQDYKDNQFRFSLLCQAALEAPRVLNLNSNKYFSGPYGDDVVFIANDWHTALLPCYFKAIYKPKGIYENAKVVFCIHNIAYQGRFPISDFSVLNLPENLKGSFDFIDGYNKPVKGRKINWMKAGILESDRVVTVSPFYAQELVSGEDKGVELDNIIRKTGITGIVNGMDVQEWNPATDKYLDTKYDNTTVLDAKPLVKEALQAEVGLPVDRNIPVIGFIGRLEE

SEQ ID NO: 11619 - protein, 386 aa, Streptomyces filamentosus
MIPGARRVSRSVNISGVRELDVVVIGAGQAGLSAAYHLRRVGLEPDNDFVVLDHAPRPGGAWQFRWPSLTYGKVHGMHALPGMELTGADPDRPSSEVIGAYFAAYEDRFGLRVHRPVEVSAVREGSGGRLLVETSEGTYAARALINATGTWDRPFWPRYPGQETFRGRQLHTANYPGPEEFAGQRVLVVGGGASGTQHLMEIAEHAADTFWVTRSEPVFREGPFTEEWGRAAVAMVEERVRNGLPPKSVVSVTGLPLNDAVRRARERGVLDRLPMFDRITPTGVAWDDGRTVETDVILWATGFRPAVDHLAPLKLREPGGGIRAEDTRAVRDGRVHLVGYGPSASTIGANRAGRAAVRSVMRLLKETGADGGASAVVSVPAPVPGV

SEQ ID NO: 11620 - protein, 759 aa, Streptococcus pneumoniae
MYNYPMRIHYHRKNGEYDTCSFVKSQDQRIDLLTYKEDYFGALFSFEHPSSHVIESLNFVVHTGQTSKEYSIRFNHYPLLTEVWILEGDDRIYYSENPAIASPFYKNQNPFAFDKAINSASFDHHWGYQGELGCRVEDNQAHFSLWSPTATEVQVVVYESAANDAPVWKTFEMKRGNSYSYNHKDNTIGVWSLDVEEDLVGKTYQYQVQFPHHQTLTRDPYTIATSPDGKRSAILSHVEKQVENFEVKHGSEATWRLENPCKAVICEMHIRDLTKSPTSGVDEHLRGTFLGAAQAGTVNQYGQSTAFDYIKKLGYNYVQLQPIADRHKEYDEDGNVTYNWGYDPQNYNAPETSFSTNPDDPAQVIRDLKVMVQAYHDAGIGVIMDVVYNHTFSVVDAPFQTTVPDYYYRMNPDGTFQNGTGVGNETASEHEMFRKYMIDSLLYWVQEYNIDGFRFDLMGIHDVKTMQMIRQSLDEIDSNIILYGEGWDMGTGLAPYDKAKKDNAYQMPNIGFFNDNQRDAVKGGEVYGAIKSGFVSGAATEPILAKAILGSRELGSYTHPNQVLNYVEAHDNYNLHDLLATLHPDQSSEQIMRKVETATAMNLLMQGMAFMEIGQEFGRTKLVATGENGELTHDDRERAMNSYNAPDSVNQVNWNLINERQDSIEFIRQVIRLKTKTGAFSYSSYDEIYHHVFVHSAIEHSGYLIYEVHGKEHLLVVVNAKSEPYQFENAGNLAMLVTNSRSKEDNVLNDISLAVLSVL

SEQ ID NO: 11621 - protein, 199 aa, Haemophilus parasuis
EEGDIIIDGGNSNYPDTNRRVKALAEKGIRFIGSGVSGGEEGARHGPSIMPGGDEEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 11622 - protein, 289 aa, Legionella pneumophila
MSDYLDKTASLTPATKRIVCDKATEYPHTGSYNQVATHGTYLCRRCGLALFRGVSQFSSGCGWPSFDDEIANAVARKPDADGQRTEILCARCDAHLGHVFTGEYMTYKNLRHCVNSASLDFVADNEVLDTEEAILAGGCFWGVEYYLKRIPGVLKVESGYTGGHVSEPSYEQVCSGTSGHYEAVRVVYDAAKTNYHDIVKRFFEIHDPTQANGQGPDLGHQYLSAVFYFNQEQRQEAELLIQLLKKRGYQVVTQLLQTQSFWPAEDYHQDYYFKHHKIPYCHKSVDRFG

SEQ ID NO: 11623 - protein, 431 aa, Psychrobacter arcticus
MTSANDKSTDTNVDSTQAEQKMAEKQNKLLSGIIERATKSGIGRKKLNPSAVESAVAKNMAEIHNNPTKLRLVVLGGGSFGTAMANLAARNGCDTTLWVRNKRTVKAMAKSQMNKKYLPGYKLDDRLKYSHELQAAVKDTDIIFIAVPGLAFRETLKSIAPFISGQSIVSLTKGMEKDTFALMSDIIKEELPEVNFGVMSGPNLAIEIMKNMPSATVIASESEPLRHAVQAALHSAFFRVFASDDIRGVELGGALKNIYAIAMGMAAAYEVGENTKAMILTRGLAEMSRFGVHAGANPLTFLGLSGVGDLYATCSSELSRNYRIGNMLGRGMTIDAAVKKLGQTAEGVNTIQQVHEKATKEGIYMPITHALHAVIYEDKAALGVALHLMEAGFRSDVEFVMEHDHSNASLTAQMQTANNQAKNEKTKPDNK

SEQ ID NO: 11624 - protein, 380 aa, Streptococcus pneumoniae
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDSVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSTGAQVREGAEVLDSVIMSGAIIGQGAKIKRAIIGEGAIISDGVEIDGTDEVQVVGYNEVVGVATDED

SEQ ID NO: 11625 - protein, 407 aa, Brassica rapa
MVEVEELEPLTPVEEEEEEVISYDDLKRRMWKDRNLMEKLKQQKRHSNDVVSLASHRAEASRRKKMARSQDSRKGFVYGIVPDKGKPITGSSDSLRRWWKETVQFDQTAPNAVSDYLTIAAAAAAEMIEKEPSSLLHMLQELQDTTLGSLLSALMQHCVPPQRRFPLEKGIAPPWWPTGTELWWGEQGEAHEHGVPPYRKPHDLRKSWKVSVLAAVIKHMSPDLGRVRRLATQSKCLQDKMMAKETDTWSRVLNQEEALLNIKDRKISDQDQEASGSKTKRKCDFMEPSKRPRSDVTQEPRQITGDMISMLVTSPSIGTNTTSEDDYSVSSSAMGKPDDYDSNWMDYLWFERMQPEFNSSRRFDDDEDNPMVLNQSTESNQSDNVSQSIFSVWDMGCEDKDIYMFDY

SEQ ID NO: 11626 - protein, 294 aa, Saccharomyces cerevisiae
TTPLVHVASVEKGRSYEDFQKVYNAIALKLREDDEYDNYIGYGPVLVRLAWYTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 11627 - protein, 424 aa, Burkholderia vietnamiensis
MSNTQPFFSQPLAERDAPVRSAILKELERQQSQVELIASENIVSRAVLEAQGSVLTNKYAEGYPGKRYYGGCEFADEIEALAIERVKQIFNAGYANVQPHSGAQANGSVMLALAKPGDTVLGMSLDAGGHLTHGAKPALSGKWFNAVQYGVNRDTMRIDYDQVEELAHQHKPTLLIAGFSAYPRALDFARFRAIADSVGAKLMVDMAHIAGVIAAGRHANPVEHAHVVTSTTHKTLRGPRGGFVLTNDEEIAKKINSAVFPGLQGGPLMHVIAGKAVAFGEVLHADFKTYIDRVLANAQALGEVLKAGGVDLVTGGTDNHLLLVDLRPKGLKGAPVEQALERAGITCNKNGIPFDTEKPTVTSGIRLGTPAGTTRGFGVAEFREIGRLILEVFDALRANPDGDHATEQRVRREIFALCERFPIY

SEQ ID NO: 11628 - protein, 274 aa, Prochlorococcus marinus
MTDFLSAALQLTSTSNVEANLSAAEEQIEIAARRGADLVGLPENFAFIGNDEDRLEMASELAEKSSRFLVTMARRYQIVLLGGGYPVPAEDGKRTLNRSELVGRDGQLLGRYDKIHLFDVDLPDGNKYRESETIVSGNLLPSVIDVPGLCRVGLSICYDVRFPELYRHLVDNGAELLMIPAAFTAFTGKDHWQVLLQARAIENTAYVVAPAQTGEHYRRRQSHGHAMIIDPWGTVLADAGVQEGAAIAPVDNSRVKSIREQMPSIKHRKQELFS

SEQ ID NO: 11629 - protein, 608 aa, Brassica rapa
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKDKSYIAVRDAIGVIPLYIGWGLDGSVWFASEMKALSDDCEQFMAFPPGHIYSSKQGGLRRWYNPPWFSELVPSTPYDPLVLRDTFEKAVIKRLMTDVPFGVLLSGGLDSSLVASVAIRHLEKSDARQWGSKLHTFCIGLKGSPDLKAGKEVADYLGTRHHELHFTVQEGIDAIEEVIYHVETYDVTTIRASTPMFLMSRKIKSLGVKMVLSGEGSDEIFGGYLYFHKAPNKKELHEETCRKATPLEFLDHDVSCAYLLCLNLVCLLLMQIKALYQYDCLRANKSTSAWGVEARVPFLDKAFLDVAMGIDPEWKMIRPDLGRIEKWVLRNAFDDEKNPYLPKHILYRQKEQFSDGVGYSWIDGLKDHANKHVSDAMLTNANFVFPENTPLTKEAYYYRAIFEKFFPKSAARATVPGGPSVACSTAKAVEWDAAWKGNLDPSGRAALGVHVAAYEGDKAEAPRPEKVQKLAEKTAEAIV

SEQ ID NO: 11630 - protein, 209 aa, Triticum aestivum
NDGPVNCNTTHYRANWAPTSHAPGRHGRGSVFAPEVSHCVHLVSWEKENVSSEALEAARIACNKYMTKHAGKDAFHLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGVNAKLLGCHGRLANRAPGQAFLSAA

SEQ ID NO: 11631 - protein, 1131 aa, Burkholderia pseudomallei
MKPADTLEDVGRAQFVAHMARRPRRARRREAPGVADTPLWYKDAIIYQLHVKSFFDANNDGVGDFAGLIAKLDYIAELGVDTVWLLPFYPSPRRDDGYDIADYRGVHPDYGTLADVRRFIREAHARGLRVITELVINHTSDQHPWFQRARRAKRGSVHRDYYVWSDTDLKYAGTRIIFLDTETSNWTHDPVAGQYYWHRFYSHQPDLNFDNPAVVREVLQIMRFWLDLGIDGLRLDAVPYLVEREGTSNENLPQTHAILKLIRATIDAEYPNRMLLAEANQWPEDVQEYFGDEDECHMAFHFPLMPRIYMSIASEDRFPIIDIMRQTPALAPSNQWAVFLRNHDELTLEMVTDSERDLLWQAYASERRARLNLGIRRRLAPLMERDRRRIELINSILLSMPGTPVIYYGDELGMGDNLHLGDRDGVRTPMQWSSDRNGGFSRADPELLVLPPVMGTLYGYDAINVEAQTRDPHSLLNWTRRILSTRRATRVFGRGAIRFLRPGNRKILAYLRELDGETPVLCVANLSRASQAVELDLSEFAGCVPTEMTSDSPFPPIGQLPYLLTFPPYGFLWFALSEHGREPAWHQQYAEPLPEYLTLVMRRGETQPGAALLDTLAQDALPSWLARRRWFASKERRVDSARFDALTPIPGEPFQYAEARVAVDGREERYVVPLASAWGSETPQPLFAQLALARVRRGHTVGLLTDAFALPSFAHGVLRQLRAGAAVPVAGGGRLEFRPEPDLARLDPGDAPGVRWFAAEQSNSSLVIGEAIVLKIVRKLAAGVHPEAEMGRHLRRIGYRNVAPLVGEVVRIGADGAPHTVAILQEYVDNQGDAWTRSCDFLKRAIEELALPAANDADAAAPSAEPEMIDGYATFAGIVGKRLGELHAALAQPSDDAAFAPQRVSPARVDGWIGDALGWFERAASLLAERLDTLEGQTRAAAELLVAQRAAVAEALRALVPRELDGCCIRIHGDFHLGQVLDVQGDALLIDFEGEPARPLEQRRAQSHPLRDVAGFLRSLSYASAAAQFTIEKAPQQAAERKRALFERFGQAAADRFVAQYREALSAASREFVEPRYADRLLALFLIEKASYELCYEAANRPDWLSVPANGLAALVARLIGGAAPQQEDAR

SEQ ID NO: 11632 - protein, 724 aa, Spinacia oleracea
LTVTPIRDDKGCVIKFIGMQVEVSKFTEGINDKALRPNGLPKSLIRYDPRQKEAALGSIIEVVQTVKHPRSLSQPLSNNDADRREVAGKFNLDYMLPKLAEIDNVGTPGRLSSPSRLSTPGRQTPKIDASSRDSDKSSRKSARISLLGFKGRSSAKHERPPSPEPEFLIPKDIDRDDSWERAERERDVRQGIDLATTLERIEKNFVISDPRLPDNPIIFASDSFLELTEYTREEILGRNCRFLQGPETDQTTVQKIRDAIKEQRDITVQLINYTKSGRKFWNLFHLQPMRDQKGELQYFIGVQLDGSDHVEPLRNRLSERTEIQSAKVVKATAENVDEAVRELPDANSRPEDLWAIHSEPVYPRPHKRGSSSWAAIQKITAAGEKVGLEHFNPIKPLGCGDTGSVHLVELKVPENWFAMKAMDKSVMLNRNKVHRACVEREIISTLDHPFLPTLYASFQTSTHVCLITDFCPGGELFALLDKQPLKIFKEESARFYAAEVVIGLEYLHCLGIIYRDLKPENILLQKDGHLVLTDFDLSFLTSCNPHIINHPQPKKRRSRSQPPPTFIAEPVTQSNSFVGTEEYIAPEVITGASHTSAIDWWALGVLLYEMLYGRTPFRGKNRQKTFANIMHKDLTFPSSIPVSLSARQLIYALLNRDPATRLGTQGGASEIKEHPYFRGINWPLIRCMDPPTLEAPFKLIGRDPNAKEVKWDDDGVLASPMDFF

SEQ ID NO: 11633 - protein, 384 aa, Brassica rapa
MELKEGSNQISEIEEGENKRDRYKRSANMRRSPCSDDSGLKKGPWTPEEDEKLVNYIQKHGHSSWTALPKRAGLNRCGKSCRLRWTNYLRPDIKRGRFSPEEEQTILNLHAVVGNNQRFCVPVLLAYVDNVIRWSTIANNLPGRTDNEIKNFWNTHLKKKLIQMGVDPMTHRPRPDIFSSLSQLVSMSSNLRGFVDMQLQFQTDQEQTILKLQTEMAKLKLLHDLLQPPSMNNNTNPNDFDTRSLLHSIASLKETYTTSNNPDLGPYLQDFSSIPSLETLNTNMVPSSISPRDLEDSHFKFFSQRDNLPVSPVWLSDPSSSNQSLLPSLDHSSVVSGDLIRNQYIIEDVNSNLMTSSSGQESGASASPVWPDHLLDDSIFSNIL

SEQ ID NO: 11634 - protein, 506 aa, Ruta graveolens
MDLLLLEKALLGLFAAAVVAIAVSKLRGKRFKLPPGPLGFPVFGNWLQVGDDLNQRKLANLSKKFGDVYLLRMGQRNLVVVSSPEMAKEVLHTQGVEFGSRTRNVVFDIFTGKGQDMVFTVYSEHWRKMRRIMTVPFFTNKVVQQQRFNWEDEAARVVEDVKKDPQAATTGIVLRRRLQLLMYNNMYRIMFDRRFESVDDPLFNKLKALNGERSRLAQSFEYNYGDFIPILRPFLRGYLKLVKEVKERRLKLFKDYFVEERKKLTSTKSMTEENFKCAIDHVLDAQQKGEINEDNVLYIVENINVAAIETTLWSIEWGIAELVNHPDIQKKLRAEIDRVLGPDHQITEPDTHKLPYLQAVIKETLRLRMAIPLLVPHMNLNDAKLAGYDIPAESKILVNAWWLANNPAHWKDPQVFRPERFLEEESGVEANGNDFRYIPFGVGRRSCPGIILALPILGITIGRMVQNFELLPPPGQSKIDTSEKGGQFSLFILNHSTIVLKPRSSV

SEQ ID NO: 11635 - protein, 704 aa, Gibberella zeae
MDSFQKTVPETVSLSHPKEQSPPQPPRHPYLIGNFAPIHKTLNLTPCTHSGCIPPELTGGQYVRNGGNPVSHEDLGRDAHWFDGDGMLSGVLFRKGTFDGQIVPEFVNQYILTDLYLSRKTTSVMSPIMPSITTLVNPLSSLLKIMLATFRTMFLVFLSNLPGSQQALKRTSVANTAILYHDGRALATCESGPPMRIQLPSLDTVGWYNGVQAEGEPEQTISEDKIEPFGGDGVFKSMREWTTGHPKVDPISGEMILYHNTFIQPYVHYSVLPKTNVQAPTTGRLVNQAVPGVSGARMMHDFGASRAHTIIMDLPLTLDPLNLAKNKEVVSYDPSKPSRFGVFPRHEPSKVRWFQTAPCCIFHTANSWDTKFANGTSSVNLLACRMTSSTVVYTAGNIKPPAKPKRSNPRSYLAAQDVGQWDEKDVRRFEAAPMLESPSEKAHGDDYFSPSDDVDDYSQCRLYYYEFNMSATSTNNVINQWALSTIPFEFPSVRPDREMQDARYIYGCSTSTSCFGIALGRADKVDLLVKMDAKILIERGKKMNTRPVTGCVDRRSAREILDSQDEKDPIKIFRLPPRHFAQEPRFVPRAGATEEDSGYLLFYVFDESQILPNGDCPSSSASELWILDAQNMRDVVAKVRLPQRVPYGLHGTWFSAKDIQEQRAVETLRSLEAVQRKKDEWANNGGSIARAWMTFREKLERAVG

SEQ ID NO: 11636 - protein, 572 aa, Gibberella zeae
MVGLGPRRPPSRKAVACSRYCHGGAEPAKMSCNDDVGSINPDRGVRRQKQDEALHDFTEITILGKPAVQDREPMSLTFRACPNAGFYYGGSQRGSMADVPKDLAEEINKLENLFTVQPSKLKEITNHFVSELAKGLSVEGGSIPMNPTWVMSYPDGYETGTYLALDMGGTNLRVCQITLTDEKSEFDIIQSKYRMPEELKSGTSEELWEYIAECLYQFLETHHGDCTKLEKIPLGFTFSYPATQNYIDEGILQRWTKGFDIDGVEGQNIVPMFEEALKTRGVPIKLAAIINDTTGTLIASAYTDTAMKIGCIFGTGCNAAYMEDCGSIPKIADLNLPADLPMAINCEWGAFDNEHKVLPRTPYDVIIDKESPRPGQQAFEKMIAGLYLGEIFRLILVDLHDNKSIHIFENQDIALLRKPYSLDASFLSAIEEDPWENLSETSDLFSKKLNLKCTQPELELIRRTAELIGTRAARLSACGVAAICKKKNYQSCHVGADGSVFNKYPHFKERGAKALRDILDWPEKTNKKEEDPIEVLTAEDGSGVGAALIAALTLKRINEGNMAGILHPENFK

SEQ ID NO: 11637 - protein, 404 aa, Sulfolobus solfataricus
MKCEYLIIGSGIAGYNALKELLQIKPNSRIIMITSDKYYPYDRPPLSKDYLKGKLEKDMLFFESDDFYKRDNLEVMLNKSVERIDANLKEAILNDGSVISFDKALISTGGRPRRLNIPGSENALYLRSLDDADRIREAASKGKNALIIGAGFIGVEVASSLITLGVKTTVVEVMPYIWNTFVDEKVSRVIQQYLESKGINFILNESVKEIQGKIATTSSGRKIEADMFLIAVGISPNVELAQRSGMQVDNGIVVNEYLETSARDIYAAGDIANIFDPREGKRKRIEHWNNAEYTGKLAARNMAGSREAYNFISSIWSDIFDLHIESAGETRNYDEYIIRGKFELERPRFSVIYLKGGIIKGYLAINRNVKEIIALNKLIQKQADVSSKRDKLADESFDLQKLLI

SEQ ID NO: 11638 - protein, 745 aa, Rickettsia typhi
MFNEITKSVIWNRQVLEISTGKIARQADAAVTVKMGNSILLCTCVVANKVKDGIGFFPLTINYREMAYSAGKIPGGFLKREGKASDKEILVSRLIDRPIRPLFHQAFIHETHITCSVLSYDPETPVDILAIIGASAALSISPAPYLEIVAASKVGLINGEFVLNPTLELLKTSQLDLVVAGTKDSVMMVESEAHLLSEEKMLEAIKFGFENFQTVIKLIKEFAKEAKKPKFEMQDLYPSSLKKEIGKLFAKEIEQAFAIKSKQERNANLALIHEKVLTHFVCDIENKKYNNYQIESTLKAISADILRNKILEQNIRIDGRSTTDIRQIACEVGLLPSAHGSALFTRGETQSLVSTTFGTSLDEQIVDSLEGEYKERFMLNYIFPPYSVNEAMPMKAPSRREVGHGKLAWRAINPILPNKVQFPYSIRVVAETTESNGSSSMATVCGSSLALMYAGVPIKAPVAGIAMGLIKEGDKFAILSDIIGDEDYFGDMDFKVAGTSKGITALQMDIKISGIDFKIIQVALEQARHGRLHILEQMNKIISKPNSELSKNAPSSTTIKIDKDKIKDIIGPGGKIIKEICETSNAKIDISDDGTVSVYAADRDKIKVALDKIKAIAVEPEIGEIFNGTVMKVLDSGAFINYLGNKDGFVHISEISETRIDKVSSVLKQGDIVKVKLIGFDNKGKAKLTIKNACKDHSLNNPKQKNNVKEDSEPEQRRDASKKRTWNEDNNTEMSEVITERKYFT

SEQ ID NO: 11639 - protein, 568 aa, Colwellia psychrerythraea
MAQNTLPQKKSHLLDDILLILTMAVLAGCGLIYEYLLSHYAGRVLGVMESTIYTMIGLMIVSMGLGAFAARKVRCAFNGFVWLELIIALLGSSAILIIGGLIAITQIFPQLIADMLSLPPDMKPQGGLFKDLSWLAFNSPYFFGVLLGFFIGMEIPLIARIRESIHQQHLANNLGTIYGADYVGAGIGAAIWVVFLLSLDISKAAALTASLNLIAGAFFILRYWQHLNWRKTFVALHCALALIIVLMFSYGNQWLNQMNSLLYLDKVVHTDKTRYQQLTFTERHMGLEQDNIINFYLNGRLQFSSIDEHIYHDYLVAPVMAGSARHDKILIIGGGDGLALRDVLKYNPKHVTLIDLDSELIDIFKQPKKQVNPRLASQILQLNKNSLQDERVTIYRADAFIAINQLLEDRQTFDAIIVDLPDPSHPDLNKLYSVNFYARLKLLLSGDGLIAIQSTSPYHAKDSFIAIGNTLAAAKFSHVEQYHDNVPSFGEWGWTIASKSGASPLTRLNKLTKLPVAHQWLNLAILKAAFIFPNDFYQNKDNIGINILGSHTIYQLHQSAWQDQQGLN

SEQ ID NO: 11640 - protein, 549 aa, Helianthus tuberosus
MVFDMGLMFEKMGSSTLATSEYSSVVSMNLFVALLCGCIVLGHLLEENRWMNESITALLIGLCTGVVILLISGGTSSHLLVFSEDLFFIYLLPPIIFNAGFQVKKKQFFRNFMTIVLFGAVGTMISFTIISFAAIKIFKKMNIGELELGDYLAIGAIFSATDSVCTLQVLNQDQTPLLYSLVFGEGVVNDATSVVIFNAVQNFDLSRITTAIAFQLLGNFFYLFITSTLLGAGAGLLSAYIIKKLYFGRHSTDREVAIMILMAYLSYMLAELFSLSGILTVFFCGIVMSHYTWHNVTEKSRVTTKHAFATFSFIAELFIFLYVGMDALDIEKWSFVKDSPGTSAEVSAILLGLVLVGRAAFVFPLSFLSNLTKKAQHEKIDFRQQVLIWWAGLMRGAVSMALAYNQFTKEGHTTMPGNAIMITSTITVVLFSTMVFGLITQPLVRLLLPAPKNLNRMISSEPSSPKSFIVPLLGNGQDSIDNMPRPSSLRMLLATPSHTVHYYWRKFDNAFMRPVFGGRGFVPFIPGSPTEQSLHQSAHHLVDEETTGN

SEQ ID NO: 11641 - protein, 142 aa, Arabidopsis thaliana
  misc_feature (124)..(124): Xaa can be any naturally occurring amino acid
NPGPTHPSEKPRASFILFSFLMVAFPVRAGLVVPLNGLKSSVAFQATRRVNTAITSITGNGGGVNCLQGWPPMGKKKLGTFFNLPALTDSELVKEVAYLIRTRGIPGVEFKWDHGFGSRGHGNXPGYYDGRSWTLWKFPLFG

SEQ ID NO: 11642 - protein, 509 aa, Ricinus communis
MPIPHAEQSRARAARTSATAAARPPAAVVKRVSLRKLLRVTSIAGGIQFGWALQLSLLTPYVQELGIPHAWASIIWLCGPLSGLVVQPLVGHMSDRCTSRFGRRRPFIFVGAGLICCSVLIIGHSADIGWLLGDRGETRPRAIAVFIIGFWILDVANNMTQGPCRALLADLTGKDHRRTRVANAYFSLFMAVGNVLGYATGSFSNWFKVFPFTVTSACNIDCANLKSAFYLDIVFMVITTYMSITATKESPIGLSDRSSLITEEISEQSGHAQEAFLWELLGTFRYFPWPVWTILLVTALNWIGWFPFLLFDTDWMGREIYGGAPNDGHNYNSGVRMGAFALMVNSVILGLTSVLMEKLCRKWGAGFMWGISNILMALCFLAMLITSYIANHIGYLGHDLPPSGIVIAAIIIFAVLGFPLAITYSVPYALISSRIEPLGLGQGLSMGVLNLAIVIPQVIVSLGSGPWDQLFGGGNSPAFVVGALAAFAAGVIAILGIPRSGAPKPRVLP

SEQ ID NO: 11643 - protein, 525 aa, Unknown
  Magnetococcus sp. MC-1
MDILLINPDHKNRKNNTPWGVLALGSYLRKVEGVDVHLFDASIEGADAAYQTLPDLMAQARVIGIGAFSSDAPFIKRVADMAKQLFPDKPLILGGPHANLYPEQSACYKNIDYVAYGDGEATTAALLKAAAAGSIDPAKIPGLCYQQADGTVVRTPPQPIEPFFDIDYDLLDPRVRHYFGKYIQVLAGRGCPFRCTFCYVSPSAKSWQGRSIESLFEQLDALIAQYDSKVVYFRDELFFHDKQRIRDFIRLYRERNYHFKWRASCRASDFGDNFITQEMVQDLAEVGCSCLKMGFESGSDTILKAIKKGIKVKNIQTAVTMLAKQPEIQINCSFIMGFPQETPADYRATMQLINWIRKQATNFYMVGPQYYRVYPGGALYEEVISQFDYQIPPTLDAWSERYLDPGNKDAFTDQSVDYPWVPVEMRPLAQQASFLVALACMEQQIGYMSRYKKRLLAPFVALARLRLNMGWYGYLVDLKMARGVVDFSIWAWADRSPLLNGLKKRAWFNALRQTPLYRKFSALFT

SEQ ID NO: 11644 - protein, 339 aa, Burkholderia pseudomallei
MNTTTLSTKLNAFARLNLIDAPTPLQYLPRLSAHVGRDIHVKRDDCTPLAMGGNKLRKLEFLAADALGQNADVLVTAGAIQSNHVRQTAALAAQLGLGCVALLENPIAAARDDYLQSGNRLLLDLFDVRAHVVDGLDDVDRQLEAAARRLRDEGRRPYVIPIGGSNPLGALGYVRAGLELAQQIRAAERDFAAVVLASGSAGTHAGLAFALAHALPGLPVIGVTVSRTDAQQRPKVRHLLDGMSGLLDVALPAGARIDLWDDYFAPRYGEPNRAGIDALRLLARTEGLLLDPVYTGKAMAGLIDGVARGRFDGNGPVLFVHTGGAPALFAYQDACRASR

SEQ ID NO: 11645 - protein, 159 aa, Clostridium perfringens
MGYIMDLRKELPNPHRPLIMCSAGIIIIDKKGRVLLQKRTDNNKWGLPGGSLELGESFEEAAIREAYEEVGLKVKSLSLFNVYSGKECYNKYPNGDEIYNASSIFISNDYEGEVILDGEESADAVFFKKVDIPSLEEVNPPDRIVIKDIIEKLNIEKYI

SEQ ID NO: 11646 - protein, 155 aa, Zea mays
  misc_feature (76)..(76): Xaa can be any naturally occurring amino acid
MAAAAAALVSSNSLRAPAAFSVVVRAASRPAPVVAVVTPLPAAKAAAARGARLRAQATHNVKLITPDGEVQLKMPXDVYILDHAEERGLDLPYSCRAGACSSCVGKIVSGSVNQFDQSFLDDDQVAEGFVLTCIAYPTSDLVIQTHKEDALVESY

SEQ ID NO: 11647 - protein, 1328 aa, Alternaria brassicicola
MAAETYSSVSAIIRNLARQHDPTRDPSFSAQVSANGAKTAVNAIALPGPESDEKTQLQQELSALCSRIDFLEHKSNHAANQQGQFPLTPAQEPSDEGALYTPAGVFRGNNGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDINGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHKIRTPMNGIIGMTQLTLDTDLTHAQREMLTIVHNLAGQLLTIIDDILDISKIEANRMVMEEIPFSMRGTIFNALKSSASRANERKLNLAYDVSYKVPDYVVGDSFRLRQIILNLVGNAIKLTEPGEVKVAISMAQEQECDPDHYVFQFAVSDTGIGIRGDKLNLIFDTFQQADGSTTRKFGGTGLGLSISKRLVTLMGGRMWVESDAGKGSVFYFTYKVRLGKPAIQAIQPQLVAYKQHTVLFVDQGNTGFSDEITEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNITLPGKGNDNGGASSSSGGLPSPGKKRPQLEARGFTERGGAQSPNLLAVDQTDNGSVERLLLRSHSS

SEQ ID NO: 11648 - protein, 231 aa, Brassica oleracea
SSTGQAPGDDSEVILCPQAIFRDPFRKGKNILVICDCYAPTGEPIPTNKRYNAAKIFSHPDVKAEEPWYGIEQEYTLLQKDTNWPLGWPLRGYPGPQGPYYCAAGADKSYGRDIVDAHYKACLYAGINISGINGEVMPGQWEFQVGPAVGISAGDQLWVSRYIVERITEIAGIVVTFDPFPISGDWNGANAHANYSTKSMRSDGGYEVIKKAIKKLGMRHKEHIAAYGEGN

SEQ ID NO: 11649 - protein, 1145 aa, Pinus sylvestris
MVSISSDQACTIPKLYANFFLGSDIEFVRPDGRPEFFNADRFLSYYHSMTFAVNQEGQALLPGRKLLAMELHEPFFESWDPRHENPCKWTGVICSLDHENLVTEINIQSVQIAGNVPSQFAVLGSLRSLVISAANLTGSIPAEIGGYESLEILDLSGNRLRGNIPAEISKLKNLKSLILNSNQLQGSIPAEIGNCHNLVDLVVFDNQLSGKIPAELGRLANLEVFRAGGNENIEGTLPDELSNCTNLVTLGLAETNISGKIPLSFGSLKKLQTLAIYTAFLSGTIPAELGNCSELVNLYLYENRLSGAIPRELGKLQKLEKLYLWDNELDGSIPAELGSCSSLKFVDLSTNSLSGSIPDSFGSLKNLSELEITDNNVSGSIPAALANCTELTQIQLYNNQISGQMPAELGALKKLTVLFLWQNNLEGPIPSSLGSCDNLQSLDLSHNRLTGSIPPSLFEIKNLTKLLLLSNELTGALPPEIGNCVALSRLRLGNNRLLNQIPREIGKLENLVFLDLAMNQFSGSIPAEIGGCSQLQMLDLHGNRLGGELPRALGFLHGLQVVDLSANELTGLIPANLGNLVALTKLTLNGNALSGAIPWEISRCTNLQLLDLSLNRFSGQIPPEMGKCKRLEIALNLSWNNLSGSIPAQFSGLTKLASLDLSHNLLSGNLSALAQLSESCFSQHFFQRFFRVSARYQVFSDLCLPSDLSGNAALCTSEEVCFMSSGAHFEQRVFEVKLVMILLFSVTAVMMILGIWLVTQSGEWVTGKWRIPRSGGHGRLTTFQKLNFSADDVVNALVDSNIIGKGCSGVVYKAEMGNGDVIAVKKLWTGKESECEKVRERDSFSAEVNTLGAIRHRNIVRLLGCCTNGRSKLLMYDYMPNGSLGGLLHEKRSMLDWEIRYNIVLGVRRGLSYLHHDCRPPILHRDVKANNILLGSQYEPYLADFGLAKLVDSADFNRSSTTVAGSYGYIAPEYGYTMKITQKIDVYSFGVVLLEVVTGKQPIDPTIPEGVHLVEWARDAVQSNKLADSAEVIDPRLQGRPDTQIQEMLQVLGVAFLCVNSNPDERPTMKDVAALLKEIRHDCHDYNGKADLLLKQTPAPGSTRSPNPTADARSPVGSSFGLEYSSASTTAHESYSLHSSVSNVI

SEQ ID NO: 11650 - protein, 408 aa, Nocardia farcinica
MVIVGAGHAGVQVADALRAGGHTGPLTLVGDEPCLPYQRPPLSKEHLAAESGAEPLPLRGARYFADHGIDLRTGTAAVAVDRRARLVGLADGREIGYDALVLATGSVNRPLRVPGAELAGVHALRTLADARALRGALATASAVLVVGAGFVGLEFAAVARARGLPVTVLDAGSRPLARAVSEPISAHVAAAHRAAGIDLRLGESVARFVGADGRVRGAVGTGGTEYRADLVLVGIGAVPRVELAERAGLAVADGIVVDGRLRTADPAIYAVGDCAAHPHPHAGTRIRLESVQNATDQARHVAAGLLGAEHDYADLPWFWSHQGAVKVQIAGLRRPGDDTVTLGDPATGRFSVCCLREGDLVAVESVGRPADHMAARRLLAAGPVPAPPDLTDPAFSLKRCAAALAPAR

SEQ ID NO: 11651 - protein, 373 aa, Unknown
  Burkholderia sp. 383
MDDVQFKLQQADAGAHPAGAYDATTRLAASWYVAMRSDDLKDKPTALTLFGRPCVAWRGATGRAVVMDRHCSHLGANLADGQVKDGCIQCPFHHWQYDEQGQCVHIPGHSTEVRRLEPVPRGARQPTLVTAERYGYVWVWYGSPQPLHPLPEIAAADVDNGDFMHLHFAFETTTAVLRIVENFYDAQHAHPVHALPISAFELKLFDDWRPWPEVESLARAGAWFGAGIDFTVNRYFGPLGMLSRALGLNMSQMNLHFDGYPGGCVMTVALDGEAKYKLLQCVTPVSDGKNVMHMLISIKKVGGPLRRATDFVLFGLQTRQAAGYDVKIWNGMKPDGGGAYSKYDKLVLKYRAFYRGWVERVVAGERQGVSRRS

SEQ ID NO: 11652 - protein, 179 aa, Fritillaria agrestis
MASSATMLSSVATAACVAPAQASMVAPFVGLKSASAFPVTQKTVTGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 11653 - protein, 702 aa, Burkholderia pseudomallei
MPTPTPDRLEPGRSYPLGAHWDGLGVNFAVFSAHARRVQLCLFDPTGRREIARLDLPECTDEIWHGYLPDAHPGTVYAFRADGAYEPQHGHRFNPHKLLLDPYARKLVGQFRWSDALFGYRLHSSRADLSIDRRDSAPAMPKCVVVDEAVDWSTDRRPCVPWRDTVIYEAHVRGVSMRRAELRAPERGTFAALACPAFIDHLLALGVTSIELLPVHAFMHARALVNLGLCNYWGYDTAAFFAPEPSYLATRRLDEMRIAIRQLHAAGIEVLLDVVYNHTCEGNQLGPTICWRGLDNASYYRLAPDDPRRHIDETGCGNTLDLSHPRVLQMVMDSLRYWSNAFNVDGFRFDLCATLGREAAGFDPGAGFFDALRQDPVLATRKLIAEPWDVGPGGYQLGRHPAGFAEWNDRFRDTVRRFWRGDAGMRPELAARLAGSADLFNHHGRRTWSTVNFVAAHDGFTLADLVSYAAKHNDANGEDNRDGRDDNCSANWGAEGPTEDRQVRAVRARVARSLLTTLFAALGTPMLLGGDEFGRTQQGNNNAYCQDNELSWFDWSAAESADGRTMIHFVGRLAALRRAYPVLSEPRYPSGERDGAPGLHEIDWFDERGDALTVPAWHDRERRALTMRRVGNGRAGRPEALLLMLNASSDAIVFHAPPPSLVYRILLDSAAPDAAPRLMPADGVEIAAHAAVIAAASVPEAG

SEQ ID NO: 11654 - protein, 179 aa, Fritillaria agrestis
MAASSTMLSSVATAACAAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVERPE

SEQ ID NO: 11655 - protein, 634 aa, Burkholderia pseudomallei
MNDSTATHAYALPFGATCVDARHTRFHLWAPACRSAAVERQDGETVAMTPDGGGGFDAIVRCGPGTLYCYLLDGTLRVPDPASRFQPHGVHGPSEVVDPAAYRWRHDDWRGRPWRETVLYEVHVGAFGGYARIARRLPALAALGITAIELMPVNAFPGARNWGYDGVLPFAPDASYGPPDALKSLVDAAHGLGLQVLLDVVYNHFGPDGNLLPRYAPAFFRRDRDTAWGPAIDFSCPQAGAFFLENALYWLDEYRFDGLRIDAAHAIDDDAWLAGLARRVRAYAGDARHVHLVLENERNTASLLAGGRFDAQWNDDFHNSMHVLLTGEQAGYYRAYADAPIRHLARVLGEGFAYQGEPSPLHGGAPRGEPSADLPPSAFVAFLQNHDQIGNRAFGERLRALVNDDALRAASALALLAPQIPLLFMGEECGTTQPFQFFTDHRGALAAAVREGRRREFAAFPAFADPAHRDAIPDPNDPATFARSSLAAPGAEPPDANAWRRFYRGALAVRARFVTPWLDGARALGATVLARADGGHANALVARWRLGDGNTLAIALNLDARPAALAAPPDGKIVFETPPRARDALADARLAAHACIAWRSGNVNGVARRGRAVDAKHMPAVKHANGVNGQDGAP

SEQ ID NO: 11656 - protein, 173 aa, Flaveria pringlei
MASIPATVATVAQANMVAPFTGLKANAAFPVTKKVNDFSTLPSNGGRVQCMKVWPPLGKKKYETLSYLPDLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPGGF

SEQ ID NO: 11657 - protein, 131 aa, Picea mariana
DFQEVNHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 11658 - protein, 464 aa, Borrelia garinii
MDVGIYGLGVMGGNLALNIADNGFNVSVYNRDSEKTEIFVKQNSHKKINGFKDVESFVKSLKPPRKIILMVTSLAVEKVVEQILPLLNKSDIIIDGGNSHYKNTMRIEKELFAKDIYFVGLGISGGERGARFGPALMYGGSKSAYEILEPILNKIAAKTKNNDVCSTYIGENGSGHYVKMIHNGVEYADMQLISEVYFFMKKAFNLDNSKISEVFEKWNEGDLSGYLLEITSKILRYKENNEYLVDKILDVANQKGTGVWTSIDALESSMPVNLILESVFSRFMSGLKHERIIASDLLKMDTASFEFELSDWILDLYYALLVSKIVAYAQGFMMLKTASVNYSWDLNLGKISLVWREGCIIRSSFLDKIKLAYDKNPHLINLLFDDYFLDLLKNNHKSLRRIVSKASEIGIPLPAFYASLSFLDSYSTNYLPSNLIQAQRDFFGAHSFERLDSKRGEFFHSIWQ

SEQ ID NO: 11659 - protein, 346 aa, Magnaporthe grisea
MAKYMSLDQKGSIMAEYVWIDSEGGVRSKSRTLKEQKYEPKDLPTWNFDGSSTGQAGGDNSDVFLKPVAVYPDPFRGEPNIIVLAECWDSDGTPNKFNHRHEAAKLMEAHAEHEPWFGLEQEYTLLNLEDRPFGWPKNGFPAPQGPYYCGVGAGKVVQRDIVEAHYKACLYAGVKISGTNAEVMPAQWEFQVGPCEGIEMGDHLSIARFLLHRVAEEFGAKVSFDPKPIPGDWNGAGLHSNFSTKEMRVDGGMKHIEAAIKKLEGRHKEHIAVYGEGNEKRLTGSHETGSIEEFSYGIANRGASIRIPRECAAKGYGYFEDRRPASNADPYQITGIIMETCFGAVN

SEQ ID NO: 11660 - protein, 178 aa, Flaveria pringlei
MASISSTVATVSRAAPAQANMVAPFTGLKSNVAFPATKKANDFSTLPSNGGRVQCMKVWPPLGKKRYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPEGF

SEQ ID NO: 11661 - protein, 199 aa, Haemophilus parasuis
EAGDIIIDGGNSNYPDTNRRVKALAEKGIRFIGSGVSGGEEGARHGPSIMPGGNSEAWQYVKPIFQAISAKTDKGEPCCDWVGKEGAGHFVKMVHNGIEYGDMQLICEAYQFLKDGLGLSYDEMQAIFAEWKKTELDSYLIDITTDILGYKDTDGTPLVEKILDTAGQKGTGKWTGINALDFGIPLTLITESVFARCVS

SEQ ID NO: 11662 - protein, 452 aa, Desulfitobacterium hafniense
MIYVGKSPDRHTLRQDEINQLLVQKSLAGKVVTRLKGGDPFVFGRGGEEAEALLAVGIPFEIVPGITSAIAVPAYAGIPVTHREMTSSFAVITGHEDPGKNDSAIAWEHLVPAHGTLIFLMGMENLSLIAQRLIQHGKNPATPVGIIQWGTRPEQRTLVGRLDTIASLVQEQGFTNPATIIVGEVVSLREKLQWFEKKPLFGSRIVVTRARHQAGVLAQAIEDLGGEPWEFPAIEIREPSDPELLTRAMQDLRRFKWLVFTSANGVERFLSGLKDSGKDIRDLSGMEIVAVGPVTQAALEQRGLCVTCMPEEYRAEGILAELTGRILPGEGVLLARAEEARDVLPQSLQTLGAEVWDVPVYKTVSGSANKGLLKSMLEDKQIQAVTFTSSSTVRNFCRLIDNQTELLDGVKLFSIGPLTSAAARELGLPIHKEAARSTIDGLVAALVEGARG

SEQ ID NO: 11663 - protein, 179 aa, Fritillaria agrestis
MASSATMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 11664 - protein, 179 aa, Fritillaria agrestis
MASSATMLSSVATAACAAPAQASMVAPFVGLKSASAFPVTQKTATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTGAAQVVKEAAECKKEYPAAFIRVIGFDNVRQVQCVSFIVEKPE

SEQ ID NO: 11665 - protein, 88 aa, Oryza sativa
MSVRLASGRITDDEINELIFKLQSLLPESSRRRGATSRSPATKLLKEMCSYIKSLHREVDDLSERLSELMATMDSNSPQSDIIRSLLR

SEQ ID NO: 11666 - protein, 182 aa, Unknown
  Dehalococcoides sp. BAV1
MMNRMKLSLFIPKTEIEVYLERLAYEINRDFKDRPLVVIGVLKGSFVFMADLIRRLNMPVELDFVGLASYGKNTQSCGKVHLTRPLNRDIAEKDILVIEDIVDSGLTVSYLLKYLKKRRTNSVKLCALLSKPSRRVCPVEIDYLGCEVEDKFLVGYGLDWAECYRQLPEIFALEGKPDADKP

SEQ ID NO: 11667 - protein, 543 aa, Brassica rapa
MASMSMSSREKRRKRKREASPESTTPVSKPTPASTPRWSSPIPSLPYDLVLLCVARVSRLYYPTLSLVSKSFRSLVSSPELYKTRSLFGFTESCLYVCLQDLRGSSTWYTLCRKPDKTLKTGSSGYALSKVPVPSSPIWRCSNVVAVGSNIYNIAFPRSLNVLPRVSILDCKSHTWIEAPSLPVELHSFSASVVHQKIYVAGFDHRLKKNSFEVFDTETQIWDSVSTGNTSVEREGIEREGMFIKKTISIDGKFHVVTDEEVFAYDPKLAKWDMVGRGMRGLMYSEAYCVIGNVLYSAKEGVFKWYDTERRTWKDLQGLVGLPKITRHREFIRLGYYGGKMVVFWVHVIWPYYKKICFFEEAQLVLADLWFWSCNEKIREYTAQVLYFAVKTLKETGHEHVYDAVEKPLQLAQTAAVLEVQSHFLVASLVISWSITEIIRYSFFGLKEALGFAPSWHLWLRYSSFLVLYPTGITSEVGLIYLALPHIKTSEMYSVRMPNTLNFSFDFFYATILVLAIYVPGSPHMYRYMLGQRKRALSKSKRE

SEQ ID NO: 11668 - protein, 251 aa, Unknown
  Polaromonas sp. JS666
MTFEAQEHTGRGFVSIVGAGPGPVDLMTLRAFDRLQRAEVVVHDRLIAPEVLALIPVAAQRVYVGKALGNHAVPQGGIHDLLVQHARLGKRVVRLKGGDPYVFGRGGEEVQALQAAAIAFEVVPGVTAASGCSAAAGIPLTHRDLAGSCVFLPGHLADDEATHDWQALARPGQTRVFYMGVQRLAQIAHQLIAHGLAPDTPAAIVRDGARATQTVIATGLRDLVARAPAYGPQPGLLIIGETVQLSPHFNL

SEQ ID NO: 11669 - protein, 323 aa, Unknown
  Erythrobacter sp. NAP1
MATHHTKMLIIGSGPAGYSAAIYAARAMLEPIVVQGLQPGGQLTITTDVENYPGFRDVVQGPWLMEEMKAQAEHVGTRMMYDIITSVDLEGGSPFRAVGDSGDEYIADTIVIATGAQAKWLGVPGEQELGGKGVSACATCDGFFYRGKKVAVIGGGNTAVEEALYLTNHSDDVTLIHRRDELRSEKILQDRLFKSPKISTLWNKTVESFEAGENGTLSHLVLKDTQTGETSTLEVDGAFVAIGHAPATELFKGKLPMDESGYLDTEPGTPKTVIPGVFAAGDVTDHVYRQAVTAAGMGCMAALDGERFLATMEDAEEEAEAAE

SEQ ID NO: 11670 - protein, 310 aa, Haloarcula marismortui
MSDSDSFEQFSDVGEAEVTRAIGQEWTEEFMDFSDSDVIIVGGGPSGLMAAKELAERGVQVMVVEKNNYLGGGFWLGGFLMNKVTVRDPAQQVLDELEVDHKRSKDSEGLYVANGPEACSGLIKAACDAGAKMQNMTEFTDIVIREDHRVGGIVMNWTPVHALPREITCVDPIAVEADLVIDATGHDAMAVKKLDERGVLNAPGLEDEASGMDQTDDDTYGAPGHDSPGHDSMWVGESEDAVVEHTGLAHDGLVVTGMATATTYGLPRMGPTFGAMLVSGKRAAQVALDELEVDAEPVDVTSRDATPADD

SEQ ID NO: 11671 - protein, 174 aa, Pisum sativum
MARMAQEPLIVGRVIGEVLDSFTTSMKMTVSYNKKQVFNGHEFFPSTINTKPKVEIDGADMRSFYTLVMTDPDVPGPSDPYLREHLHWIVTDIPGTTDATFGKEIVSYEIPKPNIGIHRFVFVLFKQRARDSVRATPSSRDHFNTRSFASQNDLGLPVAAVYFNAQRETAARRR

SEQ ID NO: 11672 - protein, 91 aa, Pisum sativum
HLHWIVTDIPGTTDATFGRKEVMKYEMPRPQIGIHRFVFLLYKQKRRQTVMKIPTSRDLFNTQKFAQDNDLGPPVAAVFFNAQRETAARRR

SEQ ID NO: 11673 - protein, 440 aa, Chlorobium tepidum
MDNDILKRLDPEVFEAIANETKRQTETLELIASENFTSKAVMEACGSVMTNKYAEGYPGKRYYGGCEFVDVAENLARDRAKKLFGCEYVNVQPHSGSSANMAVLFAVLKPGDAIMGLDLSHGGHLTHGSKVNFSGQFFDAHSYGVDKETGIIDMNKVEEMARRVKPKLIITGASAYSQGFDFKAFREVADKVGALLMADIAHPAGLVAAGLSANPMPHCHFVTTTTHKTLRGPRGGMIMMGKDFENPLGLTINTKNGSRVKMMSEVIDAEVMPGIQGGPLMHIIAGKAVAFGEALQPEFKAYAQQIKDNAAAMAAKFLAAGYHIVSGGTKNHLMLLDLRNKNVNGKVAENLLHEAGITVNKNMVPFDDKSPFVTSGIRIGTPAMTTRGMKVAEAEKIVEFIDRVISAANDANVADVCKAVRAEVRELCLGFPLNNYGSLV

SEQ ID NO: 11674 - protein, 546 aa, Medicago truncatula
MVAGSGCLVWFPHSCTNIFPSSFVSSTSQHHRSVLSLFFPKNRNMSQQQLNLSSTTTNIEVEVVDNSPPMTLPSFNDYHQIDDKVLENIVYDALVFATLNGLLVGDKSVERSGRVPGVGLVHLPFSLLPPPLPETHWKQACDLSPLFNELVDRVSLDGKFLQQSLSKTKKADEFTSRLLDIHAKMLEMNKKEEIRMGLFRSDYMLDEKTKSLLQIEMNTISTSFSGVGVVMTELHRNILSHYGKLLGLDSERVPVNTADSRYAEALAKAWKEYNNPRAVIIVVVQGEERNMYDQHFVSAILREKHHITTIRKTLAEINQEGEILPDGTLSVDGQAVAIVYFRAGYTPVDYPSESEWRARLLIEQSSAIKCPNISYHLVGTKKIQQELARPNVLERFFENKEDIAKLRKCFAGLWSLEDSDIVNEAIAKPELFVMKPQREGGGNNIYGDDLRETLKRLQKPGSQEDAAYILMQRIFPANTASILMRNGFLHKDHVISEFGIFSTYLRNKDKVIVNNESGYMVRTKPSLSDEGGVLPGFGVIDSVYLT

SEQ ID NO: 11675 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKEEFHQETCRKIKALHKYDCLRANKSTFAWGLEARVPFLDKDFIRVAMNIDPEYKMIKKEEGRIEKWALRRAFDDEEHPYLPKHILYRQKEQFSDGVGYGWIDGLKAHAEKHVTDRMMLNAANIFPFNTPTTKEAYYYRMIFERFFPQNSARLSVPGGPSVACSTAKAVEWDAAWSNNLDPSGRAALGVHASAYGNQVKAVEPEKIIPKMEVSPLGVAI

SEQ ID NO: 11676 - protein, 224 aa, Zea mays
  misc_feature (91)..(91): Xaa can be any naturally occurring amino acid
  misc_feature (173)..(173): Xaa can be any naturally occurring amino acid
  misc_feature (183)..(183): Xaa can be any naturally occurring amino acid
  misc_feature (217)..(217): Xaa can be any naturally occurring amino acid
MGRRPARCYRQIKNKPYPKSRYCRGVPDPKIRIYDVGMKRKGVDEFPYCVHLVSWEKENVSSEALEAARIACNKYMTKSAGKDAFHLRVRXVHPFHVLRINKMLSCAGADRLQTGMRGAFGKPQGTCARVDIGQVLLSVRCKDNNAGPWPAKLWRRAKFKFPGRQKIIESRKXWGFTKFSRAXYLKYKSEGRIVPDGVNAKLLGNHGRLEKRAPGKXAFLDAVA

SEQ ID NO: 11677 - protein, 258 aa, Methanothermobacter thermautotrophicus
MKLDDIKISRAIVEGYMEDLLDYMEMDVAIGGGGPSGLTAGYYLARAGLKVALFERKLSIGGGMWGGGMMFNKIVVQDEGREILDEFGIRSEPYDEGYHVADSVEATSTLCSRACQAGLKIFNLMSIEDVMIRDEGITGLVLNWSSVEMAGLHVDPLTVRARAVIDATGHDCEIVKVVERKIGPELNTPDGRIQGERSMWADVGEAALIENTREVYPNLYVAGMASNAVYGAPRMGPIFGGMLVSGRRVAEMIIEKLK

SEQ ID NO: 11678 - protein, 479 aa, Thiomicrospira crunogena
MKTLVWLQRELRINHHPALEAAMAASDDIIVAYFHDPEQTIGAANTVWLANSLQQLQQDFKTRHGRLWCLEGIFEQQLEQVIQTHQIEQVFYTFQLGHPFKAMQQQALNVCQRCQVPLRAFETENWLHYNQLLNQSGQPYKVFTPFYNTLSRKLSELEPFSDPIDTLEKTARTVCQSGQDQNLPQSLNQILARPWARKIMQHWQVGEHKAWSKFETFITEGLANYEQDRDFPAIDGTSQLSPHLHFGELHSRAIVFELLSLETEPTIANQAIRVWLRQLAWREFARAILWHFPHTETHPFQAKFETFYRPLAEDDSESSKNYQAWCEGRTGVPIIDAGMKQLWETGWMHNRVRMLVASWLTKNADIDWRAGAQWFNDTLVDADPANNTLGWQWVAGCGVDAAPYYRLFNPVRQSEKFDANGQYLRQWLPELKTYSNKHIHAPWLIAPNEKHFCPIIDLTESRQHHLDKVATLKSLNQIH

SEQ ID NO: 11679 - protein, 252 aa, Pyrococcus horikoshii
MLREVTITRAIVESYYRDLLNNLELDVAIVGAGPSGMVAAYYLAKGGAKVAIFEKKLSIGGGIWGGGMGFNKVVVQDEAREILDEFGIRYEEFEKGYYVADAIEVATTIASKVVKSGVKIFNMIEVEDLVIKDNRVSGIVINWTPVLMAGLHVDPLTIEAKYVIDSTGHGAQVAQFLVKRGLLKEIPGEGAMWAEQGEKLTVKNTREVFPGLYVTGMAANAIAGAPRMGPIFGGMFLSGRKAAQEILKKLKS

SEQ ID NO: 11680 - protein, 270 aa, Glycine max
EGNEKGLQPRINLQGYLLGNPITTRNEGNDQIPFAHGMGLISDELYASLQRNCKGEYENRDSRNVLCLRDLKHYDECLSGINTFYILDRYCKSDSPKKHEAQWRRSLTQKFEASLNSHLRVPDIRCQIFGFFLATQWANDESVRKSLHIREGTIGKWERCYTTDFEEQIFSSFEFHVNLSAKGYRSLIYSGDHDAVVPFMSTQAWIRALNYSIVEDWRPWLLEDQVAGYTRIYSNQMTFATVKGSGHTAPEYKPEEGFAMFSRWIANMPL

SEQ ID NO: 11681 - protein, 439 aa, Xanthomonas campestris
MSSTAPPLSFARILALNAGFFGVQYSFGLQQSNMSPIYNYLGADHASLPYLWLAGPITGLVLQPFVGALSDRSVTRWGRRMPYMVLGALVCSLCLLAMPFSTALWMAVCLLWVLDAANNVAMEPYRALVSDVLAPPQRPLGYLTQSAFTGLAQTLAYLTPPLLVWFGMSQDAANAHHIPYVTIAAFVIGAGFSAASILLTARSVREPVVPAAEIARMRKAGTGLGATLREIGSALRDMPPTMRQLAPVMLFQWYAIFSYWQYIVLSLSTTLFGTTEANSHGFREAGLVNGQIGGFYNFIAFLAAFAMVPVVRRVGPKYTHAACLLAAGVGMWVLPGIENRWLLLLPMIGIGLAWASMMGNPYLMLADSIPPERTGVYMGLFNLFIVLPMLIQIVTLPLYYEPLLHGDPRNVIRLAGALMLAAAVAMLCVRIRKPKAVAA

SEQ ID NO: 11682 - protein, 519 aa, Fulvimarina pelagi
MATSDQAAGADQDVSSETAGEGATGSLKLLPMLIGLGVFVVLLILPPPEGLAIEAWRVVAVASLMIVWWITEAIPVPATALVPLVLFPLTGATSMDDAAAPYADPTIFLFMGGFMLAGAMERWNLHRRIALNIVSRTGSRQHHIVGGFMLATAFLSMWVSNTATTVMMLPIALSVVGLVGDETGNAADAKKFALALLLGVAYSASIGGVATLIGTPPNALLAGTLSQNYGYDLGFGRWMLIGLPVAILMLGISWFLLTQFAIGLKKDEIEGAQEVIKRELIGLGSMSRAETIVGAVFAGAAVLWILRSWLQNFVPELDDAAIAIGAALLLFVIPTSEKDGDGTRIGLLDWKTAAKLPWGVLILFGGGLSLAAAVTETGLDEWIGSAIGSFAGTLTLIVLVLVVASIMLMLTEFTSNTATAATFLPLLAALSQNIGENPLMLAVPAALSASMAFMMPVATPPNALVFSSGHVTIPQMVRYGAWHNLAALIVVSTIGYLVLTTLFGVTVGEMPDWASGTGN

SEQ ID NO: 11683 - protein, 514 aa, Chlamydomonas reinhardtii
MALKMRVSQRQALGSQTFVCPHGSVVRKAVSSKARAVSRQAQVVRAQAVSTPVETKVANGVAASSAAGTGQNDPAGDISKTVLGIILGGGAGTRLYPLTKKRAKPAVPLGANYRLIDIPVSNCLNSNVTKIYCLTQFNSASLNRHLSQAYNSSVGGYNSRGFVEVLAASQSSANKSWFQGTADAVRQYMWLFEEAVREGVEDFLILSGDHLYRMDYRDFVRKHRNSGAAITIAALPCAEKEASAFGLMKIDEEGRVIEFAEKPKGEALTKMRVDTGILGVDPATAAAKPYIASMGIYVMSAKALRELLLNRMPGANDFGNEVIPGAKDAGFKVQAFAFDGYWEDIGTVEAFYNANLALTDPEKAQFSFYDKDAPIYTMSRFLPPSKVMDCDVNMSIIGDGCVIKAGSKIHNSIIGIRSLIGSDCIIDSAMMMGSDYYETLEECEYVPGCLPMGVGDGSIIRRAIVDKNARIGPKCQIINKDGVKEANREDQGFVIKDGIVVVIKDSHIPAGTII

SEQ ID NO: 11684 - protein, 466 aa, Oryza sativa
MSWSRRRWCGRGSTAWSLGSMPHLLYCQCHFRPRVRPRVRLHAPFALLPMSFSKVYWDQAVELAPLFNELVDRVSLDGDFLQETLARTKEVDSFTGRLLDIHAKMMKLNKKEDVRLGLTRSDYMIDGATDQLLQVELNTISTSSNGLACGVCELHRNLIRQHERELGLDPESVVGNTAIAQHAEALAGAWAEFNNQSSVVLVVVQPEERYMYDQYWITVALREMYGVTTIRKTMAAIDAEGELRPDGTLTIDGLPVAVVYFRAGYTPNDYPSEAEWRARLLIECSSAIKCPSIAHHLVGTKKIQQELAKENVLERFLDNKADIEKVRKCFAGLWSLENDSIVMSAIESPELFVLKPQREGGGNNIYGDNLRETLISLKKDGSNELAAYILMQRIFPPASLCYLVRDGTCIRENAVSEFGIFGAYLRNKDRVIINDQCGYLMRTKAASLNEGGVVAGYAFLNSVFLT

SEQ ID NO: 11685 - protein, 475 aa, Agrobacterium tumefaciens; identical to SEQ ID NO: 469

SEQ ID NO: 11686 - protein, 882 aa, Agrobacterium tumefaciens; identical to SEQ ID NO: 375

SEQ ID NO: 11687 - protein, 815 aa, Agrobacterium tumefaciens
MTQKLVIIGNGMAPGRMLENLFETAPGLYDVTIFNAEPRVNYDRIMLSPVLSGEKSYEDIVIHNDEWYAANNVTLHKGAKVTRIDRANKIVTSENGITASYDRLVIATGSLPFIIPVPGHQLPGVLAYRDLDDVTKMLEIAKGKGRAIVIGAGLLGLEAAYGLKRQGMDVTVIHLMPTIMERQLDPAAAYLLEKALNERGIDIITKANTKCILGEEKVEGIELEDGRIIKGDMVVMAVGIRPASGLAKEAGIAVNRGIVVDDGMMTSDASIYALGECAEHRGMCYGLVAPLYESARVLADRLCGGSAEYHGSVTNTKLKVTGINLFSAGDFAEGDDREEIVLRDATAGVYKRLILKENRIIGAVLYGETADGSWFFDLMKKSTDISAMRETLIFGQAYQGGSPLDPMAAVAALPDDAEICGCNGVCKGKITSAITSKGLTSLDDVRAHTKASASCGNCTGLVEQLMTLTLGDTYNPAAVQPMCKCTDLGHDDVRRLIKAKGLKTIPAVMQELEWKTSCGCAKCRPALNYYLVCDFPDEYADDYQSRYINERVHANIQKDGTYSVVPRMWGGVTNADELRAIADVVDKFEIPLVKVTGGQRIDLLGIEKEDLPAVWADLGKAGFISGQAYAKGLRTVKTCVGEQWCRFGTQDSTGLGIRIEKFMWGSWTPAKLKLAVSGCPRNCAEATCKDIGVICVDSGFEIHFAGAAGLDIKGTEVLGLVHTEDEALEHIVALTQMYREQARYLERIYKWAKRIGYDEVRRQIMDDADKRKAYFDRFVFSQKFAQVDPWSERVSGHDKHEFRPMAAIGFSEAAE

SEQ ID NO: 11688 - protein, 173 aa, Flaveria pringlei
MASIPATVATVAQANMVAPFTGLKSNAAFPVTKKVNDFSTLPSNGGRVQCMKVWPPLGKKRYETLSYLPNLTESQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 11689 - protein, 178 aa, Flaveria pringlei
MASISSTVATVSRAAPAQANMVAPFTGLKSNAAFPATKKANDFSTLPSNGGRVQCMKVWPPLGKKKYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 11690 - protein, 508 aa, Bacillus cereus
MILDADIKTQLSQYLQLMENDILLKVSAGDDDVSKDMLALVDELATMSSKITVEKVELERTPSFSVNRPGEDTGVVFAGIPLGHEFTSLVLALLQVSGRAPKVEQKLIDQIKNIQGEYHFESYISLSCHNCPDVVQALNVMSVLNSGITHTMIDGAAFKEEVESKDIMAVPTVFLNGESFGSGRMTLEEILAKMGNGPDASELSDKDPYDVLVVGGGPAGASAAIYAARKGIRTGIVAERFGGQVMDTMGIENFISVKRTEGPKLVASLEEHVKEYDIDVMNLQRAKRLEKKELIEVELENGAILKSKSVIVSTGARWRNVGVPGEAEFKNKGVAYCPHCDGPLFTGKDVAVIGGGNSGIEAAIDLAGIVNHVTVLEFMPELKADAVLQERLNSLPNVTVLKNVQTKEITGTDKVNGISYIDRETEEVHHVELQGVFVQIGLVPNTDWLGETVERVRGEIVTDKHGATNVPGVFAAGDCTNNPYKQIIISMGSGANAALGAFDYLIRN

SEQ ID NO: 11691 - protein, 173 aa, Flaveria pringlei
MASIPATVATVAQANMVAPFTGLKSNAAFPVTKKVNDFSTLPSNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 11692 - protein, 564 aa, Unknown
  Burkholderia sp. 383
MNHPATVSSIAGARKATAAPCHARPRTCGEALVDLLERHGVECVFGIPGVHTVELYRGLAASSIRHVTPRHEQGAGFMADGYARVTGRPGVCFIITGPGMTNIATAMAQAYADSIPMLVISSVNARRELGSGDGRLHELPSQRDVFAGLTAFSHTLLDAADLPQVLARAFAVFASARPRPVHIEIPLDVIVMPAPALSDAPPALPARPAPDANALAAAADLLAHARRPLILAGGGAIHAAAELRELAERLHAPVALTINAKGLLPAGHPLLIGSTQSLPATRAAIRDADVVLAVGTELGETDYDVTFDGGFAIDGRLIRIDIDAQQLMRNARAEIAIAGDSQLALGALSTRLHETPAPTPDAGWGAPRVAAVRAAIAATHDSAAQSQALLIDTIVATLPGAIIAGDSTSPVYVGNFTHDAPAPRSWFNSSTGYGTLGYGLPAAIGAKLAAPARPVVCLIGDGGLQFTLPELASAVEARLPVIVIVWNNHGYGEIRKYMVARDITPVGVDPYTPDFQVLARGFGCAAHTAATPGALAAALRDAAARAIPTVIEIDEATWFGQVQR

SEQ ID NO: 11693 - protein, 180 aa, Spinacia oleracea
MASSVLSSAAVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 11694 - protein, 182 aa, Fagus crenata
MASSMISSATVATVSRATPAQATMVAPFTGLKSTAAFPATRKSNNDITSLASNGGRVQCMKVWPPLGLQKFETLSYLPPLSIESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPAK

SEQ ID NO: 11695 - protein, 411 aa, Clostridium thermocellum
MKYVIIGNSIAAVGAVEGIRKIDTEGEITIIGKEPYHVYSRPLISYLLYGKTDEERMKYRGSSFYDTMNCKVILGREAVKINDAKKEVVLDNGEVINYDKLLVATGSLPFVPPMKGLEGVEKRFSFLSLDDAKKLESAISPSSKVLIIGAGLIGLKCAEGISKKVESITVVDLADRILSSILDKDGAEIVKSHIEKENIKFVLNAKVEEFINSNEALLDSGEKVEFDVLVVAVGVIPNTGLIKDINGKVNRGIVVDEFCQTSIPDIYAAGDCCESFDITSEQNRVLALLPNAYMQGECAGINMAGGKKEFGKAIPMNAISFFGLHIITAGSYVGEVFSKINGDNYKKLFVKDGLLKGYIMIGDVDKAGIYTSLIREKTPLSEIDFELIFERPGLMAFTRKERQRMLGGVVR

SEQ ID NO: 11696 - protein, 187 aa, Capsicum annuum
MASSVMSTATVATGANAAQASMIASFNGLKSAASFPVTRKQDLDITSIASNGGRVECMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEATKFSMFNV

SEQ ID NO: 11697 - protein, 563 aa, Brassica rapa
MAPMTNWLTFSLSPMEMLRSSDQSQFVSYDASSAASSPYLLDNFYGWTNQKPQEEEEAQITASMADSTILTSFVDSQNHSQNHIPKLEDFLGDFRYSDNSQTETQDSSSLTHIYDPRHHQNQTGFYSDHSHDFKAMTGFQTAFSTNSGSEVDDSVSMSRTHLAGEYLGHVVESSGHELGFIHGGANTGGALSLGVNINNTNNHASNDNNKISEYNYRGNNNGERIINNNNREKTDSEKEKPVVAVERSDSSNKKVADTFGQRTSIYRGVTRHRWTGRYEAHLWDNSCRREGQARKGRQGGYDKEDKAARAYDLAALKYWNTAATTNFPITNYSKELEEMKHMTKQEFIASLRRKSSGFSRGASMYRGVTRHHQQGRWQARIGRVAGNKDLYLGTFATEEEAAEAYDIAAIKFRGINAVTNFEMNRYDVEAIMKSALPIGGAAKRLKLSLESEQKPIIGHHQLHHFQQQHQQLQSSPNDSSINFALCPSSAAQSQMIPCGIPFEAASLYHHQQQQQQQNFFQHFPANAASDSTDSNNNSNVQSSMGLMAPNAAAEFFLWPNQSY

SEQ ID NO: 11698 - protein, 175 aa, Aegilops tauschii
MAPTVMASSATSVAPFQGLKSTAGLPVSRRSNGASLGSVSNGGRIRCMQVWPIEGIKKFETLSYLPPLSTEGLLKQVDYLIRSKWVPCLEFRKVGFIFREHNVSPGYYDGRYWTMWKLPMFGCPAPTQVIPEVEEVRKEYPDPYCRIIGFDNMRQVQSVSFIASKPPGCEESGKA

SEQ ID NO: 11699 - protein, 176 aa, Erwinia chrysanthemi
MIFVLNLLNFNNLTILPIAENKTALYYLCTVTVNIYFEINPMSEALKILNNIRTLRAQARECSLETLEEMLEKLEVVVNERREEENQAQAEIEERTRKLQQYREMLIADGIDPNELLQSLGSSKVAGKAKRAARPAKYQYTDENGELKTWTGQGRTPAVIKKAIEEQGKSLDDFLL

SEQ ID NO: 11700 - protein, 227 aa, Brassica napus
MSQLLSSPPLAVNSRIFLTHRFPEARFLTAGVFVGKGRGFAVKPTERLKLTVKSRYSDSSSPAYSQQNGEGSSPRFYVGHSIYKGKAALTIEPRAPEFVALESGAFKLSKEGFLLLQFAPAAGVRQYDWSRKQVFSLSVTEIGNLVSLGPKESCEFFHDPNKGKGSDEGKVRKVLKVEPLPDGSGRFFNLSVQNKLLNVDESVYIPITKAEFAVLISAFHFILPHLI

SEQ ID NO: 11701 - protein, 136 aa, Ajellomyces capsulatus
MARTKQTARKSTGGKAPRKQLASKAARKAAPSTGGVKKPHRYKPGAVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 11702 - protein, 183 aa, Amaranthus hypochondriacus
MASSMLSNAAMATTAATAGAQASMVAPFNGLKSFATFPITKKSSNDFSSLPSNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPSAFIRIIGFDNKRQVQCVSFIAYKPAGGL

SEQ ID NO: 11703 - protein, 290 aa, Pseudomonas fluorescens
MSQETPYIFDARTADFDQSVIENSFHKPVLVDFWAEWCAPCKALMPMLQQIAESYQGELLLAKVNCDIEQDIVARFGIRSLPTVVLFKDGQPVDGFAGAQPESAVRAMLEPHVQMPPPPAADPLEQAEALFAEGRIGDAEALLKVLLGEDNSNAKALILYARCLAERGELGEAQTVLDAVKSDEHKAALAGAKAQITFLKQAADLPDAAELKARLAKDPQDDEALYQLAIQQLARQQYEAALEALLKLFMRNRSYNEGIAHKTLLQVFDLLGNDHPLVTAYRRKLFAALY

SEQ ID NO: 11704 - protein, 238 aa, Prochlorococcus marinus
MAVVTLSEMMEAGAHFGHQTRRWNPKMSRYIYCARNGVHIIDLVKTAVCMNSAYKWTRNAAKSGKRFLFVGTKKQASEVVALEANRCGASYVNQRWLGGMLTNWTTMKARIDRLKDLERMESSGAIAMRPKKEASVLRHELERLQKYLGGLKGMKRLPDVVVLVDQRRETNAVLEARKLDIPLVSMLDTNCDPDLCEVPIPCNDDAVRSVQLILGRLADAINEGRHGSNEHRGGQRLK

SEQ ID NO: 11705 - protein, 196 aa, Solanum lycopersicum
QAPGEDSEVILYPQAIFKDPFRRGNNILVMCDAYTPAGEPIPTNKRHAAAKVFSHPDVAAEETWYGIEQEYTLLQREVNWPLGWPIGGFPGPQGPYYCGTGADKAFGRDIVDAHYKACLYAGINISGINGEVMPGQWEFQVGPSVGISAGDEVWVARYILERIAEIAGVVVSFDPKPIPGDWNGAGAHTNYSTKSM

SEQ ID NO: 11706 - protein, 558 aa, Streptomyces coelicolor
MAQADGETRTVIMTVDDDPGVSRAVARDLRRRYGATYRIVRAESGESALDALRELKLRGDLVAVILADYRMPQMNGIEFLEQALDVYPGARRVLLTAYADTNAAIDAINVVDLDHYLLKPWDPPEEKLYPVLDDLLQAWRAGDHRPVPSTKVVGHRWSARSSEVREFLARNQVPYRWYSSDEPEGRRLLSAAGQDGQRLPVVITPDGTPLVEPEAPELAARVGLATTPTSDFYDLVVIGGGPAGLGAAVYGASEGLRTVLVERSATGGQAGQSSRIENYLGFPDGVSGGQLTERARRQAARFGAEILTAREVTGLEANGAARVVRFSDGSAIAAHSVILATGVSYRQLTAPGTEDLAGCGVFYGSALTEAASCQGHDVYIVGGANSAGQAAMYLARGAKSVTLLVRGGSLEASMSYYLIQQIEETPNIRVRCGTLVEGAHGDGHLERLTLRDAASGATELVDAQWLFVFIGAAPLTDWLDGTVLRDERGFILAGPDLTPDGRPPAGWELDRPPYHLETSVPGVFVAGDARAESAKRVASAVGEGAMAVMLVHRYLEQS

SEQ ID NO: 11707 - protein, 151 aa, Glycine max
MGAFTEKQEALVNSSFEAFKANLPHHSVVFFNSILEKAPAAKNMFSFLGDAVDPKNPKLAGHAEKLFGLVRDSAVQLQTKGLVVADATLGPIHTQKGVTDLQFAVVKEALLKTIKEAVGDKWSEELSNAWEVAYDEIAAAIKKAMAIGSLV

SEQ ID NO: 11708 - protein, 313 aa, Bradyrhizobium japonicum
MRRGNPVTIIDQGNGAAGPAAADLIKDTTTQTFVKDVIEESKRQPVLIDFWAEWCGPCKQLTPVLEKAVKAAKGKVKLVKMNIDQHPAIPGQMGIQSIPAVIAFVNGQPADGFMGAVPESQLNAFIEKLTKGVTAPGEPNIAEILQEAEAVLAEGDAAAAAQIYAEVLSHDSTNIAALAGLAKCYTVSGAMEQAKQTLAMVPESKRNDPAVKAVQTAIDLAEQAEQLGPVAELEQKVAANPLDHQARFDLATALNAQGNRAAATEQLLAIIKRDRKWNDDGARKQLVQFFEAWGGTDDATVEGRKRLSTILFS

SEQ ID NO: 11709 - protein, 957 aa, Unknown
  Bradyrhizobium sp. BTAi1
MTTPLKPLDDAATSFARRHIGPSPRDVAAMLETVGAKSVAELMAQTLPGTIRQATPLTLEPALSEVEAIGHMRALAAQNQVFTSLIGQGYSGTIMPAVIQRNILENPAWYTAYTPYQPEISQGRLEALFNFQTMICDLTGLDVANASLLDEGTAAAEAMALAERSARAKTKAFFVDRNVHPQTLAVLRTRAEPLGWQLIVGDPVKDLDGAEVFGGLLQYPETTGALRDPRADIAKLHDKGALAILAADLLALTVIASPGELGADIAIGSAQRFGVPMGYGGPHAAYMAVRDALKRSLPGRIVGLSVDSRGAPAYRLALQTREQHIRREKATSNICTAQVLLAVIAAMYAVYHGPDGLKSIARTVHRRAAVLAAGLRKLGFAPASDSFFDTVLVEAGANCDEIIARAESQRINLGRDGSRLRIALDETTTADVVEAVWRAFGGELSYAAIEAEARDAVPAELKRQRPFLTHPVFHAHRSETEMLRYLRKLADRDLALDRAMIPLGSCTMKLNATTEMIPLTWPEFSSLHPFVPRAQAAGYHTMFADLQDWLCRISGYDAVSLQPNSGAQGEYAGLLAIRGYHAARGEGHRTICLIPSSAHGTNPASAHMVGMEVVVVGCDSNGNVDLADLKAKAELHSAKLAAIMITYPSTHGVFEEHIRDICDIVHAHGGQVYLDGANLNAQVGLSRPGDYGADVSHFNLHKTFCIPHGGGGPGMGPIGVKAHLAPFLPGHPATDAATPSPVGPVSAAPYGSASILTISYIYMLLMGGEGLTRATEIAILNANYVAARLDPHFPVLYRNERGRVAHECIIDPRPLKQTCGVTVDDIAKRLIDYGFHAPTMSFPVAGTLMIEPTESESKAELDRFCDAMIAIRKEIAAVEQGRFTIEASPLRHAPHTVHDIADDDWNRVYRRSEGCFPEGTSRTDKYWCPVGRVDNVYGDRNLVCSCPPIGDYAQAAE

SEQ ID NO: 11710 - protein, 654 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVRAVSFAMVTITYYFHPEKDVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQQQLVPLVWPSSADSNLSAPKVLPDGRGSVSLKSRYQRSV

SEQ ID NO: 11711 - protein, 625 aa, Cornus unalaschkensis
MASSGEQNQVGLLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 11712 - protein, 312 aa, Bradyrhizobium japonicum
MTDWTTADIPSLSGRTAVVTGATGGLGYETAMALAGAGAIVILTGRNDAKGLRAIEGICERFPDALIAYEHLDLASLSSVADFAKRFAAGNEQLDLLVNNAGVMALPKRQQTEDGFEMQLGTNYLGHYALTARLLPQLRRAKASRIVNLSSLAHRSGAINFDDLQGKRSYRPWRAYCQSKLAMLMFALELQRRSLAAGWGVTSVAAHPGYARTDLIANGPGANTLQWRVGRWLQPFISQSAAEGALPTLFAATSPAAEPGGYYGPNRFYELKGPPAPAKITPQARDFAAAAMLWDVSATLTGVSFDDIAVAA

SEQ ID NO: 11713 - protein, 449 aa, Mycobacterium smegmatis
MSELHPKLQAVFEEVSHRNGGEKEFHQAVFEVLQSLGPVVEKHPEYADNAIIRRLCEPERQIIFRVPWVDDTGHVQINRGFRVEFNSALGPYKGGLRFHPSVYLGIVKFLGFEQIFKNALTGLPIGGGKGGSDFDPKGRSDAEIMRFCQSFMTELYRHIGEYTDVPAGDIGVGTREIGYLFGQYKRITNRYESGVLTGKGLTWGGSRVRTEATGYGTVFFVDEILQSRGQSFDGKRVVVSGSGNVAIYAIEKVHALGGIVVACSDSGGYVVDEKGIDLDLLKEVKEVQRARIDAYAEARGGATQFVSGGSVWNVACDIALPCATQNEVSGDDARALIESGCRIVAEGANMPCTPEAVKLFDQAGVTFAPGKAVNAGGVATSALEMQQNASRDSWTFDDTEGRLAGIMRRIHDRCLTTADEYDQPGNYVAGANIAGFTQVADAMLALGLI

SEQ ID NO: 11714 - protein, 625 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 11715 - protein, 381 aa, Euphorbia characias
MQIFVKTLTGKTITLEVESSDTIDNVKAKFQDKEGIPPDQQRLIFAGKHLEDGRTLADYNIQKESTLHLVLRLRGGMQIFVKTLTGKTITLEVESSDTIDNVKAKIQDKEGIPPDQQRLIFAGKHLEDGRTLADYNIQKESTLHLVLRLRGGMQIFVKTLTGKTITLEVESSDTIDNVKAKIQDKEGIPPDQQRLIFAGKQLDHGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPSQQRLIFAGKQLEDGRTLADYNIQKESTLHLVLRLRGGN

SEQ ID NO: 11716 - protein, 625 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNQQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASANTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 11717 - protein, 476 aa, Unknown
  Magnetococcus sp. MC-1
MVQHSPTVIVWFRRDLRLSDNPALLAATAMGQVLPVYIHENNQQEGGGGAWRWGLQQALAALNADLQGKLCCYVGDPARLLPEVAHAVGATGVYWNRLYTPQAIKRDRAIKQSLIERGLQVRSFNGSLLWEPWQVLKADKTPYKVFTPYYRRGCLVQDVPRQPMDAPPTVTWATLPAAAPAPSMQALDALLLGDVSWHKKWHGIWSMGEEAAQTRFEHFLSHGLACYDQGRDFPGRDCTSRLSTALQYGLLSPNQVWYGLEHAKADEHSVDKFRSELAWREFAYYQLFHFPSLPHKNFQPKFDHFPWLEDEVALGRWQTGQTGIPIVDAGMRELWQTGVMHNRVRMLVGSFLVKNLLLDWRAGAAWFKDCLVDYDLAINSASWQWVAGCGADAAPYFRIFNPVTQGEKFDRNGTYTRRFVPELANLPDQYLFKPWMAPASILRQAGVRLGQDYPEPLVDLAASRAQALAAFQALKI

SEQ ID NO: 11718 - protein, 82 aa, Arabidopsis thaliana
  misc_feature (2)..(3): Xaa can be any naturally occurring amino acid
  misc_feature (8)..(10): Xaa can be any naturally occurring amino acid
  misc_feature (14)..(14): Xaa can be any naturally occurring amino acid
  misc_feature (20)..(20): Xaa can be any naturally occurring amino acid
  misc_feature (22)..(22): Xaa can be any naturally occurring amino acid
  misc_feature (33)..(34): Xaa can be any naturally occurring amino acid
  misc_feature (39)..(39): Xaa can be any naturally occurring amino acid
  misc_feature (43)..(43): Xaa can be any naturally occurring amino acid
  misc_feature (45)..(45): Xaa can be any naturally occurring amino acid
  misc_feature (53)..(53): Xaa can be any naturally occurring amino acid
  misc_feature (60)..(60): Xaa can be any naturally occurring amino acid
  misc_feature (62)..(62): Xaa can be any naturally occurring amino acid
  misc_feature (66)..(66): Xaa can be any naturally occurring amino acid
  misc_feature (69)..(69): Xaa can be any naturally occurring amino acid
  misc_feature (71)..(74): Xaa can be any naturally occurring amino acid
  misc_feature (76)..(77): Xaa can be any naturally occurring amino acid
  misc_feature (80)..(80): Xaa can be any naturally occurring amino acid
SXXLSSAXXXASPXQATMVXPXNGLKSSAAFPXXRKANXDITXIXSNGGRVNXMHVWPPXGXKKFXTLXYXXXXTXXELXKE

SEQ ID NO: 11719 - protein, 264 aa, Deinococcus radiodurans
MSYISMKQLLEAGVHFGHETKRWNPKFKKFIFAERNGIFIIDLQKTLKQVDRSFDYIKDLAERGGVILFVGTKKQAQEIVELEARRTGMPYVTSRWLGGMLTNFKTMRTRIDRLNELDDLFESERINDRPKAERIQLASERERLLRFVGGIRKMNRLPDAIFVVDPTKEVIAVQEANKLGIPVIALADTDSDPDVIDYIVPGNDDAIRSIQLITHRVGDLLVEARGGHEDVSAGPVEEQSDEAQAAEQGTEGDTAQLTSSQGRS

SEQ ID NO: 11720 - protein, 456 aa, Triticum aestivum
MHTAYLKLLHSLCAAASPLLSPPLTLRGYSTRRRGGSGGGISSGRMNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNAQTMAWILDEYSKFHGYSPAVVTGKPVDLGGSLGRDAATGRGVLFATEALLAEHGKGIAGQRFVIQGFGNVGSWAAQLITEAGGKVIAISDVTGAVKNSNGIDIAKLMKHSAENRGIKGFDGGDAVDPTSLLTEECDVLIPAALGGVINKDNADAIKAKYIIEAANHPTDPEADEILAKKGVLILPDILANSGGVTVSYFEWVQNIQGFMWDEEKVNRELKTYMTRAFRDTKEMCRSHHCDLRMGAFTLGVNRVARATVLRGWEA

SEQ ID NO: 11721 - protein, 625 aa, Cornus cf.
MASSGEQNQVGLLENLKNRLAIAVRSIQWSYAIFWSISSRQPGVLEWGDGYYNGDIKTRKTVQAVEFNADQLGLQRSEQLKELYESLAVTESNQQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIVMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 11722 - protein, 583 aa, Unknown
  delta proteobacterium MLMS-1
MCTIVVTYNEAQPEVLRAMAKAVHHRGPDSLEICCHGNHGVAACRLTILGDPKAPMIYHDPHSGRIILLNGEIYNYSELWQELNKVGIVAGTDLEAELISRLYSVHGPQFAQRLKGMFAIAILDEANLVLIRDRFGIKPLYFTRHGQRILVSSEIKGILAHPGITPILNHSSFQETRVFGYVSSPEQTFFENIQQVQPGQVLVFNAAGREHATTFGAIPKAHFVNGQPEPDYEESVVITRETILKAVERMFGHGEMDKGVFLSGGIDSSTIALVASLHSGRKLQTFTLADSNETPDLLAARQVAEALKTDHHEYIVTSDDYWRWLPDYVAHYEGLMAGGVFHIQGGLAFHILAQYISKHVKVAFSGEGADELFGGYYWIHTHPLGFSDRIRKNLTAVKGNAALTATVNTLFPPPEDATVYQKNLFDFLLKGGLSNYHLQSVDRSAGAFGMEIRPFYLDDDLSQWAASLPIEYKVPNKQTTKRILRDAFRQDFQKLGLETVLTRQKMGMPSALANLDKEINEKVERAVTAEDLAGHPYGAILGSKMNLLLFDLFEHIFFKGWNHHSALPPSDSYLARVWPTYST

SEQ ID NO: 11723 - protein, 592 aa, Deinococcus radiodurans
MEQTGKQGQNRGEMTGAKALWATLAGHGITTVFGYPGGAIMPVYDALTFYPEVRHILARHEQGAIHAAEGWAKATGEIGVCMATSGPGATNLVTGLADAMLDSVPLLAITGNVAQHLMGTDAFQEADITGITMPITKHNYVVRDVDELPRVIAEAIRIARSGRPGPVLVDIPKDVQLAAFAGDIPTPHTRPQAPEASAESIASARELLRNAKKPVLVMGGGSLDASAELTALAHAWGLPVITTLMGLGAYPASDPLWLGMPGMHGSVAANRAISECDVLLAVGMRFDDRVTGRVSGFAPHAQIIHVELDAAEIGKIVRTHLPIRSDAKTAARQLAEGAEKLELGEWLSQIEEWKGRAVPPQQWGAAYAVGQVTARLRPDDILSSDVGQHQMLAAQLARFEKPRRWLNSGGLGTMGFGFPAAIGAALAEPGVVSMVVAGDGGFQMTAQELATLKMYDIRNVKICIINNSYLGMVRQWQELFHGKRYSEVWLGDSNPDFVKLAGAYDVPAYRASSAEELPAAIDAWLSDPKSSLLEVVVPHEHGVFPMVPAGAALHEMMETEPVRTDISAEATEVNEATWQEMTEQEAEEMNQG

SEQ ID NO: 11724 - protein, 531 aa, Unknown
  Shewanella sp. MR-7
MSADQQTVTPLENFSPKVAQRAVHRVQPELNFWQIFNMCFGFLGIQFGFALQNANVSRIFQTLGASIDDIPILWIAAPLTGLLVQPIIGYLSDNTWGRLGRRRPYFLIGAICTTLAIFVMPHSPTLWIAAGMLWIMDASINIAMEPFRAFVGDNLPPKQRTQGYAMQSFFIGIGAVVASALPYILSNFFAVANTAPAGEIADSVRYAFYFGGAVLFLSVAWTVVSTKEYSPDELAAFHGNADAGIDEQQNRTRTHKNYQFAAIVWMAVGALLTLAVWTQDLDKQLYILTLGIFAFGPLQLYCALRLGKSTPSQRAQLGIVFNVVDDLFHMPKAMHQLAIVQFFSWFALFAMWIYTTSAVTSYHFGSSDVLSKAYNDGADWVGVLFASYNGFSAIAALFIPLLAKRIGIKLTHTFNMLCGGFGLISFYFIKDPSLLWLPMIGVGIAWASILSVPYAMLSGALPPKKMGVYMGIFNFFIVIPQLLAASVLGLILNGLFDGQPIYALITGGVLMLCAGIAVLFVEQPNTQHTQA

SEQ ID NO: 11725 - protein, 462 aa, Unknown
  Shewanella sp. MR-7
MGKLSIKKWLIFSAMLVAVLLAMFPLKQHPALFSYSASVVLITLLFWSTGFIPPFMAGLIFFALATIFKLIDPSALFSGFGSAAVWLIISGFVIGSAISESGLSRRLAALIAPALTMSYPRMIAGLVISAMLLGFVMPSSVGRAVVMLPIGMALAEQLGFSRGSNGRIGIATALALACNMPSLAVLPANIPNMILAGASENLFNVHFGYAEYLFLHFPILGLLKSALIVALVVYLFPAKIDKTQITAAADIEAYDVVKQVKLGVLLIITLLFWITDSWHGINPAWVGLTTAIILLLPKWGIIEPKRFNQSVDFSTVIFVAAALGLGVLVNQSGLGSELGQVFSKYLPLSQGASFLNFMSLSLISTLTGLVATVPGVPTVLTPMAADLANATGFSLPAVLMTQVIGFSTVIFPYQAPPLILAMQLSQESLAHLLKVTLPLALITLLVLMPLDYFWWQLLGWIS

SEQ ID NO: 11726 - protein, 178 aa, Glycine tomentella
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYRENHRSPGYYDGRYWTMWKLPVFGCTDASQVLKELQEAKTAYPNGFIRIIGFDNVRQVQCISFIAYKPPSF

SEQ ID NO: 11727 - protein, 178 aa, Glycine tabacina
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYREHHRSPGYYDGRYWTMWKLPMFGCTDASQVLKELQEAKTAYPNAFIRIIGFDNVRQVQCISFIAYKPPSF

SEQ ID NO: 11728 - protein, 122 aa, Arabidopsis thaliana
  misc_feature (22)..(22): Xaa can be any naturally occurring amino acid
  misc_feature (41)..(41): Xaa can be any naturally occurring amino acid
  misc_feature (77)..(77): Xaa can be any naturally occurring amino acid
  misc_feature (101)..(101): Xaa can be any naturally occurring amino acid
  misc_feature (109)..(109): Xaa can be any naturally occurring amino acid
  misc_feature (115)..(115): Xaa can be any naturally occurring amino acid
MAFLYALLRYLWLASSAKATMXVPFNGFKLHPLPFPATRKXANNDITSIKSKGGRVKCMEVWPPIGKKKCENLSYLXDLTDSELAKEVDYLIEKSGFCVEXELENGFVXREQGNXPGYYDGR

SEQ ID NO: 11729 - protein, 182 aa, Betula pendula
MACSMISSATVAAVSRASPAQSSMVAPFTCLKSTSAFPVTQKTNNDITSIASNGGRVQCMQVWPPLGLKKFETLSYLPPLSSEQLAKEVDYLLRKNLIPCLEFELEHGFVYREHNRSPGYYDGRYWTMWKLPMFGCNDSSQVLKELEECKKAYPSAFIRIIGFDNKRQVQIISFIAYKPPGV

SEQ ID NO: 11730 - protein, 161 aa, Unknown
  Shewanella sp. MR-7
MTSTIYSHSANDIQGNPTALAQYQGKVILIVNTASECGFTPQYKGLEALYQKYKAQGLVVLGFPCNQFGAQEKADEKGIQSFCELNFGVSFPLFSKIEVNGEHTHPLYQYLKKAAPGVLGTERIKWNFTKFLINRQGEVVARFAPTTKPEAISDKIEALLK

SEQ ID NO: 11731 - protein, 550 aa, Unknown
  Chrysanthemum x morifolium
MVFDSGLLLGKLGSTSLGTSEYSSIVSMNLFVALLCACIVIGHLLEENRWMNESITALVIGICTGVIILLISGGTNSHILVFSEDLFFIYLLPPIIFNAGFQVKKKHFFRNFMTIMLFGAVGTMISFTIISIGAINIFSRMNIGSLELGDYLAIGAIFSATDSVCTLQVLNQDQTPLLYSLVFGEGVVNDATSVVIFNAVQNFDLSQFNTTVVFQLIGNFFYLFLTSTLLGAGAGLLSAYVIKKLYFGRHSTDREVAIMILMAYLSYMLAELFYLSGILTVFFCGIVMSHYTWHNVTEKSRVTTKHAFATLSFIAELFIFLYVGMDALDIEKWRYVKDSPGTSVEVSAILLGMVLVGRAAFVFPLSFLSNLTKKGHQEKIDFRQQVLIWWAGLMRGAVSMALAYNQFTKEGHTTLQGNAYMITSTITVVLFSTMVFGLITQPLVRLLLPAPKGLNRMISSEPTTPKSFLVPFLGNGQDSEADLGHHIARPTSLRMLLSTPSHTVHHYWRKFDNAFMRPVFGGRGFVPFVPGSPTEQSTHHLVDEEDEERN

SEQ ID NO: 11732 - protein, 742 aa, Coccidioides immitis
MARDPMLSPSSTPTSSALDSDATAIDATVPVLTPATSISEQSTPVDTEKDGEHRAKKAKASRRVTRSSLKNGELEANGGGEAMVTRPNDESLDNTNTQEDEDCTSLLNGAEDASGSVDKWSSKNAEAAGKKPNKKAGNKSPKRRSTRLSLLAKTMDLAQSAPSVLGKRTLDAISKSKDKVKTIDRKASLRPRVENEKKEASTPAPQEPSPKKRRVSGDNKSTCQVPRQEQTATRENSLIRQKRKPWLKHGLYAGQEYIDSSVPKSKRGTRDAKNNGQQSQVFPFPMYAGARLLENGRAYKLPFDIFSPLPHGQPKPNEWRKANKNVFVGDAASIWKAAKIKEHSTCTCTPETGCDENCQNRYMFYECDDTNCKLGSELCRNRPFSALRRRAKAGGKFNIGVEVIKTEDRGYGVRSNRSFDPNQIIVEYTGEILTQEECERRMRTVYKKNECYYLMYFDQNMVIDATRGSIARFINHSCEPNCRMEKWTVAGKPRMALFAGEDGIMTGEELTYDYNFDPYSQKNVQECRCGAPTCRGVLGPRPKESWKNKDKEKKSAPAAKRKVDSALDESASRLNKKPKPSRASSLKTGIKKAVSKARTALKSTQTKGKVKRVGRPAKKAVSIKPIPVKKRRSTLTRAKMPVKSASKSAEGDEKPPRNKGRKLKMPSKPRLGNSIAAARASNKTPALMRKFLEAGDTKGGAKVVSDTIKPGRKTRAARTADVRSSPDNVPVSRKRGRAKKTS

SEQ ID NO: 11733 - protein, 932 aa, Oryza sativa
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSLRKLRHLHLGGNIFSGGIPPEYGHGGSFKYLALRQTSLSGYPPGGLGNLTSLREFYIGYFNSYSGGIPPELGNMTDLVRLDAANCGLSGEIPPELGNLANLDTLFLRVNGLAGGIPRELGKLASLQPKVDLSKKGLAGEDPAKVRRLQRTFTLLNLFRNKLQGDIPEAFVGDLPSLEVLQLWENNFTGGMPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSLPTGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGAPGTDHGGRSHGGLSNSFKLLIVLGLLALSIAFAAMAILKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCSPPILHRDVKPNNILLDSDFEAHVADFGLAKFLQDSGTSERMSAIAGSYGYIAPEYAYTLKVDETSDVYSLGAVLLEPDHRKEAGRGVWGWRRHRSVGQDDDGLEQGTCDQDLGP

SEQ ID NO: 11734 - protein, 173 aa, Flaveria pringlei
  misc_feature (63)..(63): Xaa can be any naturally occurring amino acid
  misc_feature (172)..(172): Xaa can be any naturally occurring amino acid
MASIPATVAAVAQANMVAPFTGLKANAAFPVTKKVNDFSTLPSNGGRVQCMKVWPPLGKKKYXTLSYLPNLTEAQLAKEVDYLLRNKWVPCLEFELEHGFVYRENARSPGYYDGRYWTMWKLPMFGCTDSVQVMKELQECKKEYPQAWIRIIGFDNVRQVQCISFIASKPDXF

SEQ ID NO: 11735 - protein, 173 aa, Flaveria pringlei
MASIPATVATVAQANMVAPFTGLKSNAAFPVTKKVNDFSTLASNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 11736 - protein, 278 aa, Glycine max
KERTAELVRKSMASSLGFEFLTKKPYSPPSWASHLHPLPSHFFSLAHLPTPIHRWNLPNLPTNTELWIKRDDLSGMQLSGNKVRKLEFLMADAIAQGADSIITIGGIQSNHCRATAVAAKYLNLDCFLILRTSDLLVDQDPGLTGNLLVERMVGAHVHLISKQEYAKIGSVTLTNVLKEKLIKEGRRPYVIPVGGSNSLGTWGYIEAVREIEQQIQKGTGNVKFDDIVVACGRYMHSLFVMTQITSTTLLKACLMDSRLALAQEILSTFKTPRVLAMQ

SEQ ID NO: 11737 - protein, 169 aa, Arabidopsis thaliana
  misc_feature (130)..(130): Xaa can be any naturally occurring amino acid
GGPGPEFRGGPHPSGRPRASFMLFSVPMVAFPVKAIMVVLLNGLKSSVAFQATRRVNTAITSITGNGGGVNCLQGGPPMGKKKLGTFFYLPDLTDSEWVKEVDYLIRTRGIPGVEFKWEPGFGSRGPGTXPGSFDGRSWPMGKLPLFGGTDSVQGLKEGERCKRESPNA

SEQ ID NO: 11738 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTMKDEALVKQIEYLLRSKWIPCLEFCPKGFVWRENHRSPGYYDGRYWTMWKLPMFGCTDAVQVAKEVEECKKEYPHAFIRIIGFDNNRQVQCISFIAYKPTGY

SEQ ID NO: 11739 - protein, 354 aa, Burkholderia thailandensis
MSRVRLLSELVPGLDTLVRPLDLLERPTPVTEEPELARRWGQAGLWVKRDDLANPLYGGSKVRTLEFFLGRARAVGADGVVTMGPYGSHQLLATAVFGRLTGFRTRGVATPQPDVPEIELNRRLLPAYGMEVMRCGSFAAVPATLLRARLKRLGSARPFWIPPGANHPLGVMGVVEGALEVAQAIRAGSLPLPDDVVVPTGTCATAAGVYLGFALAGLHVRVVAVRMVPMIVTGPAKLLRMVRQTEWLLRRYGLTATARWGALLWTNDHAGPSYGRGGLVAERARADVEQFGAFRTETTYTAKTLALLAGGGLRQRRVLFWNTYSAIDPDPMRDAADACAPADGAPFPRCATEP

SEQ ID NO: 11740 - protein, 178 aa, Zantedeschia aethiopica
MASSMMVSTAAVSRTSPAQSNMVVPFAGLHSSAAFPVTRKFADSSKLPSNGLRVRCMQVWPPEGKKKFETLSYLPPLTREQLGQEVDYLIRNGWIPCIEFCKVGFVYREYHNSPGYYDGRYWTMWKLPMFGCTDSSQVLKEVDECSKAYPDYFNRIIGFDNTRQVQCISFLTYKPEGN

SEQ ID NO: 11741 - protein, 394 aa, Bacteroides fragilis
MAEKRDYYEVLEVTKESTVEEIKKAYRKKAIQYHPDKNPGDKEAEEKFKEAAEAYDVLSNPDKRARYDQFGHAGMSGAAGNGGPFGGFSGGMSMDDIFSMFGDIFGGHSGGGFGGGFGGFGGFGGGGSQQRKFRGSDLRVKVKLNLKEISTGVEKKFKLKKYIPCSHCHGTGAEGNSGSETCPTCKGSGSVIRNQQTILGTMQTRTTCPTCNGEGKIIKDKCKVCGGEGIEYGEEVVTVKIPAGVAEGMQLSMGGKGNAGKHNGIPGDLLILVEEEPHPELIRDENDLVYNLLLSFPTAAIGGAVEIPTIDGKVKVKIEAGTQPGKVLRLRGKGLPSVNGYGTGDLLVNVSVYVPETLSKEEKSTLEKLEESKNFKPSTSIKEKIFKKFRSLFD

SEQ ID NO: 11742 - protein, 401 aa, Chlorobium tepidum
MKKIGILTSGGDCGGLNAVIKGAALMALNKGLELYVIPNGYAGLYNLLNQDRLVRLDEARLDQFQASFAGSEAGHSRVKIKAISNPDKYNRIKVGMKKFDLDALIISGGDDSGSVMIDLNHNGIQCIHCPKTMDLDLQTYSVGGDSTINRIAQFVEDLKTTGRTHNRVLVTEVFGRYAGHTAFRSGVAAEADCILIPEIPVDWDVVYEHIVERFTRRIRQSDVHSGTYTIVVAEGMKNADGTDIVDESAGIDAFGHKKLAGAGKYVCQEIKKRFKTDPRMPQFMKDTGMFVEGIYEIPEVREVHPGHLVRAGHSSAYDINFGFEAGAAAVLLLLEGKTGVTISKVKGRKIEYIEASKAIEQRYVDLDQVAMYESIGTCFGRTPAAYEPILREVDGVYERIY

SEQ ID NO: 11743 - protein, 315 aa, Magnetospirillum magnetotacticum
MIAAVSSDLAMAMPDVKIVYGGVFPTYHWRDILEAEPHVTAIVRGEGEETTRRLMSALEAGRPLDAIPGIAFRDGSVIRETPPAALIRDLDAYRVGWELIDHTRYSYWGGLRAVVVQFSRGCPHPCTYCGQRGFWTRWRHRDPIRFAAELARLHREHGVRAINFADENPTVSKKVWRTFLEALIAENVDLILVGSTRADDIVRDADILPLYRQAGWVRFLLGLESTDAATLDLIRKGTTTTTDREAIRLMRENGILSMATWVVGFEEERDRDYWRGLRQLLAYDPDQIQMLYVKPHRWTPYFRLTEERRVIQARP

SEQ ID NO: 11744 - protein, 248 aa, Picea mariana
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEVIKAKILAHPQYPSLLGAYIDCQKIGAPPEVVARLDALTHEYENQQHRTTVSIGMDPELDQFMEAYCEMLTKYHEEL

SEQ ID NO: 11745 - protein, 371 aa, Alkaliphilus metalliredigenes
MKDVMGIVNDIKIKRDLRDLVSHRSTAAVPFGGRYRVVDFVLSNMANGGIKNVGIFTQSNNRSLLDHVDSGKAWDLFNKRGGLFILPPTFSYERFGNRLGDIDHFYNHMDYLERSTQQYVLISNSNSIYNMDYSKIKEAYEKSGADIVILYQRKKEWDSSIKYVSMIMDEKSKIVDMSVNKLIGNNSFKDMGVAFMKKELFMEIIRECHSKGLNDFVKDGLIKNTKKYNMYGMPYDGYVANIDSINNYYKHNMNLLKPEIWKQLFFKEGLINTKVKDEAPSKYNKTAKVSNSLVANGCIIEGEVINSILFRGVKVGKNVTVKNSILMQKNVIHEGCQLEHVILDKDVVVTEGKVLKGDEGYPFVVSKKTVL

SEQ ID NO: 11746 - protein, 371 aa, Alkaliphilus metalliredigenes
MKKECIAMILAGGQGTRLGMLTKNIAKPALPFGGKYRIIDFTLSNCSNSGIDTVGVLTQYEPLVLNSYIGIGSHWDLDKKSGGVMVLPPYVKENGGNWYRGTADAVYQNLDFVEHYEPEYLLVLSGDHIYKMDYSAMLKHHKEKQADATIAVIRVPSEETYRFGIMNTDEEERIIEFQEKPENAKSDLASMGVYIFNWKKLKKHLIEEDQNPDSSLDFGKNIIPKMLNEGEKLFAYGFQGYWKDVGTVESYWEANMDLIEDDASLDLHERNWIIYSVNPSQPPQYIGPSAKVTESLLNEGCQIFGEVSHSVIFPGVYIGKGAVVKDSVIMANAIIGDHAKIEKSIIAEKAIIQKKEIIGDNKKNDITVVAT

SEQ ID NO: 11747 - protein, 543 aa, Bacteroides fragilis
MSMFCFQCQETAKGTGCILSGVCGKTPEVANMQDLLLFVVRGIAVYNQALRKDGRSSARADKFIFDALFTTITNANFDKHAIIKKIKKGLELKKDLSNQVTIEHAPDECTWYGDETEFEEKAQTVGVLRTSDEDIRSLKELVHYGIKGMAAYVEHAYNLGYENPEIFAFMQYALAELTREDITVDELITLTLATGNHGVQAMAQLDTANTSHYGNPEISEVNIGVRNNPGILVSGHDLKDIEELLQQTEGTGIDIYTHSEMLPAHYYPQLKKYKHLVGNYGNAWWKQKEEFESFNGPILFTTNCIVPPRPNATYKDRIYTTGATGLEGATYIPERKDGKQKDFSVIIEHARRCQPPVAIESGKIVGGFAHAQVIALADKVVEAVKSGAIRKFFVMAGCDGRMKSRSYYTEFAEKLPADTVILTAGCAKYRYNKLPLGDINGIPRVLDAGQCNDSYSLAIIAMKLQEVFGLKDINDLPIVYNIAWYEQKAVIVLLALLALGVKKIHLGPTLPAFLSPNVKQVLIDNFGIGGISTADEDIAKFLA

SEQ ID NO: 11748 - protein, 515 aa, Lobelia erinus
MSLIFYTCIIAFLLYVLLSTLRTFLLNRNPASRKPLPPGPKPWPIVGNLPHLGTMPHQTMAALARTYGPLMHLRLGSVDVVVAASGAVAEQFLKVHDANFLNRPPNSGAVHIAYNYQDLVFAPYGPRWRLLRKVSAVHLFSAKALDDFRHVRQEEVAVLTRDLASAGNAPVHLNQLLSVCTTNALSRVMFGKRVFGGGGDSKADEFKQMVVEAMVLAGVFNIGDFIPALEWFDLQGVVGKMKKLHVRFDSFLTAILEEHKTTGSRGGGKHVDLLSTLISLKDNDLAGEGEKLSDTEIKALLLNMFIAGTDTSSSTVEWALAELIRHPKILAQAQQELDEVVGRDRLVSESDLSQLTFFQAIIKETFRLHPSTPLSLPRMAAESCEINGYFIPKGSTVLVNVWAIARDPDIWAEPLEFRPQRFLPGGEKANVDVKGNDFEVIPFGAGRRVCAGLSLGLRMVQLVTATLVHSFDWELADGQKPEELNMEEGYGLTLQRAKPLKVHPRPRLSEHVYQA

SEQ ID NO: 11749 - protein, 112 aa, Bradyrhizobium japonicum
MKLVVAIIKPFKLDEVRQALTAIGVHGMTVTEVKGYGRQKGHTEIYRGAEYVVNFLPKLRIEIAVASDVADKAVAVITATARTGQIGDGKIFVTPIDHALRIRTGETDSDAL

SEQ ID NO: 11750 - protein, 896 aa, Unknown
  Candidatus Kuenenia stuttgartiensis
MTTVIIDGKRVEADPSQTILEAARRVGIRIPTLCHDPRLKPSGACRICVVEVEGKDNLAASCATPVSEGMKVSTRSEAVLRSRRLNLELLWSNHPNDCLTCDKAGECSLQNLMYEYDVKTSRFVKQNPVPALDESNPAIYRDMNKCILCGKCVRICDEVQGQHVWAFSDRGIKTRVSTAFEKSMQDGGCVFCGHCVSVCPVGALMDKPVMKKARSWETRKVRTVCSYCGVGCSLVLHIKNNEILQVTADINSAPNYGSLCVKGRYGFEFYSSKDRLKTPLVRDNINEPFREASWEEAIGLVAKRFSEIKKKYGPDSFGCLSSSRGTNEENFLAQKFTRVVMGTNNMDNCARVCHAPSVTGLRAALGSGAATNSLADIEGAEVLIVSGSNTTEAHPVAALKIKKAVRQNGAKLIVIDPRKIELVKYADIHLQLRAGTNVALINGLLHVIIKEGLQNDDFIERRTENFEMLKQVVSKYTPEETEAITGVPKEDIIKAARMYAGTNKGMIIYGLGMTEHKAGSHGVMSLANLALITGNVGRPNTGINPLRGQNNVQGSCDMGALPDVYACYQRVDDPEANRKHAEAWKVKKLPEKPGLKEPQMYRAIESGDLKAMYIIGYDPAISQADINKVRASISKLEFLVVQELFMTETAKLAHVVLPTSCYFEKDGTFTNAERRVRRLHKAIPLPEGTKSDWDIICSIATAMGYPMSYNHPSEIMDEIAKLTPDMAGINYKRLEGDGLVWPVWDMNHPGTPILHKDTFKRGRGMFNDLMYTPSEELPDEEYPLLLTTGRRLYQYNNGSMSLRNPEICAINSEEFMEIHPADAAKLDIKSGEKVKVSSRRGSLEVKTELTEKSRLGSVFLSFHYPETPTNVLTGPGEDMLALTPEYKVCAVKVEKM

SEQ ID NO: 11751 - protein, 598 aa, Pantoea dispersa
MFLNGFKTVIALTMASSFYLAASPLTKPSTPIAATNIQKSADFPIWWKQAVFYQIYPRSFKDSNGDGIGDIPGIIEKLDYLKMLGVDAIWINPHYESPNTDNGYDISDYRKIMKEYGSMADFDRLVAEMNKRGMRLMIDIVINHTSDRHRWFVQSRSGKDNPYRDYYFWRDGKQGQAPNNYPSFFGGSAWQLDKQTDQYYLHYFAPQQPDLNWDNPKVRAELYDILRFWLDKGVSGLRFDTVATFSKIPGFPDLSKAQLKNFAEAYTEGPNIHKYIHEMNRQVLSKYNVATAGEIFGVPVSAMPDYFDRRREELNIAFTFDLIRLDRYPDQRWRRKPWTLSQFRQVISQTDRAAGEFGWNAFFLDNHDNPRQVSHFGDDSPQWRERSAKALATLLLTQRATPFIFQGAELGMTNYPFKNIEEFDDIEVKGFWNDYVASGKVNAAEFLQEVRMTSRDNSRTPMQWNDSVNAGFTQGKPWFHLNPNYKQINAAREVNKPDSVFSYYRQLINLRHQIPALTSGEYRDLDPQNNQVYAYTRILDNEKYLVVVNFKPEQLHYALPDNLTIASSLLENVHQPSLQENASTLTLAPWQAGIYKLN

SEQ ID NO: 11752 - protein, 513 aa, Unknown
  Erythrobacter sp. NAP1
MTDQSRIADAWERLSALPTETLAGLFDADEDRVARLSQRLEFDLGELGEVGILLDWSKTHLNDAALDAFEELAKASQFGAARDALFDGGIVNPTEGRPATHGAMRGSGRESDVEEAEALLARMGMLVEAIHQGTLGEIKHLIHIGIGGSALGPDLAVDALTRDLKLVDVHVVSNIDGLALEQAFAACDPATTLIAVASKTFTTTETMTNASSALKWLADNGVSDPSGRVVALTANPEKAVQWGVDETRILPFPESVGGRYSLWSSIGFPVALAVGMDDFSAMLAGAQAMDAHFRESEGRANGPLLAAFGDLYYTRVRGCQTRAVFAYDERLALFPDYLQQLEMESNGKSVTADGKPVNGPTAPITWGGVGTDAQHAVFQLLHQGTHLVPVDFIASIAPGDELDPAHHSSLLMNCLAQGAALMAGKTSDDPARNYPGDRPSAMFLVDDLDAATLGALIAFHEHRTFANAVLMGINPFDQFGVELGKAMAKAIDSGEGEFDASTKALMQAAGLGG

SEQ ID NO: 11753 - protein, 651 aa, Vibrio fischeri
MNTHQAFPFPLGATLTNTGCNFAVHHDSAFPLSLIIFKEDGSYTEHSFTEEYGTIKYTHLTGIKEGAVYGFKIIKNEEDLLLLDPYAKALKNIPNYQVPYTAKQSWSLAQAIVVNDNFDWQSTTMPIIPRSETILLETHVKGFTLLNPNIDENVRGTYLGLVDPATIAHIKEQGITSIQLLPIAACMHEPHLLEMGMVNYWGYNSLSFMAPDPRYAISDAVTELKTAIRELHKNNIEVILDVVYNHTAEGGNGGCTFNLKGLDQDYYLHHNGNYTNYTGCGNTLDITHQPSLNLVMDTLRYWVEHYHIDGFRFDLAATLGREYDQFNPNNAFFKAIAQDPILKNTKLIAEPWDIGPNGYQVGEFPDGWNECSDKYRDTTKSFWRGEQNYLKSIATRLMGSRDLVSASRWPHKLPVNYVSYHDGFTLQDLVSYKNRHNHANGENNRDGHGDNRSDNYGVEGPTDNPRIIALREKQKRNMMTTLLFSFGIPHLLAADACSHTQQGNNNAYCQDSEISWVNWNLDPTAQEFKIWLSDMIHARQKHIVPIINAFSGSKRSHQKVEWYTPDGRTMTHNDWHGAKSLCLHLNIYDGEKELLIMINQSNIPTRFVLPKLTKQANWSLVCDTQYSKVKPKPIVFDYSLSPLSIAVFCNK

SEQ ID NO: 11754 - protein, 332 aa, Triticum aestivum
MGAGNGLSNGAAAAAEAAPDGTTVFRATAYSPLRTTLALALWLGAIHFNILLVLASLFLLPRRVAAMVLGTQLFFMLVPLNDKSRIGRKIARFISKYVVGYFPVTLHVEDYKAFDPKRAYVFGYEPHSVLPIGLGALVDLVGFMPLPKTKVLASTAVFYTPFLRQIWTWLGLVPASRKNFYSYLRAGYTCIVVPGGVQEMLHMDHDSEVAFLKSRKGFVKIAMETGSPLVPVFCFGQSLVYKWWRPGGKLIVKIARAIKFTPIVFFGKYGTPIPFTTPLHLVVGRPIEVQKNPQPTYDEINEVHEQFVVAMQELFEKYKTKAGYDKLELRVL

SEQ ID NO: 11755 - protein, 435 aa, Saccharum officinarum
MGLSTAYSPAGSGLVPAPLGAGAGAARRLSAQVRRPRLATVRCSVDAAKQVQDGVATAVAAEAPASRKECFGVFCNIYDLKAEDKTKSWKKLVNIAVSGAAGMISNHLLFKLASGEVFGQDQPIALKLLGSERSFQALEGVAIELEDSLYPLLREVSIGIDPYEVFQDVDWALLIGAKPRGPGMERAALLDINGQIFADQGKALNAVASRNVKVLIVGNPCNTNALICLKNAPNIPAKNFHALTRLDENRAKCQLALKAGVFYDKVSNVTIWGNHSTTQVPDFLNAKIDGRPVKEVIQDTKWLEEEFTMTVQKRGGALIQKWGRSSAASTAVSIVDAIKSLVTHTPEGDWFSTGVYTTGNPYGIAEDIVFSMPCRSKGDGDYELATDVSMDDFLWERIKKSETELLAEKKCDAHLTGEGDAFCDLPEDTMLPGEK

SEQ ID NO: 11756 - protein, 777 aa, Flavobacterium sp.
MDPHAPQRQRSGQRLRALALAALACALSPAHAAIDAQQLGARYDAAQANLAFRVYSSRATRVEVFLYKNPTGSQEVARLALSKDPATQVWSLSLPTSTIKNTYGITGAVYYGYRAWGPNWPYDAAWTKGSATGFVSDVDNAGNRFNPNKLLLDPYAREISQDPNTATCADGTIYATGAAHRNKDSGLCASKGIALAADATSVGSKPTRALKDEVIYEVHVRGLTRNDDSVPAAERGTYKGAARKAAALAALGVTAVEFLPVQETQNDQNDVDPNSTAGDNYWGYMTLNYFAPDRRYAYDKSAGGPTREWKAMVKAFHDAGIKVYIDVVYNHTGEGGPWSGTDGLSVYNLLSFRGLDNPAYYSLSSDYKYPWDNTGVGGNYNTRHPIAQNLIVDSLAYWRDALGVDGFRFDLASVLGNSCQHGCFNFDKNDSGNALNRIVAELPPRPAAGGAGADLIAEPWAIGGNSYQVGGFPAGWAEWNGLYRDALRKKQNKLGVETVTPGTLATRFAGSNDLYGDDGRKPWHSINFVVAHDGFTLNDLYAYNDKQNNQPWPYGPSDGGEDHNLSWNQGGIVAEQRKAARTGLALLMLSAGVPMITGGDEALRTQFGNNNTYNLDSAANWLYWSRSALEADHETYTKRLIAFRKAHPALRPANFYSASDTNGNVMEQLRWFKPDGAQADSAYFNGADNHALAWRIDGSEFGDSASAIYVAYNGWSGAVDFKLPWPGTGKQWYRVTDTATWNEGPNAVALPGSETLIGGENTVYGMQARSLLLLIAK

SEQ ID NO: 11757 - protein, 574 aa, Unknown
  delta proteobacterium MLMS-1
ELNEQKIVIIGGVAAGPKTASRVKRLLPEADVTIIDQDNLISYGGCGIPYYIGGDVSDEKELRNTSFHLTRNEDFFLKAKGVTVRTKTRALAIDRPNKKVQVQALDGGAREEIPYDQLVIATGSQPNRLPLPGVELDGVFTISDLHQAIEIKERIARGKVSRAVIIGGGAIGIEMAEAFVDLWGLEADLLEFMPQLLPRLVDWEFARMLENHLRQQGVNIYTNEAARAIEGEAGTVSRVVTPQRTLAADLVIMAVGVRARGELAAEAGLPVDGQGNILVNDRLQTADPNIYAAGDCIAVKNRLTGKSGIAPMGSLANREGRIVADNLAGIPSRYQGWVGSFTLKAFERCIAATGLSLESARAEGFDAAAATTAQSDRAHFFPNQTVIPLRLVFDRSNRQLLGVQGFGPMGDAVLARIDAAAALLQQGGTIDDVSQLEMAYAPPFATALDALNATGNVADNLAAGRLRCVETADFLAWMEDFSSQPDWVALDIRHPNEASLLADKFGRDQWLTIPYVDIRERHRELPTDRTMIIICDAGTRSSEIQIFLDSVGLANNLVLGGGFNLIRRMGVAWM

SEQ ID NO: 11758 - protein, 213 aa, Unknown
  Frankia sp. ACN14a
MSKAEFIQAEYIWIDGTEPEPLMRSKTRIIKKGKEPEIWGFDGSSTNQAPGSNSDCVLRPVFVTPDPIRGGDNILVLCEVELTDFTPHPTNTRAATRAVAEKYADMSPMFGIEQEYTFFKDGRPYGWPEVGYPAPQGPYYCGVGGSKMPGREIVERHTQACLDAGLAIEGTNAEVMMGQWEFQIGVLPAPAIGDQIWLGRWLLHRIAEDYGVE

SEQ ID NO: 11759 - protein, 409 aa, Vetiveria zizanioides
AQQVHRPRRALLATVRCSVDASKQVQDGAATAVAAEAPASRKDCFGVFCTTYDLKAEDKTRSWKKLVNVAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASQNVKVLVVGNPCNTNALICLKNAPNIPAKNFHALTRLDENRAKCQLALKAGVFYDKVSNVTIWGNHSTTQVPDFLNAKIDGKPVKEVIKDTKWLEEEFTMTVQKRGGVLIQKWGRSSAASTAVSIADAIKSLVTPTPEGDWFSTGVYTTGNPYGIAEDIVFSMPCRSKGDGDYELATDVMMDDFLWERIKKSEAELLAEKKCVAHLTGEGNAFCDLPEDTMLPGEV

SEQ ID NO: 11760 - protein, 405 aa, Vibrio fischeri
MAGVLGMILAGGEGSRLRPLTESRTKPAVPFGGSYRLIDFALNNFVNADLMRIYVLTQFKSQSLFQHMKKGWNVNGITDRFIDPVPAQMRTGKRWYEGTADAIYQNISFIESTDPEHVCIFGSDHIYKMDIRQMLDFHKKKKAALTVSALRMPAKDASGFGVIEVDEHGKMIGFEEKPSNPKCIPGQPGIALVSMGNYIFEAESLCKELIHDAALEDSSHDFGKDIIPKMFPEGNVYVYDFSTNHIKGEKKEVYWRDVGTIESYWEAHMDLLKKDAPFSLYNRKWPLHTYYPPLPPATFSDSDNGRVQIIDSLVCGGSYIRGSRIEKSVLGFRSNIASACDISESILLGNVKVGKGCVLRRVIVDKGADIAPGTEIGVNLQEDKKRYHVSDEGIVVIPKGERVGY

SEQ ID NO: 11761 - protein, 336 aa, Coprinopsis cinerea
MDGAEFENRWKNSKLGQFVHFKNPQGRYLKSVPNSIGWYGLKWDPTAPDLDCRFRVRQIPEEPGKFYVLGRASDDYRFCVSLYKSSGSTKYYDCDVSSIPINGVPSSYVWRIVPVGGNDIYLVSDNTYDRPIIFMSNWENQRYKLWDHNDSFPGSTSITVERAALRTDVYDVQYRIDDSKIIELTPTIAIEKVLENRTDADASQSVSYTYTKSEEGNWNNAAGIELGQGFTFKAGVPFITEAEVEVSVTEAYEHQWGGSTIESVEVQTSTSTVVPAHTTVKLTVLIYKSQLDIPFSYTERVTNFDGSVVEVKNKEGVYHNVQFIKDHATSDPIRRI

SEQ ID NO: 11762 - protein, 850 aa, Oryza sativa
MARSSADDMELKRSCEAGILSKEKDRETVVMSMRVAKGRGVWGKAGKLASRHMAKPRVLAVTTKKKGQRTKAFVRVLKYSNGGVLEPAKVYKMKHLSKVEVVPNDPSGCTFLLGFDNLRSQSVSPPQWTMRNKDDRNRFLMCILNMCKEIYGAIPKVVGMDVVEMAMWAKDNTTVKVTQVSTKDGPIESLVGEADSQVAIQKDLVLQTEDEDTEALLDTYIMAIGEAEAFSERMKRELVALESANVYALMETETVIEEVLEGLEIASICVEDFDEWLGIFNVKLRHMREDIQSIEWRNNKLELQSDSNVALIDELDKMLVLLQIPPEYEASLTGGSFDEGNMVKNIEACEWLTSAIKNLEASNLDPIYVKLRAVREKRAEFVLLKCTFVRRASEFLRNYFPSLIDFMLNDKGNFSQRGQLQRPDHADMRYKCRTYARLLQFIKNLDKSCLMPLRKSYCHSLNLLIRREAREFSSELRAGSKASKSSTPLFEGPASANQSISITDTTADAYCKMITVFIPLLVDESSFFAHFMCFDVAALAPSDESDNNNPVAVSEPPGSSAKPINSSAELGVLNQFLQELLDGIQEDFYAIVDWAFKLDPLSCISMHGITDRYLSAQFVDDACYQIEKYERNVRQIGVVPYIPRFSQLAARMEQYINGSRDLVDQAYTKIVTIMFVTLEKIAQVEPKYVDIVLLENYAAFQHSLYDLANVVPTLAKYYHQASEAYEQACSRHINLVIYIHFEKLFQFARKIEELMYNMSPEEIPFQVGMSKVDFRKMLKSSLSGLDKTINAMYRKLQKNITAEELLPSLWDKCKKEFLDKYATFLKLISKIYPSETVISVNEMKDTLASL

SEQ ID NO: 11763 - protein, 448 aa, Clostridium thermocellum
MERIKFDYSKALPFVSEREVAYFENFVRSAHDMLHNKTGAGNDFVGWVDLPVNYDREEFARIKAAAEKIKSDSDALVVIGIGGSYLGARAAIEMLSHSFHNLMPKSKRNAPEIYFVGNNISSTYIADLLEVIEGKEISVNVISKSGTTTEPAIAFRIFKEYMENKYGKDGASKRIYATTDKEKGALRKLATEEGYETFVVPDDIGGRFSVLTAVGLLPIAVAGIDIDSMMKGAADARELYSNPNLMENDCYKYAAVRNALYRKNKTIEIMVNYEPSLHYFTEWWKQLYGESEGKDQKGIFPAGVDFTTDLHSMGQYIQDGLRNIFETVIRVEKPRKNIVIKEEKDNLDGLNFIAGKDVDYVNKKAMEGTVLAHTDGGVPNLVVTVPELSAYYFGNMVYFFEKACGISGYLLGVNPFDQPGVEAYKKNMFALLGKPGYEEQRKKLEERL

SEQ ID NO: 11764 - protein, 349 aa, Pseudomonas aeruginosa
MPAEVAAGLPPLPPNHFYFYPPDPLLEGDGAITAIEDSDPFDQYVYRLRRVLYQGRTRWQNVLIADTYNYDRVLMLDGAIQSAESDESLYHELLVQPAMLAHDEPRDVLIIGGGEGATLREVLSHASVRRAVMVDLDRELVELCREHLFQWHQGAFDDPRCELLAEDGRAYLERDPSLYDVVIIDVVDMLDNGPAQALYTRQFYELLHSRLRPGGVVAVQGLEFSHSDDKPHAALARTLRSVFSQVHSYRATVPSFLSSWGFLLASDWLDANHWQAEDIDRRIERKLGPLWLDHLDGDYLKACFVMDRETRFLLAQPGPVLEDGVPFVAPPDIEEIEFGPAQLPALART

SEQ ID NO: 11765 - protein, 1078 aa, Vibrio angustum
MLINATQKEELRVALVDGQKLFDLDIESPGHESKKANIYKGRITRIEPSLEAAFVDYGAERHGFLPLKEVAKDYFPANYSYQGRPNIKEVLKEGQEVIVQVDKEERGNKGAALTTFISLAGSYLVLMPNNPRAGGISRRIEGEERTQLKAALSTLDLPQGMGLIVRTAGVGKSGEELEWDLNVLLNHWNAVKEAADSQSAPFLIHQESNVIARAIRDYLRRDIGEILIDSPKIFDRARDHIKLVRPDFLSRVKRYEGEVPLFSHYQIESQIDSAFQREVRLPSGGSVVIDPTEALTSIDINSARATKGGDIEETALQTNLEAADEIARQLRLRDLGGLVVIDFIDMTPVRHQREVENRLREAVRMDRARVQIGRISRFGLLEMSRQRLSPSLAEASHHVCPRCSGTGVVRDNESLSLSIPRLIEEEALKDNSSQVLAIVPVPVASYLLNEKRRSVQHIEKYHGVRVVIVPNSDMETPHFEVLRIREGEEQDTLSYHIPKTLEALKEAEAIEAPQPERVIKKREEPVLQGFTAPKQPAPVAKPAAKPTPKVTAKPATESTKKPGLLSRFFSALASFFSGSPEQQQEKPVEAKVEQNNNQNNRRNNNRRNDRSDNRRNNRDNSRDNNRRNNRQDNNDVENNDERQERNNEQRQNRRRNDRNDKNRQQQNDKAAKAPRQNRNNDEAKEQKRQSRKEEIQAQKQQRQQQGEQTAKATTEQPADAQRDSEEKAVKVKQRRQRRQLRKKVRITDNVEKSVEQQNATVDAVEKVEAVETAVEQTPSPLMALGTSIAKEAQDKPEKTQVVSDEQTDNEEQEGTQRRNRRSPRHLRASGQRRRRMRDTRVEKSDFVTNEEANAIEQAAIDAADSISEMVNVVSIVEKPKTMRPTSGVAIPEMAMGKVWSRIKPAVEAPVEKNITQEKADTADMIDEVETNDIIINTPVVEAKSEIVAVETTTLSGVAIPEMAMGKVIPRYTAEETTVEMKSEPAPEQVIEKPVIVEEVAAPVIKTEETVEIKSPVTAVVDLPAVAKAVMATSPRGFHAASAMTKAPAPEEHVSGSVVQAAPLRERSNTRAAGSQMAT

SEQ ID NO: 11766 - protein, 373 aa, Burkholderia vietnamiensis
MRAVPLSDSSTLEQPATEAVVRDLRRVPIHPDHWYPLAWSRELKRGKTLGVRFAGDPIVLVRAESGAVYALEDRCAHRQVPLHAGVVDGETLRCCYHGWTYACDSGRCVDVPYLGRERLPNGVRAYPCRETHGVIFVFPGDATLADERPVPALESADNPAYKTRRFGREVKCHYSFMHENLMDMNHQFLHRKQMGQMRARSVGRRRGDDWVEVDYTFARMEGKQPVGEALVFGSSKKPGDQADKSVMTVRTGYPYQTLQIRSSEGTLVMDLWIVYVPLDAEQRTNRTFGLLSIHKPGIPFALDLAWPLLVWFTERIFREDRWIVEREQEAHDRQGADWNHEVFPVINELRDLLRQCGARTVIPIRDASTSDAR

SEQ ID NO: 11767 - protein, 267 aa, Elymus virginicus
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFLGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPGIVGGRSRRSP

SEQ ID NO: 11768 - protein, 247 aa, Burkholderia vietnamiensis
MIPTSTRISVAPRRAALLRRLAALALAAAAVFGYQRVVRSAEPIHNAPAPTLDETPGASHDETAVLAGGCFWGVQGVFEHVKGVKQVTAGYAGGASETAHYALVGSGLTGHAESVRIVYDPAQVSYGRLLQLFFSVAHDPTELNRQGPDEGPQYRSAIFPTNAQQHAVATAYIAQLGAAHTFAAPVVTRVEPYQGFYPAEDYHQNYLELHPDAPYIAFNDLPKVAALKQRFPALYRADAVLWHDARR

SEQ ID NO: 11769 - protein, 431 aa, Prochlorococcus marinus
MKRVLAIILGGGKGSRLYPLTKMRAKPAVPLAGKYRLIDIPISNCINSNIHKMYVLTQFNSASLNRHISQTYNLSSPFAQGFVEVLAAQQTPESPSWFEGTADAVRKYQWIFQEWDVDEYLILSGDQLYRMDYSQFVNHHRTTGADLTVAALPVDSSQAEAFGLMRTDGEGNIKEFREKPTGDSLKAMAVDTSRFGLTAQSAKERPYLASMGIYVFSRATLFDLLNKHPNYKDFGKEVIPEALNRGDVLKSYVFDDYWEDIGTIGAFFESNLALTQQPKPPFSFYDEKFPIYTRARYLPPSKLVDAQITDSIVGEGSILKACSIHHCVLGVRSRIESDVVLQDTLVMGSDFYESGEERIALRSGGGIPLGVGQGTTVKRAILDKNARIGENVAIVNKDNVEEADRPEEGFYIRNGIVVVVKNATISDGTII

SEQ ID NO: 11770 - protein, 472 aa, Prochlorococcus marinus
MSKAHFGLVGLGVMGENLVLNAERNGFSSVVYNRTYSKTESFLLGRGLGKSISGAKDLKELVNKLERPRRILMMVKAGPATDAVISQISPYLEEGDLLIDGGNALFSDTERRVEELESKSFGYIGMGVSGGAKGALEGPSMMPGGTKSSYESVEQLLTKMAAQVDDGPCVSYIGPGGSGHFVKTVHNGIEYGIEQILAESYDLMKRMCGMTGDQMADVFAYWNSTEELSSYLVEITETCLRTKDSVDGTDLVEKIMDKAGQKGTGLWTVISALELGASVPTIYASLNARVMSSLKSQRVYASTLLKEPLIGSYELGTPSDGMSPIMDAVVLSTIASYAQGMEIMRIASHEYNYDLHMPSIAQIWKGGCIIRSRLLVHIQNAFQKDPQLKNLLLDSWFLNQVDKRIAGLAKVVSYASQAGIPVPCFSSTLDYINSYRTSRLPQNLVQAMRDCFGSHTYERTDKEGFFHTEWLN

SEQ ID NO: 11771 - protein, 171 aa, Candida albicans
MGNELLSTARIYTFKIPDAYNNVIDFDQFKNKVILIVNVASLCGFTPQYKELQLLYEKYHERGLEILGFPCNQFGNQEPLQEEEIVESCRRNFGVSFPIMKKTKVNIDCDGHESELYKYLKSEKPGEVGFKGVRWNFEKFIVNRKGEVVARFNSLITPLQLEGFIEQLLSE

SEQ ID NO: 11772 - protein, 466 aa, Brassica napus
MRNLYFLVLFPLSILILVDASLHVKYLPGLEGPLPFELETGYVSVGESGDVELFYYFVKSESNPDKDPLMIWLTGGPGCSSICGLLFANGPLAFKGDEYNGTLPPLELTSFSWTKVANILYLESPAGSGYSYAKTRRAAETSDTKQIHQIDQFLRSWFVDHPEFISNSFYVGGDSYSGKIVPGVVQQISLGNEKGLTPLINIKGYVLGNPAVRTNLEPNHRVSFAHRMGLISDELHESLERNCGGKFFNVDPSNAKCSNGLLAYHQCISEIYIEQILLPNCKVDYVLADISQTLPNIRTSRRRELKEFSRNDSSSLPPPSCFTYRYFLSAFWANDENVRRALGVKKGFGKWSRCNTQNIPYTYDIHNAIPYHVNNSRKGFRALIYSGDHDMMIPFSSTEAWIKSLNYSIVDDWRPWMMNSNQVAGYTRTYANKMTFATIKGGGHTAEYNPDQCSLMFKRWIDGESL

SEQ ID NO: 11773 - protein, 408 aa, Chlorobium tepidum
MTDNKILPITDDVSWIGVLDPGLITFDIVMETKYGTTYNSYFINAEKKTVVETTKVKFWPTYIEKLKKVVNPEEIEYIIVDHTEPDHSGNVHNLLSVAPNATVVGSGNAIKFLRDQTGHDFKHLVVKHGDKLDLGNKTIHFIGAPNLHWPDTIYSWLEEDRVLFTCDSFGCHYCNEAMYDDLCGDFDDAFKYYFDAILRPFSKYMLQAIEKIRPLDIKVICPGHGPILRSDWKKYVDLSERYAKSAIAMPNEKSILIAYVSAYENTSVLAQKIAEGLRSACDFNVDVCDIENMSAEKLEEKIAHSMGIIIGSPTINQNIVHQIYGIFAVLNPLRDRGKLAAAFGSYGWSGEGVKIIESNLANLKLKVFDQNVMVKFQPHEPEFEQCREFGKAFAEKMIEMYNLTCNIK

SEQ ID NO: 11774 - protein, 528 aa, Alkaliphilus metalliredigenes
MTNSVAEVKQADVIFITGSNTTESHPVIGAQVRQAVKNGTKLIVADPREIDLAQDADVFLKIKPGTSIALSNAMLNVIFEEGLEDKTYIEENTEGIEELKKVVQKYTPEMAGEICGVKPEDIRAAARLYGQGVRGSILYCMGITQHHNGTESVMSLSNLALATGNLGKEGTGINPLRGQNNVQGACDMGALPNVMPGYQQVTNAEVINKFEKAWNTKLSNNVGLTIPEVMHKAAHGDVKMIYIFGENPMVSDPDTHHVEEALKNSFVVVQDLFLTETAELADVVLPAASFAEKDGTFVNTERRVQRVRKAVNSQGEAKADWMIFMELMNHLGYDKQYKNVEEIFEEIRQVTPQYAGISYDRIEDIGIQWPCPTEDHPGTKFLHTGKPARGAGLFMAVEHVESSELGNEEYPLILTTGRILYQYHTRTMTGKTEGINQMAPESYIEMHPNLAVSLGITNGETVKVKSPRGEVRTKAKVTKIVDENVVFMPFHYFEGAANVLTNGTDLDKYCKIPGLKVTGVKVVKIIAR

SEQ ID NO: 11775 - protein, 133 aa, Bradyrhizobium japonicum
MANQSRNARPRPDRAQAGIGPMKIVMAIIKPFKLEEVRDALTAIGVHGLTVTEVKGYGRQKGHTEIYRGAEYAVSFLPKIKIEVAVASDQVDKTIDAITSAAKTGQIGDGKIFVINLDHAVRIRTGEADAAAL

SEQ ID NO: 11776 - protein, 292 aa, Yarrowia lipolytica
MTELTHPSIVDGWFREISDTMWPGQAMALRVNQILHVEKSKYQDVLVFESTDYGNVLVLDGAIQATERDEYAYQEMIAHLALNSHPNPKKVLVIGGGDGGVLREIVKHDCVEEAVLCDIDEAVPRVSKQYLPTMSVGFNHPKTKVHIGDGFKFLQEYQNTFDVIITDSSDPEGPAASLFQKPYFELLSGALTEKGVITTQGESIWLHMKIIKELRQACKQVFPSADYAYCTIPTYPSGQIGFMVCSKDKDANLRKPLRSVSPEEESKLYRYYNKDIHSASFVLPTWARDDLA

SEQ ID NO: 11777 - protein, 338 aa, Pseudomonas putida
MNLNRFKRYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAEEVRQQEKELGFKFDYIVVCSVTGSTQAGMVVGFAADGRSKNVIGVDASAKPEQTKAQILRIARHTAELVELGREITEEDVVLDTRFAYPEYGLPNGGTLEAIRLCGSLEGVLTDPVYEGKSMHGMIEMVRRGEFPDGSKVLYAHLGGAPALNAYSFLFRNG

SEQ ID NO: 11778 - protein, 367 aa, Streptomyces nodosus
MMNSDVMGIWNKRDDVLVHQAEPYNAESPPGALTRRITPLDSFYGRNHAPIPRVDPESWRLRVDGLVDHPLELSSDELRRRFPERSVVATLQCAGNRRADLIEVRDIPGQVSWGPGAVSTARWTGASLADVLAEAGVRPDAAHIAFTGADVSPQAQPPQPFGGSIPVAKATSGEVLLAWAMNDQELPVAHGAPLRVIVPGWIGARSVKWLRRITARAEPSDNYFQTEYSILPAEADPLRAGPGDGITLGPIALHCAILRPAKNARLPSGPTEITGFALAGDDRTVARVEVSTDHGRTWTHADLDPPDNPWTWQHWRTTLTLPPGETELVARAWDSTATVQPESPATVWNPRGYANNAAAHLRVLCAP

SEQ ID NO: 11779 - protein, 229 aa, Phytophthora infestans
MQIFVKTLTGKTITLDVEPSDSIDNVKQKIQDKEGIPPDQQRLIFAGKQLEDGRTLSDYNIQKESTLHLVLRLRGGMQIFVKTLTGKTITLDVEPSDSIDNVKQKIQDKEGIPPDQQRLIFAGKQLEDGRTLSDYNIQKESTLHLVLRLRGGMQIFVKTLTGKTITLDVEPSDSIDNVKQKIQDKEGIPPDQQRLIFAGKQLEDGRTLSDYNIQKESTLHLVLRLRGGN

SEQ ID NO: 11780 - protein, 299 aa, Deinococcus radiodurans
MPRHFGAVPGVVPGMAFVNRQELRDAGVHLPTQAGISGSASEGADSIVLSGGYEDDRDEGDVILYTGEGGRDPLTGHQVKPQQLVRGNLALAISHRDGLPLRVTRGHRHSSQFSPQSGYQYAGLYRVDDHWREVGRSGFLIWRFRLTRLENQDAHHAGADPQHPDSQHPERRPTLVQRIVRDTATARAVKALYDHRCQVCGERLETPAGAYAEAAHIRPLGAPHHGPDVAGNILCLCPNHHVLFDFGAFSVGDDLRLLGLPGRLHVHPQHAVDREHLAYHRRHYALQAGLEWGCSVPLT

SEQ ID NO: 11781 - protein, 127 aa, Ashbya gossypii
MAPKAEKKPASKAPAAKKTTASTDASKKRTKTRKETYSSYIYKVLKQTHPDTGISQKSMSILNSFVNDIFERIASEASKLAAYNKKSTISAREIQTAVRLILPGELAKHAVSEGTRAVTKYSSSTQA

SEQ ID NO: 11782 - protein, 261 aa, Campylobacter lari
MVSMRDLLECGVHFGHQTRRWNPKMKKFIFGERKGIYVIDLQKTLRYFRYTYNIVRDAAAEGKTILFVGTKKQAGGAIKEYAEKCGMPYVNHRWLGGMMTNFGTIRQSIRKLEVIEKMEEDGSIKLLTKKEALMLTRKKEKLLAYLGGIRYMKTQPDMIFVIDTVKEKIAVQEANRLKIPVVAPLDTNCDPDLVDFPIPGNDDAIRSVQLFCQEMAEAINEGKALREQDGEANEEQPISEEEKKEVLEEAMSEEDFEGDKE

SEQ ID NO: 11783 - protein, 394 aa, Vibrio cholerae
MPFFFYNFVKNQKEMLMKRLFAWGAPLFALVALTLSLFSQADTKPSTIDSTSANYQQATLAGGCFWCTESDMEKLPGVVDVISGYAGGDVDNPTYKQVSSGKTGHIEVIQVTFDPKIVTYEQVLDNFFRHIDPTDDQGSFVDRGEQYRPAIFYHNAEQLEVAKRFMMEIDQLGIFKKPLKTELIEFKKFWPAEDYHQDYYKKNKVRYNYYRYASGRDQYLDEIFGADRNTHPKTLRQWIDEKNGQANVKAYVRPSDEQIRAKLTSLQYKVTQRDGTERPFDNEYWDNKEEGIYVDIVSGEPLFSSTDKYDSKTGWPSFTQPLNSSYIVTKDDNSLFYTRTEVRSRFADSHLGHVFNDGPAPTGLRYCMNSAAMRFIPKQEMAAQGYGEYLALFK

SEQ ID NO: 11784 - protein, 410 aa, Clostridium perfringens
MNFDNLEREDEQIAHLVQKEKERQENSIELIASENFVSKAVMEAMGSYLTNKYAEGYPSKRYYGGCHVVDEVEDLARERVKKLFGAEHANVQPHSGSQANMAVYFSILEPGDTVLGMDLSHGGHLTHGSPVNFSGRLFNFVSYGVDKETETINYETVRELALKHKPKLIVAGASAYSRIIDFKTLREIADEVGAYLMVDIAHIAGLVATGLHPSPVPYADFVTSTTHKTLRGPRGGLILCKEKFAKALDKNIFPGIQGGPLMHIIAAKAVCFKEALEPSFKTYMEQVVKNAHVLAEALESYGFKLVSNGTDNHLILVDLTNKDITGKDAEILLDSIGITLNKNTVPNETRSPFVTSGVRIGTPAITTRGFKEEEMKEIASIINDAIKEKDGDLEPLKARVKALCAKYPLY

SEQ ID NO: 11785 - protein, 582 aa, Unknown
  Frankia sp. EAN1pec
MAAGENPAGQAHPGSGGGQGERGNPGGGRGAPRAVLLTVDDDVSVSRAVARDLRRRYGGTYRIVRAESGAQALEALREIKLRGDAVAVLLADYRMPGMNGIEFLEQAMDLFPAARRVLLTAYADTEAAIDAINVVDLDHYLLKPWDPPEEKLYPVLDALLDAWRAADHRPVAETRVVGHRWSARSYEVRDFLARNQVPYRWYLADEPEGSRLLTAAGADPESLPCVITTDGSALTDPTDTELAAQVGLATAPTGDFYDLVVVGGGPAGLGAAVYGASEGLRTVLLERHATGGQAGQSSRIENYLGFPDGVSGSQLTDRARRQAVKFGAELLTAADVVTLEAAGPARRLLLADGGQIDAHTVILATGVSYRQLAAPGLTELTGRGVFYGSALTEAPSCSGQDVYVVGGANSAGQAAMYFSRHARSVTMLVRGKSLEASMSHYLIQQIAAVPTITVRVCTEVVSAQGTDHLESLVLRDNSTGQAEQVDSQWLFVFIGAAPRTDWLDGVVVRDEHGFVVAGPDLVVDGQRPSGWDLDRDPYHLESSVPGVFVAGDARAESVKRVASAVGEGAMAVALVHRYLAKR

SEQ ID NO: 11786 - protein, 411 aa, Oryza sativa
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNSNGLDIAKLMKHSSENRGIKGFDGGDAIDPRSLLTEECDVLIPAALGGVINKDNANEIKAKYIIEAANHPTDPEADEILSKKGVLILPDILANSGGVTVSYFEWVQNIQGFMWDEEKVNNELKTYMTRGFRDVKEMCRSHHCDLRMGAFTLGVNRVARATVLRGWEA

SEQ ID NO: 11787 - protein, 233 aa, Brassica napus
  misc_feature (211)..(211): Xaa can be any naturally occurring amino acid
  misc_feature (220)..(220): Xaa can be any naturally occurring amino acid
MAMSDLSTPKTTSPFLHSSSQLRLSSKLHLSNQFRHLHLLPPPLHTTSISKISCSVSQNNQAPVAVQENGSVKTKKECYGVFCLTYDLKAEEETKSWKKMINIAVSGAAGMISNHLLFKLASGSVFGPDQPIALKLLGSERSIQALEGVAMELEDSLFPLVREVDIGTDPYEVFQDVDWALLIGAKPRGPGMERAALWDINGQIFAEQGKXLNAVASPKXKVLVVGILHTTHV

SEQ ID NO: 11788 - protein, 229 aa, Brassica napus
  misc_feature (196)..(196): Xaa can be any naturally occurring amino acid
APRPRRVDTGEETELEAKGLFYGIGHSPNSQLLEGQVELDSSGYVLVREGTSNTSVEGVFAAGDVQDHEWRQAVTAAGSGCIAALSAERYLTSNNLLVEFHQPQTEETKKEFTQRDVQEKFDVTLTKHRGQYALRKLYHESSRVICVLYTSPTCGPCRTLKPILNKVVDEYHNDVHFVEIDIEEDQEIAEAAGIMXTPCVQFFKNKEMLRTVSGVKMKKEYREFIEANK

SEQ ID NO: 11789 - protein, 473 aa, Buchnera aphidicola
MNYLPIFIDLKSKNVLVIGAGEVGLNKIRILLRAKAKVNVIAKELCSEVKLLLRDQKINWLSKNFDLIYLNKIFLVVSATNDIKLNQYIFKKCNERCVLVNIVDDKLKCSFIFPSIIDRSPLIVAISSGGTAPVLLRLLREKIEAILPNKLGDVAKIAGKWRLAIKKHFSNFLERRKFWEKLFHSIFVEHILNGNKEQAINVLKKNMNQNISLTGEIILVGAGPGDSGLLTLRGLQVLQQADVVLYDYLVSEDILDLIRRDAKRICVGKRVGLKNITQNEIIKLLIFFAQKGKKVVRLKGGDPFIFGRGSEEIEAAKDAGIHFQVVPGITSAIGIAAYTGIPLTHRKYSQGVIFITGHKCIDGFLNNWSILSDPSYTLVVYMGTLKAVYIAQKLITFGRSKLTPIAIIVQGTTIHQKVIVGCLGEIEKIIPFAATPSLLIIGDVVHLHKKLAWFQSENILKKIKNKFSTLTFI

SEQ ID NO: 11790 - protein, 627 aa, Lotus japonicus
MPAWWNRKPWKNKQEHDDDEDGEYEAEEVEEAPRSGLQFNFMKSPISSARSSDKKKKKKIKDKKKPKSFDEVLYRNSPRTSKDCDGGAAAMEKKGLPLPRPTTPCDQASISGSSLSSSASASFDDHSISPHFNANRGQEEVKFNVRPKSPCSRGPTSPTSPLHQRLHALSLDSPTGGKQDEGTSQCHPLPLPPGSPTSPSAPCNTRANGVLENNTCNLSKWKKGKLLGRGTFGHVYLGFNSENGQMCAIKEVKVFSDDKTSKECLKQLNQEINLLNQFSHPNIVQYYGSELGEESLSVYLEYVSGGSIHKLLQEYGAFKEPVIQNYTRQIVSGLAYLHSRNTVHRDIKGANILVDPNGEIKLADFGMSKHINSAASMLSFKGSPYWMAPEVVMNTNGYGLPVDISSLGCTILEMATSKPPWSQFEGVAAIFKIGNSKDMPEIPEHLSDDAKNFIKQCLQRDPLARPTAQSLLNHPFIRDQSATKVANASITRDAFPYMSDGSRTPPVLEPHSNRSSITTLDVDYATKPALAAVRTLRNPRDSTRTITSLPVSPSSSPLRQHRPTHNSPFFSPPHPSYAMMGQSSYTSNNMHKNPARSNATLTLDPWLETSRYKAHTPPGGSPRMRFI

SEQ ID NO: 11791 - protein, 334 aa, Arabidopsis thaliana
MISNHLLFKLASGEVFGPDQPIALKLLGSERSIQALEGVAMELEDSLFPLLREVDIGTDPNEVFQDVEWAILIGAKPRGPGMERADLLDINGQIFAEQGKALNKAASPNVKVLVVGNPCNTNALICLKNAPNIPAKNFHALTRLDENRAKCQLALKAGVFYDKVSNMTIWGNHSTTQVPDFLNARINGLPVKEVITDHKWLEEGFTESVQKRGGLLIQKWGRSSAASTAVSIVDAIKSLVTPTPEGDWFSTGVYTDGNPYGIEEGLVFSMPCRSKGDGDYELVKDVEIDDYLRQRIAKSEAELLAEKRCVAHLTGEGIAYCDLGPVDTMLPGEV

SEQ ID NO: 11792 - protein, 487 aa, Arabidopsis thaliana
MHTLPNKELEVTEPGEQKLGSSLNTLLEDSLIFFAELGCQKLNVFLNVSDESLLVISWLLLKSEGVDNVNNLLSRVINTFILTTFFSRWIGTNVNIYSSHSNPLSFYFPEDSILNLLVRERVRQKLITGEKILVHQHGRLLIVFSLRWMRINENRRLRERDAATRRFSRIAKDVTELIGNTPLVYLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 11793 - protein, 171 aa, Triticum aestivum
VTLQNKFVQKSRLVPVRNSRDIVDPRVRDKKFENKVEWGIDLASEHERYLTEVIFKKPVIVYNYPKGIKAFYMRLNDDQKTVAAMDVLVPKVGELIGGSQREERLDILKQRILDADLPLHPDEWYLDLRRFGSVKHSGFGLGFERMILFATGLENIRDVIPFPRYPGRADL

SEQ ID NO: 11794 - protein, 33 aa, Ecballium elaterium
MTRRYWNIHLEEMMEAGVHFGHGTRKWNPRMAP

SEQ ID NO: 11795 - protein, 385 aa, Photobacterium profundum
MTDAIRKFLKLESAGGIILIIAAAVAMVIANSPLQSLYSGTLSSYIAGLSVEHWINDGLMAIFFMLIGLEVKRELIEGALNTKEKAIFPAIAAVGGMVAPALVYVAFNFADPIALQGWAIPAATDIAFALGVMALLGNRVPVSLKVFLLALAIIDDLGVIVIIALFYSSDLSTLALAVAFAATATLFVMNAKNVTKTSLYLIVGAILWFSVLKSGVHATLAGVVLGFAIPLTGKDGRSDKHSPLKHLEHVLHPYVAFLILPLFAFANAGISLDGVSLESVTGMLPLGIAAGLFLGKPLGIFTASYIAVKMGLATLPDGINLKHIFAVSVLCGIGFTMSIFISSLAFVGAPADFNTYSRLGILMGSTVAAVVGYILLSRTLPKTEA

SEQ ID NO: 11796 - protein, 417 aa, Borrelia garinii
MRDDQIFNLIEKEKLREKEHIKLIASENFTSLEIRQAVGSILTNKYAEGYPLNRYYGGCSFVDEIESLAILRAKELFGAKYANVQPHSGSQANMAAIMALINPGDRILGMQLSHGGHLTHGSRVNFSGIFFNTYFYGVSRDSELIDYDEVLKIARDCRPNLIIAGASSYSREIDFKKFREIADDVSAYLLCDIAHIAGLIVAGFHNSSIDVAHLTTSTTHKTLRGPRGGIILSGKDFDKLVTFNGKEKALFNAVNSTVFPGTQGGPLVHVIAGKAIAFREALQESFREYIANVIKNTKVMAEYFKSEGFRIVSGGTDNHLFLVDLSNLDLTGADAEKLLEGVNITLNKNAIPFDKKSPSLASGIRIGGAAITSRGLNENDSLNVAKFIVRALKTRSDIELKQIKKEVVRFIRDFDMP

SEQ ID NO: 11797 - protein, 33 aa, Coccinia palmata
  misc_feature (12)..(12): Xaa can be any naturally occurring amino acid
MTRRYWNIHLEXMMEAGVHFGHGTRKWNPRMAP

SEQ ID NO: 11798 - protein, 255 aa, Triticum aestivum
MAMAVSGAVLSGLGSSFLAGGKRSAAALGNAGARRVGRKTLIVAAAAAQPKKSWIPAVKGGGNFLDPEWLDGSLPGDFGFDPLGLGKDPAFLKWYREAELIHGRWAMAAVLGIFVGQAWSGVPWFEAGADPRAIAPFCFGTLLGTQLLLMGWVESKRWVDFFNPDSQSVEWATPWSRTAENFANYTGDQGYPGGRFFDPLGLAGKSRDGVYEPDREKLERLKLAEIKHSRLAMLAMLIFYFEAGQGKTPLGALGL

SEQ ID NO: 11799 - protein, 336 aa, Pseudomonas plecoglossicida
MNLNRFKRYPLRFDLPYAAKRPSEHLGGKVELYAKREDCNSGLAFGGNKTRNPEARIPEAIEQGCDTLVSIGGIQSNQTRQVAAQAARTWAPNALLVQENWVNYSDAVYNRVGNIKMSRIRGADVRLDSAGFNIGIRPSWEQAMADVRAAGGKPFPIPAGCSEHPYGGLGFVGFAEEVRQQEAELGFKFDYIVVCSVTGSTQAGMVVGFAADGRAQRVIGVDASAKPEQTKAQILRIARHTAKLVDLGREITEKDVVLDTRFAYPRVRPAQRRHAGSHSPVRSFWRACVPDPVYTRPKSMQRDDEMVRRRRIPGRLPKVLYAHLGATYQPSAVAEQ

SEQ ID NO: 11800 - protein, 524 aa, Phytophthora infestans
MKLLQVITFVSAAVSLSTSAYGHSSNALAGETAASVVESSADPTADQRSRRTSIRADINTYPYGAKKSDVAVDDGDAPRRFRRRLTLKEEEEIEEDLEKVEKKKKAAKKRVDEATEEIEEGLENSNDDEVDDGLKEKREAEKDVEDAEVEEKVDEDLEEIQVEEEVEKMEEDEEKASSKKSKKAKTDDEDTDDDTEDDDDDQEAQTTKKSSKKTKSDEETDEDDNGDGDDEEAPAKKSKKSSTKSKTDEDEDEEDEAQRRRLTESDEKELEEDMKQVKKKEKAAKKKMEEATEEIEEGLENSNDDEVDEGLEEKLEAEKEEEEAEVEEKMDEDLEKIQKKEAAEKQKSADDEEEDEEEDEDEDETPAKKKSSKSATKSKSVDDDEERDDDKTFKKSSKKSKADEEAEEEAEEELEEELEEIEEEIEEEEEAEKAKKAKKSTHKSKTDEEEEEDDKTRRRHLRGLSTINEQEVETDMDKAKKAEKEAKAKEAEADEDIQEGLENSNDDEVDEAMATKLAAEKKKK

SEQ ID NO: 11801 - protein, 112 aa, Thiomicrospira crunogena
MKLVVAIIKPFKLDDVRESLHEIDVHGMTVTEAKGFGRQKGHTEIYRGAEYAIEFLPKVRIEIAVPEEKVESVIEAIGNAARTGKIGDGKIFVSPIEQAVRIRTEEKGEVAL

SEQ ID NO: 11802 - protein, 444 aa, Chlorobium tepidum
MPFIVNTDAERAEMLREIGVENFEALIADIPEEIRLKKALDLFPAMGEPEVKSLLEKMASGNAATCDHVSFLGAGAYDHFIPSAVKTIASRSEFYTAYTPYQAEVSQGTLQAIYEYQSVMCRLYGMDVANASMYDGASALAEAALIALNVTGRNGIVVAGKLHPYTSQVLETYLEAAGDRSIVQNGLENGIGSVEALEALVSSETAAVIVQQPNFYGCLEEVEAIGEIARKNGALFIVSADPVSLGVLEAPGNYGADIAVGEGQSVGNAQSFGGPYLGILTVKQAHVRKIPGRLVGMTKDKDGNDGFILTLQTREQHIRREKATSNICSNQALCALQSVVHLSLLGKEGIRDVANRSMQKAHYLADRIAELPGYSMKFSAPFFREFVVETPVPSATIIEKMLEKKVFAGVDLSAWGEDGLLVAVTEKRTKEELDSFVSELAALG

SEQ ID NO: 11803 - protein, 377 aa, Unknown
  Synechococcus sp. WH 8102
MADYYDLLGVGRDADADTLKRAYRSKARKYHPDINKEPGAEDRFKEIGRAYEVLSDPQTRARYDQFGEAGLGGAAGASDMGDMGGFADLFETFFQGFGGPGGAAAGRSGRRGPQQGDDLRYDLTIDFEQAVFGQEQEIKIPHLETCDTCGGSGAKAGSGPTTCGTCGGAGQVRRATRTPFGSFTQVAECPNCGGTGQVIADPCNACGGQGVRQVRKKLRINIPAGVDTGTRLRVSGEGNAGQRGGPSGDLYVFLTVKSHPRLRRDGLNILSTVNVSYLQAILGDTIEVETVDGDTVLEIPPGTQPGTVLTLANKGIPKLGNPVARGDQRVQVMVQLPTRLSDPERTLLEELAGHHSARGKQHHHHNSGLFARLFGQK

SEQ ID NO: 11804 - protein, 945 aa, Unknown
  Polaromonas sp. JS666
MNAITRQELAELDVPLVSFSLNGREVTGRATETLLQVAKREGVEIPHLCYKEGMEAVGNCRSCMVEINGERVLAPSCCRAPTAGMKVVTDSERAVASQKMVLELLLSDMPEKAYTRNNEVDQWASKIGVGKPRFEARQQVRQDLSHPAIAVNLDACIQCTRCLRACRDEQVNDVIGLAFRGDQAKIVFDMDDAMGASTCVACGECVQACPTGALMPAREAALAVPDKQVASVCPYCGVGCQLTYNVKDDKILFVEGRDGPANHNRLCVKGRYGFDYAHHPQRLTKPLIRREGVPKTGDFTMDPDRVMDVFREASWEEALAFAGGKLAAIRDQYGKKSLAGFGSAKGSNEEAYLFQKLVRTGFGSNNVDHCTRLCHASSVVALLEGIGSGAVSNPVMDVTKADVVIIIGANPTVNHPVAATWIKNAVKNGTRLVMLDPRRSDLTRMAHRHLQFKPDTDVPMLNAMMNVIVTEGLVDEEFIASRTIGYEELRKNVEGYTPELMAPICGIDADTLRYVARLYATSKASMILWGMGVSQHVHGTDNARCLIALSLMTGQIGRPGTGLHPLRGQNNVQGASDAGLIPMMFPDYQHVSDPKVRATFEKAWDVPAGTLDDQPGLTVVEVMHAIKKGGIRGMYVQGENPAMSDPDANHAREALAALDHLVVQDIFLTETAYLADVILPASAFPEKDGSFTNTDRLVQMGRKAINPPGDARQDLWIIQEIAKRMGLDWHYNHVSEVFDEMRHTMPSIGGITWDRLDREHSVTYPCMKEGDPGESVVFVEDFPREGGRARFVPADIIPAAERPDTEYPMVLITGRQLEHWHTGSMTRRATVLDAIEPDPVALVHPLDLADLGGKPGDVVTIASRRGEVTLYARADESSPRGAVFVPFCYYEAAINKLTNAALDPFAKIPEFKYCAIKVSLGGTPPLQASYGGGQALENAIALASA

SEQ ID NO: 11805 - protein, 632 aa, Erwinia rhapontici
  misc_feature (236)..(236): Xaa can be any naturally occurring amino acid
  misc_feature (449)..(449): Xaa can be any naturally occurring amino acid
MSSQELKAAVAIFLATTFSATSYQACSAGPDTAPSLTVQQSNALPTWWKQAVFYQVYPRSFKDTNGDGIGDLNGIIENLDYLKKLGIDAIWINPHYDSPNTDNGYDIRDYRKIMKEYGTMEDFDRLISEMKKRNMRLMIDIVINHTSDQHAWFVQSKSGKNNPYRDYYFWRDGKDGHAPNNYPSFFGGSAWEKDDKSGQYYLHYFAKQQPDLNWDNPKVRQDLYDMLRFWLDKGVXGLRFDTVATYSKIPNFPDLSQQQLKNFAEEYTKGPKIHDYVNEMNREVLSHYDIATAGEIFGVPLDKSIKFFDRRRNELNIAFTFDLIRLDRDADERWRRKDWTLSQFRKIVDKVDQTAGEYGWNAFFLDNHDNPRAVSHFGDDRPQWREHAAKALATLTLTQRATPFIYQGSELGMTNYPFKKIDDFDDVEVKGFWQDYVETGKVKAEEFLXNVRQTSRDNSRTPFQWDASKNAGFTSGTPWLKINPNYKEINSADQINNPNSVFNYYRKLINIRHDIPALTYGSYIDLAPDNNSVYAYTRTFGAEKYLVVINFKEEVMHYTLPGDLSINKVITENNSHTIVNKNDVEDPRGATSVCSPFQAQKRPGDPGYSAAHSIRFLPRFFASYRGDIHAFK

SEQ ID NO: 11806 - protein, 337 aa, Streptococcus pyogenes
MKRIAVLTSGGDAPGMNAAIRAVVRKAISEGMEVYGINRGYAGMVDGDIFPLGSKEVGDKISRGGTFLYSARYPEFAQLEGQLAGIEQLKKHGIEGVVVIGGDGSYHGAMRLTEHGFPAVGIPGTIDNDIAGTDYTIGFDTAVNTAVEAIDKLRDTSSSHGRTFVVEVMGRNAGDIALWAGIASGADQIIVPEEEFDIEKVASTIQYDFEHKGKNHHIIVLAEGVMSGEAFAQKLKEAGDKSDLRVTNLGHILRGGSPTARDRVIASWMGSHAVELLKEGKGGLAVGIHNEELVESPILGTAEEGALFSLTEEGKIIVNNPHKARLDFAALNRSLSQ

SEQ ID NO: 11807 - protein, 125 aa, Glycine max; identical to SEQ ID NO: 538

SEQ ID NO: 11808 - protein, 362 aa, Streptomyces avermitilis
MNNIGVPAREVDVVVTGAGQAGLSSAFHLRRTGFEPERDFVVLDHAPRPGGAWQFRWPSLTYRKVHGMHALPGMELTDADPSRPSSEVIAEYFDTYERTFDLRVRRPVDVTAVREGEGGRLLVQTSDGTWATRALINATGTWDRPFWPRYPGQESFRGRQLHTAQYPGPEEFAGQRVVVVGGGASGTQHLMEIAPYAASTTWVTRRPPVFREGPFSEDVGRAAVAMVEERVRRGLPPRSVVSVTGLPLNDAVRRAIADGVLDRLPVFDRITPDGVEWDDGRRVAADVILWATGFRAAIDHLAPLRLRAPGGGIRVEGTRVVADPRIHLVGYGPSASTIGANRAGRAAVRDIRRLLAGEPLTV

SEQ ID NO: 11809 - protein, 71 aa, Leuconostoc mesenteroides
MANDVIEIEGKVKETLPNAMFQVELENGAVILAHVSGKIRKNFIRILPGDRVTVEMSPYDLTKGRITYRFR

SEQ ID NO: 11810 - protein, 534 aa, Unknown
  Mycobacterium sp. MCS
MTADNPVKRTDVDKALLGSATYRSLGEQRLTPAEERFEKGRRTVGLFLAPALTVVFLLLPLDLPPQQQTLAAVLLGVIVLWVTEAVPIPIGGLLGVAVVVFLGVAPADDVLAPFGSSTIFTFIGAFILAQAMLKHGLARRFAFRILALPRAGQSTTGVILAFGAITCLLSAFVSNTATVAMLLPTAIGILGVIAKLLQKQGKVADDFDPLRLRVGAALMLMLAYSASVGGLLTPVGSPPNLIGRGLIEEATGERISFGQWMVMAAPICLLMFAILAVVLLLLNKPELKHIDGVADYVAREREEMGRLSRAEKNTLIAFGVTVFLWILPGIIALAFGNDSDIYSSVSDRLDEGTVAVFGAALLFLLPTEWEQREFTLRWRDAAAIDWGTIVLFGTGIIFGSLLADSGLAETIGNSVADALGLSSVVAITIFAVLLAIVVSETTSNTASAAVVVPIVIPVAIAAGVNPFVPALAATFAASFGFMLPVSTPQNAIVYGSGAVPITTMIRSGVTFDVAGAILIILFLPLMIALLGLGA

SEQ ID NO: 11811 - protein, 103 aa, Ashbya gossypii
MSGRGKGGKGLGKGGAKRHRKILRDNIQGITKPAILRLARRGGVKRISGLIYEDVRAVLKSVLESVIRDAVTYTEHAKRKTVTSLDVVYALKRQGRTLYGFGG

SEQ ID NO: 11812 - protein, 499 aa, Gibberella zeae
MSLTGVRGTSRVLRTIAKPVAISATCTRPASSLAVEDQQQEKNRQKHFINLIPSENFTSQAVLDALGSVMQNKYSEGYPGARYYGGNEFIDQSERLCQQRALESFGLDPKQWGVNVQALSGAPANLYVYSALLNTHDRLMGLDLPHGGHLSHGYQTLTKKISAISKYFETLPYRLNETTGYIDYEKLDEVASVYRPKIIVAGASAYSRLIDYQRMREICDKVNAYLLADIAHISGLVAAKVIPGPFAHADIVTTTSHKSLRGPRGAMIFYRKGIRRQHPKTKEDILYDLEGPINNSVFPGHQGGPHNHTITALAVALKQAQTPEFQAYQSQVLKNAKAFAKRLSEPKGKGGLGYKLVSGGTDNHLVLADLKPHGIDGGRVERVLELVGVAANKNTVPGDRSALVPGGLRMGTPAMTTRGFNEDDFVRVADVVDRAVTIASRIDKAARKAAEEKGDKSPGKIKVFLEHLGDGETQSEIVQLRSEVEDWVGTYPVPWNTSQ

SEQ ID NO: 11813 - protein, 428 aa, Brassica napus
MAQILAASPTCQMRLTKPSSIASSKLWNSVVLKQKKQSSSKVRSFKVMALQSDNSTINRVESLLNLDTKPFTDRIIAEYIWIGGSGIDLRSKSRTLEKPVEDPSELPKWNYDGSSTGQAPGEDSEVILYPQAIFRDPFRGGNNILVICDTYTPAGEPIPTNKRARAAEIFSNKKVNEEIPWFGIEQEYTLLQPNVNWPLGWPVGAYPGPQGPYYCGVGAEKSWGRDISDAHYKACLYAGINISGTNGEVMPGQWEFQVGPSVGIEAGDHVWCARYLLERITEQAGVVLTLDPKPIEGDWNGAGCHTNYSTKSMREDGGFEVIKKAILNLSLRHMEHISAYGEGNERRLTGKHETASIDQFSWGVANRGCSIRVGRDTEKKGKGYLEDRRPASNMDPYIVTSLLAETTLLWEPTLEAEALAAQKLSLKV

SEQ ID NO: 11814 - protein, 445 aa, Pseudomonas aeruginosa
MTQSVDAFLERLKRRDPDQPEFHQAVEEVLRSLWPFLEANPHYLEAGIIERIVEPERAILFRVPWVDDQGRVRVNRGYRVQMSSAIGPYKGGLRFHPSVNLGVLKFLAFEQVFKNSLTTLPMGGGKGGSDFDPKGKSDAEVMRFCQSFMSELYRHVGADLDVPAGDIGVGAREIGYLFGQYKRLSNQFTSVLTGKGLSYGGSLIRPEATGFGCVYFAQEMLKDRGRGFDGQRVAISGSGNVAQYAARKVMEMGGKVISLSDSEGTLYAEAGLSDEQWEYLMELKNARAGHPRDGVEQFSLQFLEGVPPWGLACDIALPCATQNELDAEDARRLLANGCVCVAEGANMPSTLEAVDLFLEAGILYAPGKASNAGGVAVSGLEMSQNAMRLRWSEGEVDTKLHGIMQSIHHACLLYGEEQGRVNYVKGANIAGFVKVADAMLAQGVV

SEQ ID NO: 11815 - protein, 338 aa, Unknown
  marine gamma proteobacterium HTCC2143
MTQYHQITVLGGGSFGTTIANIMADNGHRVCLWLRNQARADEINCDHVNSAYLPDYHLNHALKASTDLKAAVTGCDIIFMAVPSKSSRAVAAEVSAYLADNVIVVSTTKGIEHDSFKMMSEVLAEEIPGARIGVLSGPNLASEIAAKQLTATVIASCDEDLNTTIQALLHSGTFRVYASADVLGVELGGALKNVYAIMAGMAAAMGIGQNTISMLMTRSLAEMSRFAVQKGADPMTFLGLSGVGDLIATCMSPLSRNYQVGFELGNGKELEDIIADLGQVAEGVNTLQILKRQADELGVYMPLVNGLYDIIYTPKSITEVIGSLMFAEQSRDVEFTIK

SEQ ID NO: 11816 - protein, 304 aa, Agrobacterium tumefaciens
MTRQMILAVGQQGPIARAETREQVVGRLLDMLTNAASRGVNFIVFPELALTTFFPRWHFTDEAELDSFYETEMPGPVVRPLFETAAELGIGFNLGYAELVVEGGVKRRFNTSILVDKSGKIVGKYRKIHLPGHKEYEAYRPFQHLEKRYFEPGDLGFPVYDVDAAKMGMFICNDRRWPETWRVMGLKGAEIICGGYNTPTHNPPVPQHDHLTSFHHLLSMQAGSYQNGAWSAAAGKVGMEEGCMLLGHSCIVAPTGEIVALTTTLEDEVITAALDLDRCRELREHIFNFKAHRQPQHYGLICEF

SEQ ID NO: 11817 - protein, 478 aa, Xylella fastidiosa
MTANVLFPLFANLHDRAVLVVGGGKVAERKTEALLKVGALPIIGAPSLTASLQRWAETGRITWRQGTFENSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAKTPPTESGSVTLVGAGAGDAGLLTLNALRALNEADIILYDRLVSDTVLQMARRDAEQIEVGKSATGHSVRQEDIHTLMLQHARAGQRVVRLKGGDPFVFGRGGEELEFLRTHGIPYEVIPGITAALACAAYAGIPLTHRDHAQSLCLITAHCQSSLDTLNWAALAQERQTLAFYMGVAGLPTIQQRLCEAGRTETTPFALIENGARAQQRVLTGTLKTLAHTAQTYAVRPPALLILGEVTALAEHLHWFGTTPLSAPCPPRTHPIS

SEQ ID NO: 11818 - protein, 549 aa, Haemophilus influenzae
  misc_feature (113)..(113): Xaa can be any naturally occurring amino acid
MSESFAQLFEESLKVLETRQGSIVSGTVVAIQKGFVLVDAGLKSESAIPVAEFLNAQGELEIQVGDTVNVALDAVEDGFGETKLSREKAVRHESWIELEKAYEEKATVIGLIXGKVKGGFTVELNGVRAFLPGSLVDTRPAREADHLLGKELEFKVIKLDQKRNNVVVSRRAVIESENSQEREQVLENLVEGSEVKGVVKNLTEYGAFVDLGGVDGLLHITDMAWKRVKHPSEIVNVGDEVTVKVLKFDKDRTRVSLGLKQLGQDPWAAIAENHPVNSKLTGKVTNLTDYGCFVEILDGVEGLVHVSEMDWTNKNIHPSKVVSLGDTVEVMVLEIDEERRRISLGLKQCKANPWTQFADTHNKGDKVTGKIKSITDFGIFIGLEGGIDGLVHLSDISWSISGEEAVRQYKKGDEVSAVVLAVDAVKERISLGIKQLEEDPFNNFVAINKKGAVVSATVVEADAKGAKVELAGGVEGYIRSADLTSEVAVGDVVEAKYTGVDRKSRIVHLSVKAKDQAEEAAAVASVNNKQEDIVIPNAMAEAFKAAKGE

SEQ ID NO: 11819 - protein, 332 aa, Arabidopsis thaliana
MENTDELVSIELPAPASWKKLFYPKRAGTPRKTEIVFVAPTGEEISSRKQLEQYLKDNKEAAEKNEEAAVKENMDVDKDGKTENAEAEKEKEKEGVTEIAEAEKENNEGEKTEAEKVNKEGEKTEAGKEGQTEIAEAEKEKEGEKAEAENKEAEVVRDKKESMEVDTSELEKKAGSGEGAEEPSKVEGLKDTEMKEAQEVVTEADVEKKPAEEKTENKGSVTTEANGEQNVTLGEPNLDADAEADKGKESKEYDEKTTEAEANKENDTQESDEKKTEAAANKENETQESDVKKTEAAVAEEKSNDMKAEDTNRSLEANQVQQQQGAAASVSC

SEQ ID NO: 11820 - protein, 158 aa, Chromobacterium violaceum
MSIYDFSFRRLDGSEQAMADYRGSVLLLVNTASRCGFTSQYAGLEALHRRFGPQGLAIIGFPCNQFGAQEPGDAGEIGAFCQKNYGVDFAMADKVDVNGANAHPLWQYLKRQKRGLLGQAIRWNFSKFLVDRQGRVVARFAPFTRPEKLAARIEALLK

SEQ ID NO: 11821 - protein, 546 aa, Mycobacterium bovis
MDQHQRPDPMGPGSPRASARRPEPDPMGEPWWSRAVFYQVYPRSFADSNGDGVGDLDGLASRLDHLQQLGVDAIWINPVTVSPMADHGYDVADPRDIDPLFGGMPAFERLVAAAHRQGIKVTMDVVPNHTSSAHPWFQAALADLPGSPARDRYFFRDGRGPDGSLPPNNWESVFGGPAWTRVREPDGNPGQWYLHLFDTEQPDLNSDNPEILDDFEKTLRFWLDRGVDGFRIDVAHGMAKPPGLPDSPDLGIEVLHHRDDDPRFNHPNVHAIHRDIRTVIDEYPGAVTVGEVWVHDNARWAEYLRPDELHLGFNFRLARTEFDAAEIRDAVANSLAAAALQNATPTWTLANHDVGREVSRYGGGEIGLRRAKAMAVVMLALPGVVFLYNGQELGLPDVDLPDEVLQDPTWERSGRTERGRDGCRVPIPWSGNIPPFGFSTCPDTWLPMPPEWAALTAEKQRADAGSTLSFFRLALRLRRERNEFDGDVDWLAAPDDALIFRRHGGGLVCALNAAERPLALPAGEPILASAPLTDATLPPNAAAWLV

SEQ ID NO: 11822 - protein, 538 aa, Triticum aestivum
  misc_feature (221)..(221): Xaa can be any naturally occurring amino acid
  misc_feature (296)..(296): Xaa can be any naturally occurring amino acid
  misc_feature (348)..(348): Xaa can be any naturally occurring amino acid
QVCTKKQAGTGPEFPGYRRPTRPRAQDGILKYMLKMMEVCRAQGFVYGIIPEKGKPVSGASDNLRAWWKEKVRFDRNGPAAIAKYQADNAMPGSESELASGTTSPHSLQELQDTTLGSLLSALMQHCDPPQRRFPLEKGISPPWWPSGDEEWGPARGFPGRRRPPPYKKPHDLKKAWKVSVLTAVIKHMSPDIEKIRRLVRQSKCLQDKMTPQEISTWLAXVKQEEELFMRLHPGARPPASAGGIASAISFNASSSEYDVDVADRLQGAMRRHPQRWPWAIQPPSNLGAAILNDKXSCKAPMKEETGDMEYVQKRSAVAAEPELMLNNRVYTCNNVQCPHSDYGYGFXDRNARNSTGYTCKYNDPLPAKRRRTRQRHLRRRKLPGSLTTNHGSTTGFPAPHGRQRIGELMNMLTTSPATRHWTTHIIERPCITHYGQGFFGQGNGIGGNGDSMFSDVSNMMQQQQDSSHSSHSSSSSRPRRSSSSSSVTTPAVPATKMGSISGASGFKVRSGLQHVPDRSTTRQKNDGQIWTTGMMKE

SEQ ID NO: 11823 - protein, 280 aa, Methanococcus maripaludis
MKFDAWYTEPQTENLSLSTKLKDILYVGQSEYQEIQVLDTYEFGRVLILENTYQTTERDEFIYHELISHPALFTHGNPKKVLVIGGGDGGSVREVLKHKSVEKIDFVELDGQVVEVAKKFLPTLSCEIDNEKVNTIITDGIKYVAETSEKYDVILVDCPDPVGPAAGLFEKEFYNNLYKCLNDDGIMVQQTESPLLHEKLINKIKGHLKDAGFSTIRPLVCSIPTYPSGFWSFTLASKKNDPLNSDVSEIENKLKDMTTKYYDQDVHKGVFLATPRYLKE

SEQ ID NO: 11824 - protein, 486 aa, Alkaliphilus metalliredigenes
MLSKEINRADIRQKSKQRHLTEETKKLIIFIVIMVGVFLSSFITPPEGLESQGLRMLFIALAAAILWMTEAIPIGVTALVIILLQALYGITPLTNGLALIAHPVNAVVLVGYLLAGALVSSGMDKRLSLTIISKMGEKTSRLMLGIMFVTAFLSMWMSNTATTAIMVPIAAGILTMAGAKPLKSNLGKALFIGIAFSANIGGMGTPTGTPANPIAIALLHSLAGIQLSFLDWMVRALPLVIVLLPVSWLVLLKVYPLEIKVVEGGLDAVKKQLKDMGPLKNTEKKVMILFSSAIFLWLLDSFIPLPKDWIYIVAVFLTIILVTPKIGFMTWKHAQGLIGWEVLFLVGGGLSMGAGLKATGTIDWIAGLLSSSLGQMPEGLAMAVITAATGLGITVFCSLSGTATTFVPIAIVLALNFGWDPIAFAVAAGLASSFAFLLPANAAPNAVAYGSGYFKTLDMFKAGAIMIIFSIVIQGVLSGFVLPFIF

SEQ ID NO: 11825 - protein, 310 aa, Chromobacterium violaceum
MRIANTITDLIGNTPLVKLNRVTEGVGATVVAKLEFFNPAHSVKDRIAVAMLDAAEQAGKIGPNTVIVEPTSGNTGIGLAMVCAARGYKLVITMPETMSKERRQLLKAYGAELILTPGPDGMGGAIAKAKALVDEFPDTYFMPQQFENPANPEIHRHTTAEEVWNDTDGKVDIFVAGVGTGGTITGVGEVLKARKPGVQIVAVEPDASAVLSGSPKGPHPIQGIGAGFVPAILNTGIYDEIIRVKNEDALQTAREVATKEGILVGISSGAAVWSALQLAKRPENAGKLIVVVIPSFGERYLSTVLFEHLG

SEQ ID NO: 11826 - protein, 388 aa, Picea mariana
MGRAPCCAKVGLNKGAWSAEEDSLLGKYIQTHGEGNWRSLPKKAGLRRCGKSCRLRWLNYLRPCIKRGNITADEEELIIRMHALLGNRWSIIAGRVPGRTDNEIKNYWNTNLSKKLAVRGIDPKTHKKVTTDSINRASDRFNQRKGGKLYDCSQRSQRLERNVARAGQSTGLVIPNVHNLKADLKGQYIAGPRAIQSSNSIRSSSPINTLIQPKSNELTDDPDFMQPQPVVSSEAGKQTDDSTVYCSSDSAASCALIDHLSSADDDQYLSLEGNSNECYSHTVAEESGTLKSSNPQTHSEAICDSRERDNGGPVQKHDQFPEYDVLSFFDVRNAENEICCNDDQWVHEQEMPQLHSWDNQIDDQGKEHFGSHVNNDVTAMSWEASFWF

SEQ ID NO: 11827 - protein, 33 aa, Echinocystis lobata
MTRRYWNIHLEAMMEAGVHFGHGTRKWNPRMAP

SEQ ID NO: 11828 - protein, 159 aa, Brassica napus
MEGRRITASPRPCSSGRRVVAKKRPRPDGFVNSVKKLQRREISSRKDRAFSINTAQERFRNMRLVEQYDTHDPKGHCLVALPFLMKRTKVIEIVAARDIVFALAHSGVCAAFSRETNRRICFLNVSPDEVIRSLFYNKNNDSLITVSVYASDNFSSLKC

SEQ ID NO: 11829 - protein, 159 aa, Zea mays
  misc_feature (37)..(37): Xaa can be any naturally occurring amino acid
  misc_feature (87)..(87): Xaa can be any naturally occurring amino acid
  misc_feature (138)..(138): Xaa can be any naturally occurring amino acid
  misc_feature (152)..(152): Xaa can be any naturally occurring amino acid
YCANKAYPKFHFHRAVRDPKIQIFHLDQECANTHNFXCCVHLVYNKYHHLSSEALEDAHICVNEYLTQNIVKEAFHLRLPAHLFHVXMIKNMVCSGPRRYTSDRDACRLAVYDIVTVARVNIEHILMSVLTRDANRAXALECLRRSHYKFPXRQKIIVS

SEQ ID NO: 11830 - protein, 112 aa, Unknown
  Erythrobacter sp. NAP1
MKKIEAIIKPFKLDEVKEALHEIGVSGITVTEARGFGRQKGHTELYRGAEYVVDFLPKVKLEVVVPDDQADRVVEAVAAAAQTGRIGDGKIFVSPIERALRIRTGETDDDAI

SEQ ID NO: 11831 - protein, 415 aa, Unknown
  Dehalococcoides sp. BAV1
MSFLKTSDPAVYNAIMQETTRLKETIDLIASENYTSKAVLEAQGSVFTNKYAEGYPGKRYYAGCEYADAVEELAIDRAKTLFHAEHANVQPHSGAQANMAAYFAMVKPGDTIMGLTLSHGGHLTHGSKVNFTGKLYHVIEYGLNAETERIDYDNLEKLAMEHRPRMIVTGASAYPRILDFERFRAICDKVDAKLMVDIAHIAGLVAAGLHPSPVPYADVVTSTSHKTLRGPRGGFILCKEQYAKAIDQAVFPVMQGGPLMQVVAAKAVAFQEAMQPGFVTYQKKTLENTQVMAEELRKLGLRLVSGGTDNHLVLVDLSPIGVNGYDAQLALRRAGIVINRNTVPFAENQTANVPAGIRLGCPAATSRGFGPAEIRQTVGWIGKILKNIGNEDVEKQVLAEVIHLCRKFPVPGIDI

SEQ ID NO: 11832 - protein, 320 aa, Bacillus cereus
MNISVLGCGRWGTFIAWYANKVGHNVMLWGRENSRNYIELNKTRKNDYLELSKDIELSNSLHKTIVFAEIIIISISAQELRSFANRLNLIDEIQGKTFILCMKGLEATSGKRLSQVFSEIVGKNTNMAVWIGPGHVQDFVNDIPNCMVIGSENISITKKIVQEFNSDLIRFYYGQDLIGNEIGAATKNVMGIAAGMLDGLNYSSLKGSLMARGTRELSRLVTAMGGNDLTIYGLSHLGDYEATLFSLHSHNRKFGEAFVLGQKFDKLAEGVSTVKALKELSKQYDVELPISKALYEILFESKDAKDTLEELFLRPVKFEF

SEQ ID NO: 11833 - protein, 378 aa, Unknown
  Magnetococcus sp. MC-1
MSKDLYEILGVSKGANDAEIKAAYRKLAMKLHPDRNPGNDAAEAQFKEVNAAYEVLKDPQKRTIYDQYGHAGLGQGGPGGPGGFGGQGGAGFGDIFEEFFGDIFGGGRQTRGGGRSGARQGEDYRYDLRVTLEEVARGVEKRVRIPSMSTCDTCHGSGARSGSKPTTCTTCGGAGQIRTQQGFFQVQRACHVCHGKGQIISDPCPDCGGAGRQKKEKTLTVKIPPGVDTGTRIRLSGEGGAGIQGGPAGDLYIITEVEPHSMFERYGVDLLCVVPITFPQAALGAKLEVPTLNGKARITLPAGSQTGKRLVLRSKGLPHLNRPGMLGDLVVEVRVETPVKLTTKQKELLEEFDRCGDPDSQPDSVGFFDKVKEFLGGN

SEQ ID NO: 11834 - protein, 523 aa, Arabidopsis thaliana
MVGSSNSLAGLQDHLKLAREYALEGSYDTSVIFFDGAIAQINKHLNTLDDPLARTKWMNVKKAIMEETEVVKQLDAERRAFKEAPTGRRAASPPINTKSSFVFQPLDEYPTSSGGGPMDDPDVWRPPTRDVTSRRPARAGQTGTRKSPQDGAWARGPTTRTGPASRGGRGGATSKSTAGARSSTAGKKGAASKSNKAESMNGDAEDGKSKRGLYEGPDEDLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCNSRGGSGEHESSRRVKSELLVQVDGVSNTATNEDGSRKIVMVLAATNFPWDIDEALRRRLEKRIYIPLPDFESRKALININLRTVEVASDVNIEDVARRTEGYSGDDLTNVCRDASMNGMRRKIAGKTRDEIKNMSKDDISNDPVAMCDFEEAIRKVQPSVSSSDIEKHEKWLSEFGSA

SEQ ID NO: 11835 - protein, 392 aa, Pasteuria ramosa
MSEEMNSTIPFEIGSLVTGSVTKIDKNQALIKIAEDIEAILPISELSCLRINEVGDMLKLDDELELEVLRLDEEENKFILSKRAVDAKKAWPFLQHKYENNENIEAKVSDVVKGGLVIDLGVRGFVPASLVECHYVEDFSDYKDRVITMKIAEIDQDSNKLILSCRAVHEEAAQHQREATFNNIEIGSVVDGIVRRLTDFGAFVDVGAVDGLVHISQISWQRVNHPSDVLNIGDEVKCKVLKFDRESGRISLSIRDTQPGPWSGVEDQLVENDIVKGVVKRLVSFGAFVEILPGVEGLMHISEISHRHIVTPSEILKEGQEILVKILNVDSNARRVSLTMCDVEQNTSQKSENSSNKQADYDEDDDTFDHQNNRSNNLNVTLGDIYPQLKNF

SEQ ID NO: 11836 - protein, 258 aa, Unknown
  Synechococcus sp. RS9916
MSLPLRTSSLDPVQIPGWRWQPFLDTAVTAMASLQPKAYPIEERFLQKEGSTGSKAKPIPVTTATWACSTEKLRQVRCACVEAGGAASVLNFVINPSCRFDLPFFGADLVTLPNGHLLALDLQPVNKTDPDHTSPVWERLMPLFEHWRAELPDGGPIPDEAQPYFSPAFLWTRIPLGEEGDALIERVIRPAFTDYLQLYLALVEEAEPVDDDRAGLLLSGQKRYTAYRSEKDPARGMLTRFYGSEWTESYIHGVLFDL

SEQ ID NO: 11837 - protein, 417 aa, Escherichia coli
MLKREMNIADYDAELWQAMEQEKVRQEEHIELIASENYTSPRVMQAQGSQLTNKYAEGYPGKRYFGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEAEAKELAGWMCDVLDSINDEAVIERIKGKVLDICARYPVYA

SEQ ID NO: 11838 - protein, 122 aa, Saccharomyces cerevisiae
CMDPNVIELAGYKNDGTRDLSQKHGVILSTTGHDGPFGAFCAKRIVDIDQNQKLGGMKGLDMNHAEHDVVIHSGAYAGVDNMYFAGMEVAELDGLNRMGPTFGAMALSGVHAAEQILKHFAA

SEQ ID NO: 11839 - protein, 351 aa, Bordetella parapertussis
MSQARPATLRVAVLGAGSWGTALAAAASRRHPTVLWARDGAQAQAMAARHENTRYLPGVALPPALQVSADLAQALAHLAHDPAHALIILGVPVAGMTPLCTELAARLPALGLQAVPLVWTCKGFEEQTAHLPHETVQAALGAMPGLAAGVLSGPSFAREVAQGLPVALTVASESSAVRDAVTTALHGAAVRIYASTDVVGVEVGGALKNVIAVACGICDGLALGTNARAALITRGLAEMARFGAALGAQQETFAGLTGLGDLVLTATGELSRNRRVGLEIGAGRKLADILASGMTAEGVRCARAARDRARALNIELPITEAVCAVLFEGLSPMTAVSALLAREARPESPTP

SEQ ID NO: 11840 - protein, 144 aa, Capsicum annuum
MASVSATMISTSFMPRKPAVTSLKPIPNVGEALFGLKSANGGKVTCMASYKVKLITPDGPIEFDCPDNVYILDQAEEAGHDLPYSCRAGSCSSCAGKIAGGAVDQTDGNFLDDDQLEEGWVLTCVAYPQSDVTIETHKEAELVG

SEQ ID NO: 11841 - protein, 524 aa, Ashbya gossypii
MRVSRLGFSCLALAGWASAMIMQNPFSAIMRGEGDAGSTTWLDGLESWPVLGQDGKLAKWYAQGMSEPRNMLQKIALRGSDFEVMRHKSNPDYALRVKKQDPAKLGVDTVKQWSGYLDYKDEKHFFYWFFESRNDPANDPVMLWLNGGPGCSSFTGLLFELGPASIGKDLKPVHNPHSWNNNASVIFLEQPVGVGFSYGDSVDSTAVAGADVYAFLRLFFQKFPHLAKNDFHIAGESYAGHYIPQIAHEIITSKEENSEEIPNFNLTSVLIGNGFTDPRTQYKYYEPMACGKGGVPAVLNEDQCSRMNASSSRCDRLMNLCYLTNRAIPCLAATVYCERYITQVYEETGLNYYDMRRKCESPDSDLCYRGLDYVQQYMNQKEVQEALGSEVELYEGCNKRVGARFALSGDHGKPFQQYVSQLLDRAIPVLIYAGDKDYICNWLGNKAWSDEVGWRHTYKYRTLPLKPWVNKNTGKTAGEVKSFGALTFLRVYDAGHMVPYDQPESSAYMIESWLNKNYNLDYKV

SEQ ID NO: 11842 - protein, 304 aa, Agrobacterium tumefaciens
MTRQMILAVGQQGPIARAETREQVVGRLLDMLTNAASRGVNFIVFPELALTTFFPRWHFTDEAELDSFYETEMPGPVVRPLFETAAELGIGFNLGYAELVVEGGVKRRFNTSILVDKSGKIVGKYRKIHLPGHKEYEAYRPFQHLEKRYFEPGDLGFPVYDVDAAKMGMFICNDRRWPETWRVMGLKGAEIICGGYNTPTHNPPVPQHDHLTSFHHLLSMQCGSYQNGAWSAAAGKVGMEEGCMLLGHSCIVAPTGEIVALTTTLEDEVITAALDLDRCRELREHIFNFKAHRQPQHYGLIAEF

SEQ ID NO: 11843 - protein, 176 aa, Oryza sativa
MPAPEGWTKKFTPQRGGRFEIVFVSPTGEEIKNKRQLSQYLKAHPGGPASSEFDWGTGDTPRRSARISEKVKAFDSPEGEKIPKRSRNSSGRKGKQEKKEATENEEAKDAEADKEAPSEDAPKETDVETKPAEEAKEAPSEDAPKDTDVEMKTAEDASKTADAAPAKESSPVNNGQ

SEQ ID NO: 11844 - protein, 319 aa, Xylella fastidiosa
MTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPAAERGSGMVRKAKELAQQHGWFLASQFSNPANPAYHRNTTAAEILRDFAGRRLDHFVSGWGTGGTLTGVGEVLKIARPDIKITASEPASAALLQGKEWQPHKIQGWTPDFVPEVLNRSVPHHILSVTDDDAITVARRLAAEEGVFSGISGGASVATALQIAQQAEPGAVILAMLPDTGERYFSTPLFADINEHSDDAWLASLG

SEQ ID NO: 11845 - protein, 520 aa, Unknown
  Shewanella sp. ANA-3
  misc_feature (205)..(205): Xaa can be any naturally occurring amino acid
MWHSLYALKVSALGLPPTNAKTGIANRRCQFKRINMNLTVPLTAKDDAIEWALTHGMAFKETAYSARHAPFTLTPSLISKAHYQYLKGAVEPLGKLIHYVSEAHAFLVDAIQPITASDPFFAALLKAHQQLHGSAHSSTNSSGTPAPRMPLLIMRSDFMDDRDLGPKLVEFNGIAAGMGPFGQRAHQLHRYLQQQWSIQPKGELXENHAIEQLSVGIATATFKIKQEFEDSGPARFLMLVQENEDNVFDQHLLELALQQKGIQTLRRTLSELQGQLTTGAQQRLILEGVGTIDTVYLRTGYQFADYATIDINGNRDYQALMEIRVLLEQHRIALNATLGQQLATSKRMQMLLSTMDEQALTQFGLTQPEASMVKSLLGEMRPVTAQSPQLIAESPIETWVLKNQGEGGGHCIFGADILPKLAELEPAQYPVWSLMRRLHPRPRATQALVVRNGEIHIIDDLIPEIGMFSVHCDGIAAVNDKTHAESPSYAGYLIRSKSAKVTEGGVHSGQGVLDSLMFSD

SEQ ID NO: 11846 - protein, 153 aa, Medicago truncatula
MGFTEKQEFLVNSSWESFKQNLPGYSVLFYTIILEKAPAAKGMFSFLKNTPEVKDSPQLQAHAEKVFQMVRDAAVQLRATGEVVLGYTKVGAIHIQRGVVDPHFVVVKEALLKTIKEASGDNWSEELNTAWEIAYDELAISIKKAVKLGMIYC

SEQ ID NO: 11847 - protein, 382 aa, Lolium perenne
MVQPVFDAALLSGQSDIPSQFIWPADESPSPDATEELHVPLIDIGGLLSGDREAAAEVTRLVGDACERHGFFQVVNHGIDAELLADAHRCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNGTLGTGPHCDPTSLTILHQDDVGGLQVHADGRWLSIRPRADAFVVNIGDTFMALSNGRYKSCLHRAVVNSRVPRKSLAFFLCPEMDKVVAPPGTSVDEANPRAYPDFTWRALLDFTQKHYRADMKTLEVFSDWIQQGHQPAATTTTTQDQRTYTASASLHLLACCT

SEQ ID NO: 11848 - protein, 335 aa, Haemophilus influenzae
MITSQTPITVLGAGSYGTALAITFSRNGSPTHLWGHNPVHIAQMQTERQNYRFLPDVIFPEDLHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKNAQDVAISLLGRACKGE

SEQ ID NO: 11849 - protein, 147 aa, Medicago truncatula
MGFTEKQESLVNSSWESFKQNLSGYSVLFYTIILEKAPAAKGMFSFLKDTTGVQDSPQLQAHAAKVFEMVRDSAVQLRATGEVILGDATLGAIHIQKGVVDPHFVVVKEALLKTIKEAAGGNWSEELSTAWEVAYDGLAASIKKSMS

SEQ ID NO: 11850 - protein, 461 aa, Haemophilus influenzae
MGEMASLRSHKNGIIFILDIVLFFVLLNVLPFEPKANSGLALLAFIAVLWLSEALHVTITALLVPLLAVALGLVSTKQALVGFADPTIFLFFGGFSLATALHIQKLDKLIANKIMALARGNLFIAVIYLFLITAFLSMWMSNTATAAMMLPLAMGILSQLDREKDHNTYVFVLLGIAYSASIGGMGTLVGSPPNAIVASNLNLTFSDWLWYGLPIMIILLPLMIGILYIIFKPKLHLNFEQTFENIEMNPMRILTFIIFSVIALTWIFSGKINPFISGLLGLQKNIASFDSIVALLAAIVICSTGVASWKQIQSNTDWGVLMLFGGGLTLSAVLKDSGASKILADSIVFMIDGQHFYLIGLLVAAFIIFLTEFTSNTASAALLVPIFISIAQSLGMPEIGLALIIGIGASCAFMLPVATPPNAIVFGSGQVKQSEMVKVGFLLNLVCVVVIATMGYMFWLK

SEQ ID NO: 11851 - protein, 291 aa, Nocardia farcinica
MSRWDTANIPDQSGRTFIVTGANSGLGAVAARALARAGADVVLACRNLTKAEKVAAEIGARATVRELDLADLASVRAFAAGTERVDVLINNAGVMAVPHRTTADGFEMQIGTNHLGHFALTGLLLDKITDRVVTVSSGAHAVGRIDLADLNWERRRYQRWLAYGQSKLANLLFAYELQRRLGAAGSPILSVAAHPGYAATELQSHTETFLDSVMNVGNRILAQTAEMGALPELFAATMPVEPGAFYGPTGLGGMRGYPGRCGSTKASRDERVAGELWALSERLTGVTYSFD

SEQ ID NO: 11852 - protein, 126 aa, Triticum aestivum
  misc_feature (18)..(18): Xaa can be any naturally occurring amino acid
  misc_feature (42)..(42): Xaa can be any naturally occurring amino acid
  misc_feature (60)..(60): Xaa can be any naturally occurring amino acid
  misc_feature (80)..(80): Xaa can be any naturally occurring amino acid
  misc_feature (91)..(91): Xaa can be any naturally occurring amino acid
RTSESLRFFAPFVIGTSXEPTERNHHELDTSMMDDYKVRLQXTDLATEEDDTTKVVQNIXAQHRYLAWRAEKDPGCPLLXEMIDERHDKDXLAEFLFDGLHSLRNSSLLHYSRGDAWDPVQHIRRR

SEQ ID NO: 11853 - protein, 353 aa, Brassica napus
MGVLDEAFIQAPEHRPKTHLTNSGDYILSNEIPTIDLSSLQDPHCDKTALATEIAEACMRWGFFQVINHGLSLDLMRRVEKTVAEFFSLTLEEKRRVKRDEVNPMGYHDGEHTKNVRDWKEIFDFFLQDSTTVPATTEPEDTELRKLTNPWPQNPSDFREVCQEYAREVEKLAFKLLELISISLGLPGDRLTGYFKDQTSFLRFNHYPPCPNPELALGVGRHADAGVITVLAQDSVGGLQVSRRSDGQWFSVKPNPDAFIINIGNCMQVWTNDKYWSAEHRVVVNSSKERFSMPFFLFPSHDTNIEPLKELISEDNPPCYKKYNWGKFFAARNRSDYKKLQTESIQIDRFKAA

SEQ ID NO: 11854 - protein, 925 aa, Oryza sativa
MASALGAQASVAAPIGAGGYGRSSSSKGSNTVNFCNKSWIGTTLAWESKALKSRHMNKIFSMSVQQASKSKVAVKPLELDNAKEPPLNLYKPKEPYTATIVSVERLVGPKAPGETCHIVIDHGGNVPYWEGQSYGVIPPGENPKKPGSPNTVRLYSIASTRYGDSFDGKTASLCVRRAVYYDPETGKEDPTKKGPSGKIMLLPEDDPNATHIMIATGTGVAPYRGYLRRMFMEDVPSFKFGGLAWLFLGVANTDSLLYDEEFTNYLQQYPDNFRYDKALSREQKNKNGGKMYVQDKIEEYSDEIFKLLDGGAHIYFCGLKGMMPGIQDTLKRVAEQRGESWEQKLSQLKKNKQWHVEAAAQREASGEPTATRGGAQAAPVHGGDPTQINYTEYLDLMKLEVEQHLNKLKEDIRFLKSHSLVHDGDANGSCPMVCHHGKLVEIYEGFNGFKLLLVVVFRQIKEMLSLFSASIRDLQWEHEMQLEVTSIMIGDCIKSLQDELERKLYEQSSIVNTLKKNWKETVVQCGAIHEELIDIADMLLPSEEESNILNSKHEHFGNWSSGWKHKFFGKKSGEERTPSSNEENISSATQKSVCPREVISEKSDFRHLKGMNREEMIKYFRFEISKLKRLHELSLQEKTEELFKFKREKGSLALKYDPEFEPLRKKVPEIISRVDQIILNTINAPTAFSTNQVLEERGRLTGRIDSLYYANQNLRGLLAEKMKDIKDLSRQVSDASRKMSFQLSLEEKLSRQLHKIKGDYEDLHIQSTIRDEVYQTVTKRMFDDYRNSLQDPALTYQEKVTSLEAALSEKETALRLANEENQRLKEKLSKQEKEHGIQNNQDYPELIKQDNEEMILRDIEMEPHVSPRRSYAISEQNAEYEELIKLKQTLEIASTALKEVESNELDYNGILGKNEQEKQLEFILA

SEQ ID NO: 11855 - protein, 178 aa, Bacteroides fragilis
MDTIQIKDKLFTVSIREQEIQKEVIRVANEINRDLAGKNPLFLSVLNGSFMFTADLLKHITIPCEISFVKLASYQGVSSTGSIKEVIGINEDIAGRTIVIVEDIVDTGLTMQRLLETLGTRGPKEIHIASLLVKPDKLKVDLNIEYVAMNIPNDFIVGYGLDYDGFGRNYPDIYTVVD

SEQ ID NO: 11856 - protein, 143 aa, Glycine max
GAFTEKQDALVSSSFEAFKANIPQYSVVFYNSILEKAPAAKDLFSFLANGVDPTNPKLTGHAEKLFALVRDSAGQLKASGTVVADAALGSIHAQKAVTNPEFVVKEALLKTIKEAVGDKWSDELSSAWEVAYDELAAAIKKAF

SEQ ID NO: 11857 - protein, 33 aa, Cucurbita pepo
  misc_feature (26)..(26): Xaa can be any naturally occurring amino acid
MTRRYWNIHLEEMMEAGVHFGHGTRXWNPRMAP

SEQ ID NO: 11858 - protein, 541 aa, Unknown
  Acinetobacter sp. ADP1
MKSFKIALAQFSPHIGNIDSNAQRMVEQANEAKKQNADLIIFPELSVIGYPAEDLLLRPNLNKRMQKAFQQLKEVKDIVMVFGFVHQTEEGHRYNSAAVMKDGVVLGVYNKHNLPNYSVFDEKRYFSPGHQHLVFEYLGHKFGVLICEDIWSINTVKQLSKLNVETVLVLNASPYEVGKPQHRVQTLTELSKQLNVHLVYLNQVGGQDDLIFDGSSFIINHDGEVAFQAPSFKEELYYSEFDIEQKRYKKIDPAPALDTIAEIYQSLVMATRDYVQRSGFSGVILGLSGGIDSALTLAIAADAIGADKVQAVMMPYTYTSQISVEDATEQARRMGVTFGIAEIHPIVNSFMQTLYPFFGNAPADATEENLQARARGTLLMGLSNKFGNLVLSTGNKSELAVGYCTLYGDMVGGFAVLKDVYKTIVFELAKYRNTLSETPVIPERVITRPPSAELRPDQKDQDSLPAYDILDAILYAYIEEDQSQSDIIAKGFDKEVVEKVIRLVDRNEYKRRQGAIGPRISSRAFSRERRYPIVNGWRPDD

SEQ ID NO: 11859 - protein, 369 aa, Burkholderia vietnamiensis
MRMYVDVVVIGGGQAGLATAYFLRRAGIDYVVLDDQSAPGGAWRHTWESLHLFSPAEWSSLPGWQMPISHSTYPSRNHVVDYLANYERRYHLPVQRPVHVEAVSRTSEGLLVTTDRGEWLAQAVVSATGTWSAPYIPDYPGREMFRGRQIHSAQYRNPDDLSGLAVLVVGGGNSGAQILAEVSTVCSATWVTLHEPVFLPDDVDGRILFERATAKWKALRDGQATGVPVGGLGDVVMVPPVRDARTRGVLHTVRPFSHFDADGVVWADGSRSHVDAVIWCTGFRPSLGHLDALQIRDADGLVRTDGTRAKDEPRLWLVGYGEWCGAASATLIGVMRSARDTAREIAEYLRSTHEQDASAPRPVSGGGVR

SEQ ID NO: 11860 - protein, 424 aa, Parvularcula bermudensis
MSQSSMFPEAGAAPLAYASSLAFVPTRAAALARLDAFAPNMGSLYAKNRNRDDGPADRRYVSCLSPYLRHRLITEQEVIAAALNRFAFSTAEKFIQEVYWRTYFKGWLERRPWVWDLYTDDRDRRLNELSGDQATAYQAAVEGRTGIDGFDAWTKELIATGYLHNHARMWFASIWIFTLRLPWSLGADFFHRHLLDGDAASNTLSWRWVGGLHTKGKTYLARPSNIEKFTNGRFSPSPEDLAKEAPALEDDWNGEPGDPPGDLPLTSRDPAFLLLHEEDLGLETLPVEKARLVGVGLFVDPACRSAAPVGGLVSQFTQGAIDDTRHRAKTVVGCDAVIVPDEDNLLEAVTAAGANTVILPYLPVGPLRGPVARMTGRLAAEGFRVETMLRSHDRHAWPHASKGFFRLKKKIPSLIARERTPSLL

SEQ ID NO: 11861 - protein, 140 aa, Emericella nidulans
MARTKQTARKSSKSTGGKAPRKQLASKAARKAAPSTGGVKKPHRYKPGGTVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 11862 - protein, 238 aa, Pinus pinaster
VSTPHSLGILSASEPPSIGRFRRGYDRVILKPLLNFLRTTGAPFMINPYPYFGYTDKTLNYALFKPNQGVFDNNTGITYTNMFQAQLDAVYSAMKLLGFSDVDIVVAETGWPSVGDPDQTAVNVENALSYNGNLIKLVNSNAGTPLMPNKTFDTYIFSLFNEDLKPGPTAERNFGLFKPDMTMVYDVGQCNSCAYFYGTSNTGHPSTYFYSTSNTDHPCTYFYSTSNTDHPGTSYRNR

SEQ ID NO: 11863 - protein, 90 aa, Glycine soja
GINISGTNGEVMPGQWEYQVGPSVGIEAGDHIWASRYILERITEQAGVVLSLDPKPIEGDWNGAGCHTNYSTKSMREDGGFEVIKKAILN

SEQ ID NO: 11864 - protein, 714 aa, Silicibacter pomeroyi
MFDVTTKSMQWGEETLTLESGKIARQADGSVVATLGETRVMANVTFAREQKPGQDFFPLTVHYQEKYYAAGKVPGGFFKREARPTEKETLTARLIDRPIRPLFVPGFKNEVLVMCTVLSHDLVNDPDIVAMIAASAALTISGVPFMGPIAGCRVGYVDGEYVLNPTVDDMQDLRLNPEQRLDLVVAGTKDAVMMVESEAYELTEAEMLGAVTFAHAQIQPVVDLIVSFAEQCAKEPFDFTPPDYSDLYAAVKAAGEEQMRAAFAITDKQERTAAVAAAREAIKAALTEEQLADGNLGSALKKLEAGILRGDVVKGGKRIDGRDTTTVRPIVAETGLLPRTHGSALFTRGETQGLVVTTLGTGDDEQFIDALHGNFKSNFLLHYNFPPYSVGEVGRVGSPGRREIGHGKLAWRALQAVLPAPTDFPYTIRVVSEITESNGSSSMASVCGGSLSMMDAGVPLKSAVAGVAMGLILEDDGSYAVLTDILGDEDHLGDMDFKVAGTENGITSLQMDIKVAGITPEIMEKALSQAKDGRMHILAEMNKALSGAADFSVHAPRIETMQIPTDKIREVIGSGGKVIREIVEVSGAKVDINDDGIIKIASPNGDSIKKAYDMIWSIVAEPEEGQVYTGKVVKIVDFGAFVNFFGKRDGLVHVSQIENRRLNHPSDVLKEGQEVKVKLLGFDDRGKVRLSMKVVDQETGEEIVPEKKEASEAE

SEQ ID NO: 11865 - protein, 136 aa, Emericella nidulans
MPPKAAEKKPSTGGKAPAGKAPAEKKEAGKKTAAAASGEKKKRGKTRKETYSSYIYKVLKQVHPDTGISTRAMSILNSFVNRVATEASKLAAYNKKSTISSREIQTSVRLILPGELAKHAVSEGTKAVTKYSSSAK

SEQ ID NO: 11866 - protein, 96 aa, Glycine canescens
LYAGINISGTNGEVMPGQWEYQVGPSVGIEAGDHIWASRYILERITEQAGVVLSLDPKPIEGDWNGAGCHTNYSTKSMREDGGFEVIKKAILNLSL

SEQ ID NO: 11867 - protein, 237 aa, Pinus yunnanensis
MAREGERGQVKLLGATLSPFVVRVRIALALKGIDYEFIQEDLKTKSELLLQSNPVYKQIPVLAHNGKPVCESMIIVQYIEEAWDNKAPNLMPKDPYDRAIARFWAAFIDDKLFPYLRAALFGQGEQLQKAVEDSVTNFLLIEEALRTNRCFAGKAYFGGDEIGLIDIALGGMSTFIKAVEKATDSVLIDPEKMPLLTAWMDRFCKSDGVKEVMPDPVKHAEYLCARRASMVSPPTGN

SEQ ID NO: 11868 - protein, 363 aa, Lolium perenne
MVQPVFDAALLSGQSDIPSQFIWPADESPSPDATEELHVPLIDIGGLLSGDRVAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 11869 - protein, 409 aa, Unknown
  Candidatus Kuenenia stuttgartiensis
MKPFDHTLYRKVLVMLLAGGKGERLYPLTRDRAKPAVPFGGIYRIIDFTLSNCINSGLRKICVLTQYKSYSLDRHLRVGWNIFNTELDEFIENIPPQKRTNEMWYLGTADAVYQNIYVLESERPEMVLVLAGDHIYKMDYAELINYHITNEADLTVPCIEVPLEDATRFGVVAIDNDSRIIDFDEKPSNPKPLPTNQNVALVSMGIYLFNTEVLVRRIIENAKNDTNRDFGKNIIPTMIQKDRVLSFVFNGNEHNTSNYWRDIGTLDAYWEANIDLVKKNPDFDLFDNRWPIRTYNKQYPPAKYIFENEKNGMIKDALISNGCLINDASIVKSIISPCVTIGAQSSVIGSIIMEGVRIGENVKIKNAIIDKHVTIPDGMKMGYDLQDDGKQFTVTEKGIVVAHKEMHLI

SEQ ID NO: 11870 - protein, 106 aa, Unknown
  Candidatus Protochlamydia amoebophila UWE25
MSDKLVHLNDDNFQQTISQGVTLVDFYATWCGPCRMIAPIVEQLSTTLQGKAKVAKLDIDQAQSTTADLQITSVPTLIVFKDGKEVKRVVGVKDLDYLLNLVQSFT

SEQ ID NO: 11871 - protein, 237 aa, Pinus densata
MAREGERGQVKLLGATLSPFVVRVRIALALKGIDYEFIQEDLKTKSELLLQSNPVYKQIPVLVHNGKPVCESMIIVQYIEEAWDNKAPNLMPKDPYDRAIARFWAAFIDDKLFPYLRAALFGQGEQLQKAVEDSVTNFLLIEEALRTNRCFAGKAYFGGDEIGLIDIALGGMSTFIKAVEKATDSVLIDPEKMPLLTAWMDRFCKSDGVKEVMPDPVKHAEYLCARRASMVSPPTAN

SEQ ID NO: 11872 - protein, 414 aa, Campylobacter jejuni
MSLEMFDKEIFDLTNKELERQCEGLEMIASENFTLPEVMEVMGSILTNKYAEGYPGKRYYGGCEFVDEIETLAIERCKKLFNCKFANVQPNSGSQANQGVYAALINPGDKILGMDLSHGGHLTHGAKVSSSGKMYESCFYGVELDGRIDYEKVREIAKKEKPKLIVCGASAYARVIDFAKFREIADEVGAYLFADIAHIAGLVVAGEHPSPFPHAHVVSSTTHKTLRGPRGGIIMTNDEELAKKINSAIFPGIQGGPLMHVIAAKAVGFKFNLSDEWKVYAKQVRTNAQVLANVLMDRKFKLVSDGTDNHLVLMSFLDREFSGKDADLALGNAGITANKNTVPGEIRSPFITSGLRLGTPALTARGFKEKEMEIVSNYIADILDDINNEKLQENIKQELKKLASNFIIYERAMF

SEQ ID NO: 11873 - protein, 243 aa, Zea mays
MGRDGGDGELKLLGLWASPFVARAKLALQIKGLSYEYVEEDLGNKSELLLSSNPVHKTVPVLIHNGTPVCESTVIVQYIDDAFAGTGPSLLPADPYQRALARFWAAYLEDKIVTPWRRVFMVKADEEKAEAMRQTVAAMDALEGGLKECSSGGGGQSPFFGGDSVGYVDVLLGGMVSWVKASEPLSGAKIIDAARTPLLAAWMERFCELDAAKAVLQDVHEVVEYARTMQMQARVAAATASNQ

SEQ ID NO: 11874 - protein, 363 aa, Lolium perenne
MVQPVFDAALLSGQSDIPSQFIWPADESPSPDATEELHVPLIDIGGLLSGDRAAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEAYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPETLVDEANPRAYPDFTWRALLDFTQKHYRADMKTLEVFSDWIQQGHQPAATTTTT

SEQ ID NO: 11875 - protein, 408 aa, Unknown
  Pseudomonas sp. Cam-1
  misc_feature (36)..(36): Xaa can be any naturally occurring amino acid
  misc_feature (51)..(51): Xaa can be any naturally occurring amino acid
  misc_feature (104)..(104): Xaa can be any naturally occurring amino acid
  misc_feature (119)..(119): Xaa can be any naturally occurring amino acid
MIDTIAIIGAGLAGSTAARALRAQGYEGRIHLLGDXSHQAYDRTTLSKTVXAGEQPEPPAILDSAWYASAHVDVQLGRRVSCLDLANRQIQFESGAPLAYDRLXLATGARARRMAIRGXDLAGIHTLRDLADSQALRQALQPGQSLVIVGGGLIGCEVATTARKLSVHVTILEAGDELLVRVLGHRTGAWCRAELERMGVRVERNAQAARFEGQGQVRAVICADGRRVPADVVLVSIGAEPADELARAAGIACARGVLVDATGATSCPEVFAAGDVAAWPLRQGGQRSLETYLNSQMEAEIAASAMLSQPVPAPQVPTSWTEIAGHRIQMIGDAEGPGEIVVRGDAQSGQPIVLLRLLDGCVEAATAINATREFSVATRLVGTRVSVSAEQLQDVGSNLRDLLKAKPN

SEQ ID NO: 11876 - protein, 430 aa, Herminiimonas arsenicoxydans
LREGKDISEIRDSLMFGEANTTRPGDTGHEGFSKAAAMPDSAEVCGCNGVCKGTIVKAIKEKGLFTIEDVRKHTKASASCGSCTGLVEQIIMATAGGDYSASSKAKSMCGCTDHTHQEVRDAIRAEKLLTVATTMERMNWRTPNGCTTCRPAINYYLISTWPHEARDDPQSRYINERAHANIQKDGTFSVIPRMWGGETSSSELRRIADVVDKFKIPTVKVTGGQRIDLLGVKKEDLRAVWHDLGMPSGLAYAKGLRTVKTCVGSEWCRFGTQDSTRMGQQLEHQLARMYAPHKVKLAVSGCPRNCAESGIKDVGIIGVDSGWEIYVGGNGGIKTEVAEFFVKLKTHEEVLEYAGAFLQLYREEGWYLERTVHYLARVGLEHAKQKVIEDAENRKALYERLLFSLEGEADPWHEPEKAMVDTRQFESLSV

SEQ ID NO: 11877 - protein, 362 aa, Lolium perenne
MVQPVFDAALLSAQSDIPSQFIWPADESPTPDATEELHVPLIDIGGLLSGDREAAAEVTRLVGDACERHGFFQVVNHGIDAELLGHARCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 11878 - protein, 269 aa, Nelumbo nucifera
MAASVIMTLSSPSLAGKALKLTGFTSKNLGEGGFTMRSTLSRPRQSITGGPWYGPDRVKYMGPFSGQTPSYLTGEFPGDYGWDSAGLSAEPETFAKNRELEVIHARWAMLGTVGCIVPELLERNGVKIGEAVWFKAGSQIFRDEGLNYLGDPKLIHAQNILAVLAAQVILMGAIEGYRISGGPLGEPTDPLYPGGNFDPLHLADDPEEFAILKVKEIKNGRLAMFAMLGFYVQAIVTGKGPLENLYDHLADPFKNNAWAFATAFDPSNS

SEQ ID NO: 11879 - protein, 152 aa, Haemophilus influenzae
  misc_feature (91)..(91): Xaa can be any naturally occurring amino acid
MQTTTRTLTQHKRIALVAHDSCKKNLLNWTQKHKEALKPHILYATGTTGHILERETGLSIQSLLSGPMGGDQQLGGLIAEKKIDMMIFFWXPMNAAPHEPDVKALMRIATVWNIPVAINQSSADFLLTSVLFEQDVEIDVPDYEGYLKERLA

SEQ ID NO: 11880 - protein, 551 aa, Arabidopsis thaliana
MENMFRLMDQDQDLTNNRCIWVNGPVIVGAGPSGLATAACLHEQNVPFVVLERADCIASLWQKRTYDRLKLHLPKQFCQLPKMPFPEDFPEYPTKRQFIDYLESYATRFEINPKFNECVQTARFDETSGLWRVKTVSKSESTQTEVEYICRWLVVATGENAERVMPEIDGLSEFSGEVIHACDYKSGEKFAGKKVLVVGCGNSGMEVSLDLANHFAKPSMVVRSSLHVMPREVMGKSTFELAMKMLRWFPLWLVDKILLVLSWMVLGNIEKYGLKRPEMGPMELKSVKGKTPVLDIGAIEKIRLGKINVVPGIKRFNGNKVELVNGEQLDVDSVVLATGYRSNVPYWLQENEFFAKNGFPKTVADNNGWKGRTGLYAVGFTRKGLSGASMDAVKIAQDIGSVWQLETKQPTKRSRGSLRRKKKIRVLGQRSLTKEKSPLLKTQSESKGVVRVFLLPPPLSVLGVLCKQRKMWPFVFYFFTIFFFTYIFNNYFLGVGSLIFLYKFMLTSILYTLFYFFLSQIYFDFNLPSFYSLANLSYFPLTEQITMFFRQ

SEQ ID NO: 11881 - protein, 394 aa, Haemophilus influenzae
MYLFSATNYKITMAKKDYYEVLGLQKGASEDEIKRAYKRLASKHHPDKNQGSKEAEEKFKEINEAYEVLGDDQKRAAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRNCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 11882 - protein, 487 aa, Pichia anomala
MSDITLGRYLFERLNQVKVQTIFGLPGDFNLSLLDKIYEVEGLRWAGNANELNAAYAADGYSRVKGLSAIITTFGVGELSALNGIAGSYAEHVGVLHIVGVPSISSQAKQLLLHHTLGNGDFTVFHRMSSNISQTTAFIKDINSAPAEIDRCIREAYVFQRPVYLALPANLVDDLVSSDLLSTPIDLSLKPNDPESENEVVSTVLELIKKADNPVILVDACASRHSALAETKDLMDLTQFPTFVTPMGKGAVDEQHPRFGGVYVGTLSKPDVKAQVENADLILSVGALLSDFNTGSFSYSYKTKNIVEFHSDHIKIRNATFPGVQFQSVLQNLNSKIAPVVKGYKPYPVPSLKLTTSPASPETPLTQEWLWTKLSSWLREGDVVITETGTSAFGIVQTRFPSNTTGISQVLWGSIGYSVGAALGAVAGAEEVDKEKRVILFVGDGSLQLTVQEISTMIRWGLTPYIFVLNNAGYTIERLIHGEKSFL

SEQ ID NO: 11883 - protein, 417 aa, Haemophilus influenzae [sequence omitted]

SEQ ID NO: 11884 - protein, 383 aa, Aspergillus sulphureus
MKLSSSLLTLASLALANLSTALPKASPAPSTSSSSASTSFASTSGLQFTIDGETGYFAGTNSYWIGFLTDDSDVDLVMSHLKSSGLKILRVWGFNDVTTQPSSGTVWYQLHQDGKSTINTGADGLQRLDYVVSSAEQHGIKLIINFVNYWTDYGGMSAYVSAYGGSDETDFYTSDTMQSAYQTYIKTVVERYSNSSAVFAWELANEPRCPSCDTTVLYDWIEKTSKFIKGLDADHMVCIGDEGFGLNTDSDGSYPYQFAEGLNFTMNLGIDTIDFATLHLYPDSWGTSDDWGNGWISAHGAACKAAGKPCLLEEYGVTSNHCSVESPWQQTALNTTGVSADLFWQYGDDLSTGESPDDGNTIYYGTSDYECLVTDHVAAIDSA

SEQ ID NO: 11885 - protein, 595 aa, Zea mays
MITGTDFYHVMTAVVPLYVAMILAYGSVRWWRIFSPDQCSGINRFVALFAVPLLSFHFISTNNPYTMNLRFIAADTLQKLMVLAMLTAWSHLSRRGSLEWTITLFSLSTLPNTLVMGIPLLKGMYGDFSGSLMVQIVVLQCIIWYTLMLFMFEYRGARMLITEQFPDNAGAIASIVVDPDVVSLDGRRDAIETEAEVKEDGRIHVTVRRSNASRSDIYSRRSMGFSSTTPRPSNLTNAEIYSLQSSRNPTPRGSSFNHNDFYSMVGRSSNFGAADAFGIRTGATPRPSNYEDDASKPKYPLPVVNATSGAGAAHYPAPNPAVAAAPKGARKAATNGQAKGEDLHMFVWSSSASPVSDVFGGGAPDYNEAAAAKSPRKMDGGKDRDDYVERDEFSFGNRGAMDRDAGTRDGKAAAAGGDPSTVAAPTAMPPTSVMTRLILIMVWRKLIRNPNTYSSLIGVIWSLVCFRWNFQMPAIVLQSISILSDAGLGMAMFSLGLFMALQPRIIACGNKVATFAMAVRFLTGPAVMAAASFAVFFRGTLLQRRNEQAALPQGIVPFVFAKEYNVHPDILSTAVIFGMLIALPITLVYYILLGL

SEQ ID NO: 11886 - protein, 431 aa, Clostridium thermocellum
MSISEMAFQVKEASIRLAAAGTELKNKALENIARLLMERKDEIIKANNEDLQRSREEKLAEPLLKRLKFDEAKIVDVIDGINSLIKLEDPVGKTLLSTELDEGLELYRVTCPIGVVGIIFESRPDALVQISTLCLKSGNGVLLKGGSEARETNKILAQIITEATEEVGIPPNWIKLLETRADVNEMLKMDKYIDLIIPRGSNEFVRYIMDNSRIPVMGHADGICHCYIDEDADIDMAIRIVVDSKTQYVAVCNATETLLVHKNIAPKVLPELKRALDSKNVELVGCSETQKIIPVAPATEEDWRTEYLDYKLSVKVVGDLEEAIEHINTYGSGHTDSIITNSKEKAAAFMSLVDSGNVFWNCSTRFSDGFRYGFGAEVGISTSKIHARGPVGLDGLLIYKYKLIGNGHIVEDYAKRTKSFKHNKMNKQFPL

SEQ ID NO: 11887 - protein, 332 aa, Unknown
  Polaromonas sp. JS666
MRYESILDAIGHTPLVRLNQLTRHLSCAVYAKLEFLSPGGSVKDRIGMYMIQQAERRGEIGPGATIVECTSGNTGMGLALFAAGRGYKTVFTIADKQSKEKVDMLRAMGAEVIVCPTDVPPDDPRGYIQAAQRLARDIPGAFLCNQYDNPDNTLAHYASTGPEIWNDTGGMVTHFVCGMGTCGTISGAGRYLKEQNAMVRVIGVDPQGSIFHELFHRGVTVQPHVYRLEGIGEDFIPKALDWHVIDDVIQVSDQGSFLMARRLARDEGIFAGGSSGAAMLAALQVAEKLGPNDLMVVLLPDGGRQYLGKLYNDDWMREHGYLDAKPDSAPRS

SEQ ID NO: 11888 - protein, 113 aa, Chlorobium tepidum
MKYIVAMIQPHKLPDVKKSLAAAGIRKMTVTNALGCGAQGGYTEMYRGIPSEVNLLKKVKLEIAVNEEFADATVKAIIKGAKTGEIGDGKIFIFDLPECIRIRTEEKGHAAIG

SEQ ID NO: 11889 - protein, 677 aa, Unknown
  marine gamma proteobacterium HTCC2143
MVTVGDVQVLCTVVGAKSAKEGMDFFPLGVHYQEKSYAVGKIPGGFFKREARPSEKETLTSRLIDRPMRPLFPKGFKNEVQVVCTVMSADHDTDPDIAALIGTSAALSISGLPFGGPVGAARVGFTADNGYILNPSYSQLAGSALDMVVAGTSDAVLMVESEAQELSEDQMLGAVLFAHQEMQTVIKVIGELASEAGKPSWNWQPEEENTALLAAVANGYKQGIGDAYRITDKADRYSKVGELKTQAIEQLAKAEGAEYGAGDVSGVFSKLEKSTVRQRILNGEPRIDGRDNNTVRPIQAEVGVLAKAHGSALFTRGETQAIGVTTLGTTRDAQLIDALEGKREDNFMLHYNFPPYSVGECGRIGFTSRREVGHGRLARRGVAAVLPNPEDFPYTIRVVAEITESNGSSSMASACVASMSMMEAGVPLKAPVAGIAMGLIKEGERFAVLTDILGDEDHLGDMDFKVAGTANGVTALQMDIKIEGINEQIMSIALEQALTARLHILGQMNAVISESRSAVSDNAPSMATFKIDSDKIRDVIGKGGATIRSITEETGATVDIDDDGTIRIYGSDAASRDAAVAKVEEITAEAEVGAIYEGTVARIVDFGAFVNILPGKDGLVHISQISNERVEKVTDYLAEGQVIKVKVLDVDQRGRIKLSMKEMEEVVVETSGDAAGE

SEQ ID NO: 11890 - protein, 572 aa, Sulfolobus solfataricus
MPTGARILVDSLKREGVKVVFGIPGLSNMQIYDAFVEDLANGELRHVLMRHEQAAAHAADGYARASGVPGVCTATSGPGTTNLTTGLITAYWDSSPVIAITGNVPRSVMGKMAFQEADAMGVFENVTKYVIGIKRIDEIPQWIKNAFYIATTGRPGPVVVDIPRDIFYEKMEEIKWPEKPLVKGYRDFPTRIDRLALKKAAEILINAERPIILVGTGVVWANATPEVLELAELLHIPIVSTFPGKTAIPHDHPLYFGPMGYYGRAEASMAALESDAMLVVGARFSDRTFTSYDEMVETRKKFIMVNIDPTDGEKAIKVDVGLYGNAKIILRELIKAIITLGQKRDKSAWIKRVKEYKEYYSQFYYTEENGKLKPWKIMKTIRQSLPRDAIVTTGVGQHQMWAEVFWEVLEPRTFLTSSGMGTMGFGLPAAMGAKLARPDKIVVDLDGDGSFLMTGTNLATAVDEHIPVISVIFDNRTLGLVRQVQDLFFGRRIVGVDYGPSPDFVKLAEAFGALGFNATTYEEIEKSIKSAIKEDIPAVIRVPVDKEELALPTLPPGGRLKQVILRDPRKSS

SEQ ID NO: 11891 - protein, 83 aa, Glycine max
  misc_feature (63)..(63): Xaa can be any naturally occurring amino acid
QNQKQRHTIKQKPTKYYKAIKNKPYPKSHFYHNIPNPKIKIYNINIKQTNINKFPFYIHLINXKTANISNKTLKTTRITYNKY

SEQ ID NO: 11892 - protein, 197 aa, Bradyrhizobium japonicum
MRTATIKRKTKETDIEVTVNLDGTGVSNIATGIGFFDHMLDLLARHSRIDLTVKAVGDLHIDHHHTTEDTGIALGQAVKQALGTMAGITRYAGVHMPMDETLSRVVIDISGRPVLVFKVDFPRDKIGEFDTELVREWFQAFAMNASVTLHVETLYGDNSHHIAESCFKGLARALRAAVAIDPKAAGEIPSTKGSLGG

SEQ ID NO: 11893 - protein, 359 aa, Streptomyces coelicolor
MPHMTAFARNQWYVAAYSHEVGRELLGRTVLGEPLVLYRAEEDGGPVVLHDRCVHRRYPLSEAPTRLDGDRIVCGYHGFTYDTTGTCVYVPGQKRVPRTARVASYPVAERDSLVWVWIGDPALADPEAVPRARHLDAPGWVTVRGMEPIDADYGLLVDNLLDLSHETYLHGGHIGTPEVAETPITTEVDEGAGIVRVSRHMDDAECPPFYARSTGIVGRIDRWQDIEYHAPCLYVLHSRVAPTGTVPAPDGGDPEGFHTEITYAITPSGDGKVYDFWAVSRDWATDDAEVTEFLYKSNRTVVMQDVDALNLLQRTLGGERAGYQELSINIDTGGLAARRILARLVEEGEGAGTGPRVAR

SEQ ID NO: 11894 - protein, 96 aa, Glycine falcata
LYAGINISGTNGEVMPGQWEYQVGPSVGIEAGDHIWASRYILERITEQVGVVLSLDPKPIEGDWNGAGCHTNYSTKSMREDGGFEVIKKAILNLSL

SEQ ID NO: 11895 - protein, 367 aa, Prochlorococcus marinus
MSATPTEQVQDSAADSTSSEQVINTTSETAEAAKQALAEEDLSIPEDVPTADDPSSRAAKNDLSGAGFTLDEFASLLSKYDYNFKPGDIVNGTVFALESKGAMIDIGAKTAAFMPLQEVSINRVEGLSDVLLPGEIREFFIMSEENEDGQLSLSIRRIEYQRAWERVRQLQKEDATIYSEVFATNRGGALVRVEGLRGFIPGSHISTRKPKEELVADFLPLKFLEVDEERNRLVLSHRRALVERKMNRLEVGEVVIGAVRGIKPYGAFIDIGGVSGLLHISEISHEHIETPHSVLNVNDQMKVMIIDLDAERGRISLSTKALEPEPGDMLTDPQKVFDKAEEMAARYKQMLLEQAEEGEDPEVVPLD

SEQ ID NO: 11896 - protein, 472 aa, Prochlorococcus marinus
MTKAHFGLVGLGVMGENLVLNAERNGFSSVVYNRTYQKTEDFLLGRGVNKSIQGAKDLQEFVSKLERPRRVLMMVKAGAATDAVINQISPFLEEGDLLIDGGNAQFMDTERRVKELESKSFGYIGMGVSGGAKGALEGPSMMPGGTKTSYDAIESLLNKMAAQVEDGPCVTYIGPGGSGHFVKTVHNGIEYGIEQILAEAYDLMKRVCGMSGDEMASVMGYWNKTEELSSYLVEITEACLRVKDPDDSSDLVEKIMDKAGQKGTGLWTVVSALELGASVPTIYASLNGRVMSSMKDQRNYAETILNGNKPSFVDFGKPSDGMPLLMDAVVLATIASYAQGMDILRLASEEYDYDLDMPSIAQIWKGGCIIRSTLLSRIQDAFKKDPSLTNLIIDKWFTDQVNNRLSGLTQVVSAAANAGIPVPCLSSTLDYLNSFRTSRLPQNLVQAMRDCFGSHTYERVDKAGSFHTEWID

SEQ ID NO: 11897 - protein, 421 aa, Neisseria meningitidis
MSEALAKETLNPFEIARKQVKTACDRLKTDPAVYEILESPTRVLEVNFPVKLDDDTVKTFTGYRSQHNNAVGPYKGGVRFHPGVNLDEVKALSIWMTIKCCVAGIPYGGGKGGITLDPRDYSEAELERIARAYSEAISPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEALFKEFQEKGFITNEAGYGKEITNAELLALDVDVLAPCALENQLTSENAGKVRAKIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 11898 - protein, 378 aa, Bordetella parapertussis
MTAQTSAVSVISAANRLVAKVGSSLVTNEGRGLDRAAVDHWAAQIAALHQQGKQVVLVSSGAIAEGMARLGWRKRPSAMHELQAAAAVGQMGLCQAYEAAFAEFGLRTAQILLTHEDLADRHRYLNARSTLFALLRLGVVPIVNENDTVVTDEIRFGDNDTLGALVTNLIEADALIILTDQRGLYEADPRCDPAARFVAHAQAGDAALEAMAGGAGSGVGTGGMLTKILAAKRAAHSGAHTVIASGRERNVLTRLAQGECIGTELRAVLPVWSARKQWLADHLRLRGRVVLDDGAVHALLHEGKSLLPIGVAEVQGEFERGDVVACVDMHGRECARGLINYSSADTRRILRQPSSQIARILGSMTDPELMHRDNLVVT

SEQ ID NO: 11899 - protein, 131 aa, Thiomicrospira crunogena
MRLLHTMLRVGDLQKSIDFYTNVLGMKLLRQKEYPKGEFTLAFLGYGSEEDHTVIELTYNWGVSSYDLGEGYGHIAIEVDDVYDAAEAVKKAGGKIIREAGPMNAGSTIIAFAEDPDGYQIEFIGADHTRA

SEQ ID NO: 11900 - protein, 706 aa, Neisseria meningitidis
MFDKHVKTFQYGNQTVTLETGEIARQAAAAVKVSMGDTVVLVAVTTNKEVKEGQDFFPLTVDYLERTYAAGKIPGGFFKREGKQSEKEILTSRLIDRPIRPLFPEGFYHDIQIVAMVVSVDPEIDSDIPAMLGASAALVLSGVPFAGPIGAARVGYINGVYVLNPTKAELAKSQLDLVVAGTSKAVLMVESEAKILPEDVMLGAVVYGHDQMQVAINAINEFADEVNPELWDWKAPETNEELVAKVRGIAGETIKEAFKIRQKQARSAKLDEAWSAVKEALITEETDTLAANEIKGIFKHLEADVVRSQILDGQPRIDGRDTRTVRPLNIQTGVLPRTHGSALFTRGETQALAVATLGTSRDEQIIDALSGEYTDRFMLHYNFPPYSTGEVGRMGAPKRREIGHGRLAKRALLAVLPKPEDFSYTMRVVSEITESNGSSSMASVCGGCLSLLSAGVPLKAHVAGIAMGLILEGNKFAVLTDILGDEDHLGDMDFKVAGTTEGVTALQMDIKIQGITKEIMQIALAQAKEARLHILDQMKAAVAGPQELSAHAPRLFTMKINQDKIREVIGKGGETIRAITAETGTEINIAEDGTITIAATTQEAGDAAKKRIEQITAEVEVGKVYEGTVVKILDNNVGAIVSVMPGKDGLVHISQIAHERVRNVGDYLQVGQVVNVKALEVDDRGRVRLSIKALLDAPAREENAAE

SEQ ID NO: 11901 - protein, 585 aa, Candida glabrata
MNLLVKGSLVNIGLRSGILRRSIKRCFKMEALNNQNIEDSKKRQALQKNNQPLKKRPKLKRYKAKKVDPTSPLGVLQFEIDELLRENNLEKSQVENDVTAILNDTSFVTGPIASKYHREVSDVKVLKLGSNGDGLAIIPNPVETDKKQVAIVPFGLPGDLVRIKVFKTHPLYVESDLLDVIEKSPIRKDELIKDKYFGKYSGSQFEFLDYSEQLKIKKSTIANAYKHFAPLLLAESLVPEISDTVASPLQYGYRTKITPHFDMPHKVKQLEVRPPLGFGQKGRPKWRKETLEVGGTGPILDIEECALATDILNKGLSNERARFEKEFKNYKKGATILLRENTIILDPSKPTEEQLEEGSRDENGDISFIEVTDETTGVKLAKTCVTNTRQIVTEYVDGYTFKFSAGEFFQNNNSILPLVTKYVRDNLQLGNGDKPRYLVDAYCGSGLFSICSSKGVDKVIGVEISADSVSFAERNAKNNGVENCKFIVGKAEKLFESIDTPADSTSVILDPPRKGCDELFLKQLAAYNPARIVYISCNVHSQARDVQYFLKDTPEGKNYRVESIRGFDFFPQTHHVESVCVLSRV

SEQ ID NO: 11902 - protein, 655 aa, Clostridium perfringens
MRRKFNSKEFNDKYYYDGELGAIYNKEETIFRVWSPEAKSLELLLYRDGNKESLIERDLLHKKSNGLWELVKKGDLNGVYYKCHIVGEDFEHDFVDPYCKALGVNGYRAMVIDLKKTNPKGWENEKKPSLENPLDSILYEMHIRDFSIDKSSGVSLENRGKFLGIVEENTKVPGTEVKTTLDHLKELGITHVHLLPSFDFGTVDEERLDEEQYNWGYDPVNYNVPEGSYSKNPYKGEVRIKEFKEMVLKLHRAGIRVIMDVVYNHTYSGENSNLNLSYPGYYHRQDDFGNFSNGSGCGNELASERLMVRKYMVDSLKYWAKEYHIDGFRFDLMALHDIETLKEIREELNKIDPSILIYGEGWNGGDSPLPKEEACFKCNIGKFDKLQIAAFSDDMRDGIKGYVAHLKEGGFVNGGEDFEESIKFGIVASTYHEGVDYNKVNYSDSPWANEPYQTVNYCSAHDNNTLHDKLKIVCENASEEEIIEMNKLSAAIFLTSQGIPFIHSGEEFLRTKTNEKGEFIENSYNSNDFVNKIDWTRKVKYMDLFKYYKGLIELRKEYPLFRLESNKEIREKISFIESELGIKKKGIVAYRLKDHNNEFIVVFNSNNNEVKINLPKGLWGVMVNNKFSGKEIRDEARDFYDIIRKSACVLKKLSD

SEQ ID NO: 11903 - protein, 403 aa, Oryza sativa
MGKNGKKTESHRQGRGRRASRFRGGGGGGDEDGDELPSSAYDAPPPHHEDSDGDDTDEAAAEDEHEGGVDGGDQEQREVGSMPSKFHLYQLSVQSPKGDISYLQKFFLMYVGGRVPLHFQEDFCGTALLSAEWLRTDARRTAVGLDLDLESLEWCLENNLSKIGADGYSRMLLFHGNVLQPNVARLVKQKICDAMQDLHVNNDNDSLASNICDQLDPASPKCSANSTMSDLVLPARDIICAFNYSCCCLHRRKDLVLYFRHAFNALSKRGGIFVMDVYGGTSSERKLRLQRRFPSFTYFWEQEEFDIISHQTRISLHFQAGKKQMLRHAFTYHWRLWSIPEIKDCLEEAGFKSIHVWIREMPNTQSSGNAKEYNANRDVKYEELQHFNQADAWNAYVVGVANI

SEQ ID NO: 11904 - protein, 696 aa, Gibberella fujikuroi
MKFLQQNSFTQTSMSQPHEDVSPAIRHPYLTGNFAPIHKTTNLTPCTYSGCIPPELTGGQYVRNGGNPVSHQDLGKDAHWFDGDGMLSGVAFRKASIDGKTIPEFVNQYILTDLYLSRKTTSIASPIMPSITTLVNPLSTMFQIMFATFRTIFLVILSNLPGSQQAIKRISVANTAVLYHDGRALATCESGPPMRIQLPSLDTVGWFDGVEAEGEPEISQAGSDDSPFGGSGIFSFMKEWTTGHPKVDPVTGEMLLYHNTFMPPYVHCSVLPKSNEKAPGHRLVNQPVLGVSGARMMHDFGASRSHTIIMDLPLSLDPLNTMKGKEVVAYDPTKPSRFGVFPRHLPSSVRWFHTAPCCIFHTANTWDSQSSEGELSVNLLACRMTSSTLVYTAGNIRPPVRSRCTQARVWSDEREETACRYKEAPALESPGESTGLADYFPITAESDDYDQCRLYYYEFDLAMESRNHVKSQWALSAIPFEFPSVRPDREMQEARYIYGCSTSTSCFGVALGRADKVDLLVKMDAKTLIQRGKKMNATSITGCVDRRSVCEILQEQRKDDPIYIFRLPPNHYAQEPRFVPRACSTEEDDGYLLFYVFDESQLLPSGDCPPSATSELWILDAKNMRDVVAKVRLPQRVPYGLHGTWFSSQDIESQRSVESLRSLEVVQRKKEEWVNSGGQIRKSWMVLREKLEKAVG

SEQ ID NO: 11905 - protein, 1900 aa, Kluyveromyces lactis
MNPQPKETNRSSISSGARNSAGSASSNNSISSKNSGRELQPRSDTDSEWQDVGMPTFKEDYSIDAITKKVKPGKKGFHSAIVRDAGSFAHNPQPPLAKPVKPTFERSRTANLTATSSRGNLPLLSRTSSTLSVSTATSHGHKGTTKPSRATNFFKKLTSRKSSLASQGGPPDSDNQISQGGRVSASDGEQQSPFHQQSLQQQVPTNALRRKMSTFIHGSSTMSAASTLTSANAPHMKHSGSKGSSLLHSGNEASNGSNLSGGNATSGVSNQQHGVSSAGRSIDTDLSRRNSGTSFDASKLSAAKEIFGVDLDLDKLSDMTDVVVTSNAPSAETTDKVPPKSPNASQDTKDATLALRKQWTAPESWDVDETVGLDVNKIKERHKMSKANRHRGKNRKRYSKSQGKHTKGSVPKNVIAKDTSEPVIPHVHHHDFEEDALSPRTSPPNRGSNDESGLHLSETKSSECDLCFTISPNGDEDSDISIETQSESLDDITSAKTQSRPGSPLSQKNIEQYTELDGETEYEEHMLEKYYSDLSDIDQTKKYAIRIFNVDDTFTTLSCRPNTSVAELIPQIKKKFNIQQGNFQLSLKVGKLSKILRPTANPILIQIKLLLLNGYKKSDPLHILGLEDVSFVFSFKFHPVTTSQLTIEQQQRLSKGDFIHVDLRNMDLTTPPIIFYQHTSEIESLDVSNNANIFLPIDFIESAVKLSSLRMVNVRASRFPANITQAYDLVSLDLERNFIKRVPESISKLSNLTILNLQCNQLDRLPSGFKNLKNLQLLDISSNAFTAYPEVINRCTNLLQVDLSYNKINSLPLSINELSKLAKMNLSNNKIQAVPDLSGMANLRTLNLKNNRIATIKSNAPNLQNLFLTSNRISVWEDSLPKLRSCDLTENPVTSFDYRGNVLSNLTSLSLNKAKLSSLPIDFLKTLEKLEKLELNDNNLTSLPAEIKYSKKLIHFSAANNKLDSIPEEIGELSNLKSLDLHCNNIRELPISIVNLELTTLNFSSNLLGYNPGLEDYENTPLSKSLLFLNTADNNLNNEMLPLFNFNTSLKIINLSYNDISDISALNLPSLTELYLSGNAITSLPGEVFQRMKNLKVIMLNGNKLMSLPSELSQLSNLTVLDVGSNQLKYNISNYHYDWNWMNNLNLKYLNFSGNKRFEIKSMIGPDTKTDLSDLTILKQLKILGLMDVTMKTSKVPDDGVNFRLRTTGSMINGMKYGVADTLGKKSSVSTRDIKYERFRGKDDECLFCLYDSVNENASSGHKISQIIRDIYDKILTRALEKYGDDTDENIRTALRFSFLQLNKEINGMLVSVENGLNKSELTTVDLLSGASATVVFFKGKSVYTANIGNIGAILAKNNGDYEVLTRLHVPTKRDEYERIRIAGGYVNSEKLDGVSEVSRAVGFFDLLPHIHASPDISDFKLTFSDQMIIIASHNLWNYIGYEIASDIARENGSEPMLAAEKLKDYAITYGCTDKLTVVCISVEKGATETNRFNISKKDLLSRKTAFEDSSLRRLQPEIPPPTGNVAIVFTDIKNSTFIWELFPDAMRTAIKTHNEIMRRQLRIFGGYEVKTEGDAFMVAFPTPTSALVWCLSVQLKLLEAEWPGEITSIRDGCLITDTSGNKIYQGLSVRMGIHWGCPVPEVDVVTKRMDYLGPVVNKAARVSGIADGGQVMLSNDFMVEFKKILSYHQQVTEDNIPLAKAYGEDIVGEILEREIHILSSIGWMFVELGEQTLKGLETKELVTIAYPKSLQARHTLATQDQNNSVISDDFLFQIRSVSNRLETVLSSVQGGLIGLENSANGRYTTFDSNTKQAVMKNSSEADLLAFLDHLITRIESSVVLMNLRQQVQGGLTIYKSGDAMKQKSIFQLLDDLLARNQLYIENSHNDESEQQSFKSFPEE

SEQ ID NO: 11906 - protein, 929 aa, Desulfotalea psychrophila
  misc_feature (198)..(198): Xaa can be any naturally occurring amino acid
MARSRVNKAVASTATTSKRVTLNPKVARRSFLKISAATAALTGAAMTTNLTKKASASGKKSPYEGSKTVRTICTYCAVGCGIEAEVHNGVWVRQNVAVDHPVSRGGHCCKGAGAIDMVTSPKRMKSPMKRINGKWTPISWDRAMGEITDKLKSIREKDGPDALHFNGSAKVSNEMAYQIRKFAAFWGSNNIDHQARIXHSATVAGVANTWGYGAMTNSLNDIRHAKSMIFIGSNAAEAHPVSMQHILHAKEKNNAPIIVVDPRRTKLAAKADEFVRIRPGSDAAFMMGLIHVIVKNGWEDKEFIRTRVSGYEEMIEVTKKYTPEEVEDVTGIPAAQTIKVAKMLATHRPTSLTWCMGGTQHSIGSSITRSFCLLQLVLGNMGKSGGGTNIFRGHDNVQGATDMCILSHSLPAYYGLSDGAWKHWCRVWGVDYEWMVSRFPAKEWMNKKGFTLARWYEGVLNEEKIHQPSPIKALIQWGCGANSNSQYGRVKRAYNKLDLLVIVDPFPTMAAALCETDNVYILPSASQYETQGSVSSTSRQIQWRYKVVDPIYNSRDDYDILRDFVTRLGFADKFYKNIKQEPEDITRELGSGSLTIGYNGQTPERIKAHMENWHTFDIDTLQAKGGPCDGEYYGLPWPCWTQEHPGTPILYDMSKSVAEGGLPFRNRFGVEKTYDSGRTENQLAAEGTYTPGSEVKGGYPEFKDVVPGTNWKTDLSQKTIKDAISRGMAPFGNARARCIVWTFPDQVPVHREPLHSPRPDLIERYPTYQDQTNHFRVDTRFESEQNPNLIKEFPYILTTGRQVEHMGAGAETRSNQYLAELQPEMYAEINPRLANNLGIRKDAMIWIESPEGGKIKVKAFVTERVDEKTIFLPYHFGGSWEGESLVDKYPEGHAPWVVGDSANVVVNYGYDIVTQIQATKDGLCKISLA

SEQ ID NO: 11907 - protein, 110 aa, Neisseria meningitidis
MSSELIVHTSDAAFEKDVLNADIPVLLDFWAPWCGPCKMIAPILDDIAAEFEGRLKVVKINIDDNEATPSRFGVRGIPTLMVFKNGEVVATKVGALAKGQLTAFVEASIA

SEQ ID NO: 11908 - protein, 430 aa, Symbiobacterium thermophilum
MNRKWIIAIGAALAVVLVGVGTFTYVANKTEAVEGPAVSISPNETDPAVFKLLYPAHYDSYMRNGEMHEPALKYASSEKKKSRLDQFPYMRTLWAGMAFSKEYNEARGHLYTLDDVVGGNGTEATQRINDKTNLTCMYCKSAQVPQLIEQMGDAFYNTKLLADNNTDLFVHPISCSDCHDPQTMELRITRPALVEAMERIGRPVENATRQEMRSLVCAQCHVEYFFNPNDANRVYFPWDKGFEPEDMYAYYEEIGFSDWTHAQTGGGMLKAQHPEFEMFQGSVHQRAGLSCADCHMPYVTEGSTKISSHWWTSPFRTFEQSCAQCHRESQEEMAQRVLHTQDRVKEALDRAGIANQDAILAIEKAIAAGVDEEILNQARALHREAQFYWDLASAENSFGFHNPQKFLETLADSIDLARQAELLVTRAMNK

SEQ ID NO: 11909 - protein, 480 aa, Coccidioides immitis
MAASLSQKIQDGSVRWIQREFEDNDLSTLGRAEVDGYVDAVFITAGANNHLNSHISKLCRGLRIPVNVVDASELCSFSLLSTYSDGPLQIGVTTSGRGCKLASRLRREIASYLPPGLGTAIEILGSVRKRIWEEDVSAGSRTSFHFEVDDDDSEAQKHTFNSLILPEHPDVAKTRRMRWLSQICEYWPLRRLASITDADMEKILAAYKEAKTADISDAHGAHEEKRGQIILAGSGPGHPDLVTRATYHAIKTADLILSDKLVPAPVLDLIPRRTEVHIARKFPGNADKAQDELLDMALAGLRTGKRVLRLKQGDPYLYGRGAEEYEFFRAKGYSPIVLPGITSALRRHGAAPEPPSYIPTQTAVFLMALHRLPSLVESLTTAVPDEALSSRRPWPRDTPCAVVERASCADQRVIRSTLEHVCAAVEAEGSRPPGLLIVGRSCEVLHRIDQKWVVEEGFKGLDDIRHDEHLHVIDKLGQET

SEQ ID NO: 11910 - protein, 168 aa, Hordeum vulgare
ACRVLAGMPAAGATALAGGVNFAVYSAEPPRALCLFTPEDLKADRVSEEVPLDPLMNRTGDVWHVFLEGELHGMLYGYRFDGTFAPHCGHYFDVSNVVVDPYAKAVISREEYGVPAHGNNSWPQMAGMIPLPYSTFDWEGDLPLRYPQKDLVIYEMDLRGFTKHDSSN

SEQ ID NO: 11911 - protein, 170 aa, Nelumbo nucifera
MASQSKKEKGSIHDFTVKDARGNDVDLSIYKGKVLLVVNVASQCGLTNSNYTELSTLYEKYKDQGLEILAFPCNQFGHQEPGTNEQILEFSCTRFKAEFPIFDKVDVNGQNAAPIYKFLKSSKGGIFGDSIKWNFSKFLVDKEGHVIDRYAPATSPLSIEKDIKKLLGIS

SEQ ID NO: 11912 - protein, 239 aa, Arabidopsis thaliana; identical to SEQ ID NO: 303

SEQ ID NO: 11913 - protein, 548 aa, Rhodobacter sphaeroides
MDISRTSDVWWKNAVFYCLDVETFQDSNGDGIGDFAGLTRRLDHLDRLGVSCIWLMPFYPSPNQDDGYDITDYYSVDPRLGTLGDFVEFLRAAHDRGMRVIADLVVNHTSREHPWFQASRADPDSPYRDWYVWRDEKPDEDAASLVFPGEENSSWTWDAKAGKYYLHRFYSHQPDLNVENRAVRDEIQRIVGFWLQLGLSGFRVDAVPFLLEQMSTVDTGFAPHRWLRDLRAFINRRSGDAVLLGEVNLDYPDVRRFFGDEDGDELHMCLDFNLNQAMALALAREDAGPIVHGLRHMPELAPDDGWAHFLRNHDEWSLDKLTEAERQEVFASFGPDPSMQLFGRGLRRRMPTMLKGNPDRLRMAYALMASMPGSPVIFYGEEIGMAENLEIPGRLAVRAPMQWDAGPHGGFSNASTEALHRPMVSDPQWGPGKVNAIDQQDRPDTMFHFMEHLLRRRRECPEIAFGEHAVLPFPEPEIFAIRHDWEGRTLIALANLGAKPQKVTLTLPKASGLGRLRPILGEGKVSLRKDELTVELGGYGLRWVRFES

SEQ ID NO: 11914 - protein, 69 aa, Eschscholzia californica
  misc_feature (1)..(1): Xaa can be any naturally occurring amino acid
  misc_feature (6)..(6): Xaa can be any naturally occurring amino acid
XRKVLXNNIQGITKPAIRRLARRGGVKRISGLIYEETRGVLKIFLENVIRDAVTYTEHARRKTVTAMDV

SEQ ID NO: 11915 - protein, 563 aa, Clostridium thermocellum
MRKIAVLLITLTFLVTTLFSMSFSSAAASHDYATALKYSILFYDANKCGPDAAVDNVFSWRGPCHTTDGSEIGLDLTGGYHDAGDHVKFGLPQAYAAAVLGWSLYEYKGVFDATGNTSKMLSTLKYFTDYLLKCHPDSNTFYYQVGDGQADHTYWGAPEVQPGPRPVPYVANASNAASDVCGLTSAALTIMYLNYKDIDQNYANKCLKAAKELYTMAKTNLGYYAENAFYISHSYWDDLSFAATWLYVVEKDPTYLKEIDSYLSNKTLWGESPFNNKWTMCWDDMYMAVFCKLAEITGEQKYIDAMNYNLDYWMNSLNTTPGGLKYLDSWGVLRYAAAEAFIAMRYYELTKNEALKSFAKSQIDYILGSNPINMSYVIGYGSNYPKCPHHRAANGYTYANGDNAKPAKNLLLGALVGGPNMSDNFIDDVNQFQFTEVAIDYNAAFVGALAAIEKYYGNIVIPTPPATTPPSPTATPSLIWCDVGDLNVDGSINSVDITYMKRYLLRSISVLPYQENERIRIPAADTNGDGAINSSDMVLLKRYVLRSISEFPVKYDIYGNIIN

SEQ ID NO: 11916 - protein, 227 aa, Glycine soja
GVCYGGNGDNLPTKQAVVDLYKSNRIDKIRLYYPDEGALQALRGSNIEVILTVPNDQLQSLTNAGAANDWVNKYVKGYSQNVKFKYIAVGNEVHPSDAAAGSVLPALKNIQNAISSANLQGQIKVSTAIDTTLLGNSYPPKDGVFSNSASSYIGPIVSFLAGNGAPLLANVYPYFAYVGNQQNIGLDYALFTKQGKNEVGYQNLFDALLDSLYAALEKVGAPNVKVV

SEQ ID NO: 11917 - protein, 226 aa, Glycine soja
GVCYGGNGNNLPTKQAVVDLYKSNRIGKIRLYYPDEGVLQALRGSNIEVILGVPNDQLQSLTNTGAATNWVNKYVKTYSQNVKFKYIAVGNEIHPGDSLAGSVLPALENIQKAISAANLQGQIKVSTAIDTTLLGNSYPPKVGVFTDSASPYITPIVNFLVKNDAPLLANLYPYYSNANNQNIGIDYVLFTKQSKNEIGYQNMFDAMLDSVYAALEKVGAPNVKVV

SEQ ID NO: 11918 - protein, 359 aa, Arabidopsis thaliana
MEGDVGIGLVCQNTMDGKASNGNGLEKTVPSCCLKAMACVPEDDAKCHSTVVSGWFSEPHPRSGKKGGKAVYFNNPMWPGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHIGDAAEFLRKSPEGKYDAIIVDSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGAMTHKRELKFYNSDMHRAAFALPTFLRREVASLLAS

SEQ ID NO: 11919 - protein, 1197 aa, Yarrowia lipolytica
MGAFRNLFALFRRDDRQRPRAPERAKSSSARLQSTTAGVSELGVSKTRPAVHRVQSESVPKSKTGSKRFSFRRSVSGPSPPTTSSSSIDPARPTTSPSPVKSPAAGNDSVPSLDYSFDRTFQTIEEEESLVSPAVDTRKFRESLKKELLLDLDVYDSKPSSKTVTAKSSLLFDSTDRPSSQLFDASRASQLFDSKLGTLDLSFDLDPATSPNLNSKLSQHSNTTVGLGSNSGAPSVHDSSRTPTHIPLFGSDHTNPPDHTSPDLAPALDYLHLNLDMGADDTDTKTVDSIDTKTVDSQDTKTSLDTVPDSLSVTSATSSSSKSTKNKKKKAKAKAKKATTKLESSKPASPEIGSLEVDLDDDDDGLDFMAQELENMKLEMQGKRGKRESPEPAAKVEEKTAEQPTSTDSAVSISKKSSEKKKKKKKSKSGDKSDKSSKSEKSDKPDSTGSSTAPIDLTSPVATSPIDLTSPVESKLETIASTPALVDQDAIAQTREVLHMEDADGDNSAKKVDTEQVKASLVQVEDDNIGAIESDKAVKVDEEQVQHDLVEEKEAEKEAEKEKEEEKEEEKEEEKEEEEFINPSTPAKVVSEKPKEVSTPSTPVKAATPTKTASTPVKASVKTPAKDSTSSTPLKGSLVQTDDNDLPEPIPTESSAQDKTATPTESSTPIKQSLVQTDETPLKAETSARVASPVPEPIPTEPSTPKAASSKSTPIGTPLSSSITASPSKTPTTATTVTTADGELLIPPRTSSLRRPEVELAKSKSKEDLKKEGEPTADIKNKSDVKAEVQPETEGLKEDVKSDVTSKDEPATQPEAEAKEAAEEKLKAPVKVKPDSEPAEAEETATEPKESSPEPEDKEKASDEASNKTSVKKDKKKKKKSTKKVKEVKEATKADKETANVESRPGAVLKDDMAESKKADIDEKPEADAKAEEEAEIDSKIAQPTETDADAVDDKLEAKGEDKEVKGTQPVTETVAEAIAEAETKEPIKTEAEIREPLETEVEKPAESEKKKEAPDSKTESKEESKDEAKPVEIQSKSAKTNVENDTKDSDVAANAIPSPAATASSTPEPETKEKKKKKKKSETGEKTEKTEKKKKVVMPADAMLDGKYYVYTSYGTGIRGIMASTNNLVNILAANDLEPQIVEITVLPRARRVWRFRGTGKELPAVVKDEEVLADYKEVCEANEVGTLEDLLEIGL

SEQ ID NO: 11920 - protein, 382 aa, Vibrio vulnificus
MSDPIIIIGSGFAAYQLVKSVRRLDAHIPIQIFTADDGAEYNKPDLSHVFSKRQTAADLVVKSGEAFATEHNVQLHAHTQVERVLTQQQQVVANGRCYPYSKLVFATGAQAFVPPMRGDGLAKVMTLNSLQEYQAAEQPLSRAQHVLVIGGGLIGVEIALDLATSGKQVTVVEPNARLLANLLPEFIALPLEQQLMKHGIQLALNSRVESVTVQGQTLAIALHDGREFAVDAVLCAAGLKANTAVAREAGLSVERGICVDLQLNTSDPHIYALGDCAQIEGRMLPYLQPIVLSANVLAKQLVGQEARLTLPPMMVKVKTPSYPIQLAGDFSPESHWQVQLSPEGIVAKAQSSLGDFTGFVVTGEYVTQAFPLLRELSQRANG

SEQ ID NO: 11921 - protein, 447 aa, Arabidopsis thaliana
MALIQFGSSCVAQWGILRPRFAVKAFYPSRLESHHDNCISQINCLGASRSSMFAQGSLPFLSLTGVSPNTHSRRGARFTVRADTDFYSVLGVSKNATKAEIKSAYRKLARSYHPDVNKDAGAEDKFKEISNAYEILSDDEKRSLYDRYGEAGVKGAGMGGMGDYSNPFDLFESLFEGMGGMGGMGGGMGSRGSRSRAIDGEDEYYSLILNFKEAVFGIEKEIEISRLESCGTCNGSGAKAGTKPTKCKTCGGQGQVVASTRTPLGVFQQVMTCSPCNGTGEISKPCGACSGDGRVRRTKRISLKVPAGVDSGSRLRVRGEGNAGKRGGSPGDLFAVIEVIPDPVLKRDDTNILYTCKISYVDAILGTTLKVPTVDGEVDLKVPAGTQPSTTLVMAKKGVPVLNKSKMRGDQLVRVQVEIPKRLSKEEKMLVEELADMSKNKVANSRR

SEQ ID NO: 11922 - protein, 61 aa, Glycine max
MLQVFPKKLGTPRRSEIVFIAPSGEEISTKKQFEQYLKAHPGNPVISQFDWGTGETPRRSA

SEQ ID NO: 11923 - protein, 152 aa, Oryza sativa
MAPKAEKKPAEKKPAAGEEKSAEKAPAGKKPKAEKRLPASKASSKEGGAGDKKGRKKAKKSVETYKIYIFKVLKQVHPDIGISSKAMSIMNSFINDIFEKLAQEAARLARYNKKPTITSREIQTSVRLVLPGELAKHAVSEGTKAVTKFTSN

SEQ ID NO: 11924 - protein, 179 aa, Fagus sylvatica
FFISMATFFETSNRSLMATIVFLMGFLMANLATTGAQSVGVCYGMLGNNLPSVQEVISLYKSNNIKRMRIYDPNQAVLQALRGSNIEVMIGVPNSDLQSLANPSNAQAWVQRNVLNFWPSVRFRYIAVGNEVSPVNGGTSGLAQFVLPALVNVFNAVRSAGLQDQIKGSIAIDMTLIGN

SEQ ID NO: 11925 - protein, 91 aa, Oryza sativa
MSSRRGGGGGGGRITDEEINELISKLQALLPESSRSRGASRSSASKLLKETCSYIKSLHREVDDLSDRLSELMSTMDNNSPQAEIIRSLLR

SEQ ID NO: 11926 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYLGGLRFAPSVNLSIMKFLGFEQAFKDSLTTLPMGGAKGGSDFDPNGKSDREVMRFCQAFMTELYRHIGPDIDVPAGDLGVGARELGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 11927 - protein, 501 aa, Acidobacteria bacterium
MPLKTLFLNPPSFENYDGGASSRWPATREIESYWYPVWLAYPAGMLEGSRLLDAPPHHVSFDETIQISKDYDFVVLFTSTPGFPGDLKIAKAMKTANPNVKIAFVGPHVTTLPERSLAEGPEIDFIVRREFDYAVVEYANGKPLNEITGVSYRGADGKVVHNPDRPPVSNLDEMPDVIDVYKRDLDVKRYNVPFLLHPYIALYTTRGCPAQCTFCLWPQTLSGHPWRKRSSDAVASEMKRAMELFPWVREFFFDDDTFNIQKARTIELCEKLKPLGMTWSCTSRVTTDYETLKAMKEAGCRLLIVGYESGDPQILKNIKKGATVERARAFTKDCHKLGLKVHGDFILGLPGETKETIRRTMDFAKELDVETIQVSIAHAYPGTELYDYAKANGFIVQEGAAMVDDQGHQVAMIEYPGLPRDYVMEMVHKFYDEYYFRPKAIFRIVRKAVFNNVERKRLYKEAKDFMKLRSVRNKAVKVAREQQAKSNINPKKNEPAEPVNV

SEQ ID NO: 11928 - protein, 322 aa, Salmonella typhimurium
SKIYEDNSLTIGHTPLVRLNRIGNGRILAKVESRNPSFSVKCRIGANMIWDAEKRGVLKPGVELVEPTNGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 11929 - protein, 453 aa, Unknown
  Synechococcus sp. WH 7805
MAVENLVIVGSGPAGYTAAIYAARANLNPLLITGFQRGGIPGGQLMTTTHVENFPGFPDGVLGPDLMDLMKAQAERWGTRLLEADADSIDLSQRPYRIEADGNTIETQALIIATGASANRLSLPNEERFWSHGISACAICDGATPQFRNEELAVVGGGDSACEEAVYLTKYGSHVHLLVRSDRLRASAAMADRVQANPQITVHWNTQVADAEGEAWLSGLRLQRRDSGLEEHLPVKGMFYAIGHTPNTELVRDQLNCDGTGYLITQPGRPETSKEGVFAAGDVADAEWRQGITAAGSGCQAALAAERWLSHNDLAQLVKRDQAEPAKADTPKATAETTESSYDPDALWQKGSYALRKLYHDSRRPLLVVYTSPSCGPCHVLKPQLKRVLDELGGSAQGIEIDIETDQAIAEQAGVNGTPTVQLFYDKQLKQQWRGVKQRSEFMASIRSLLQES

SEQ ID NO: 11930 - protein, 413 aa, Glycine max
MGELGDMEENEWQMVQTKGNQFVVNDQPFYVNGFNTYWLMVFAADESTRGKVTEVFKHASSVGMSVCRTWAFNDGQWRALQKSPSVYDEEVFKALDFVVSEAKKYKIRLILSLANNWEAYGGKAQYVKWGNAAGLNLTSDDDFFSHPTLRSYYKAHVKTVLNRVNTFTNITYKEDPTIFAWELMNEPRCTSDPTGDKLQDWIQEMAFHVKKIDPKHLVEVGVEGFYGPSTPQRTQFNPNTYATQVGTDFIRNHLVLGVDFASVHIYPDSWISQSVADSHLPFIKTWMEAHIEDAEKYLGMPVVFAEFGVSAKAPGYNSTYRDNLINTVYKTILNSTKKGGSGAGSLVWQLFPDGTDYMDDGYAIVLSKSPSTSSIISLQSTRLALFNSLCSKKCRWGCKKRNVLEKVLYHDEL

SEQ ID NO: 11931 - protein, 365 aa, Gentiana triflora
MGSLLPSRVESLAISGIKTIPKEYIRPKEELASIGNIFEEAKNNNKTSQIVPTIDLKDMDSLDNNKDVQTQCHDELKNAAMEWGVMNLVNHGISQELINRVKSAGQAFFDLPIEEKEKYANDQASGNVQGYGSRLANNASGQLEWEDYFFHCIYPERKRDMSIWPKTPHDYIPATIEYAKQLRDLATKVLAVLSVGLGLEPDRLENEVGGMEEMILQKKINYYPKCPQPELALGVEAHTDVSALTFILHNMVPGLQLFYQGKWITAKCVPDSIIMHVGDTLEILSNGKYKSILHRGLVNKEKVRISWAVFCEPPKDKIILKPLPETVSEIEPARFPPRTFAEHIKHKIFRKTEEAIKDNNIANGN

SEQ ID NO: 11932 - protein, 88 aa, Arabidopsis thaliana
MASFTGSASTVSAARPALLLKPTVAISAPVLGLPPMGKNKGGVRCSMERQQGNVSFMGAGVSAGASAALTEVMSNHAKACGEQVMFTG

SEQ ID NO: 11933 - protein, 87 aa, Triticum aestivum
  misc_feature (3)..(3): Xaa can be any naturally occurring amino acid
  misc_feature (9)..(9): Xaa can be any naturally occurring amino acid
  misc_feature (22)..(22): Xaa can be any naturally occurring amino acid
  misc_feature (26)..(26): Xaa can be any naturally occurring amino acid
  misc_feature (38)..(41): Xaa can be any naturally occurring amino acid
  misc_feature (56)..(56): Xaa can be any naturally occurring amino acid
  misc_feature (63)..(63): Xaa can be any naturally occurring amino acid
  misc_feature (69)..(70): Xaa can be any naturally occurring amino acid
  misc_feature (73)..(74): Xaa can be any naturally occurring amino acid
  misc_feature (78)..(78): Xaa can be any naturally occurring amino acid
  misc_feature (81)..(81): Xaa can be any naturally occurring amino acid
  misc_feature (85)..(86): Xaa can be any naturally occurring amino acid
SDXPFCASXFAVSFYVPAKNQXDPPXVEGLRVDRWAGXXXXAVRRFGGFVADADVXEQAARLXASFQGXXWVXXVNDXRMXDPAXXY

SEQ ID NO: 11934 - protein, 523 aa, Acidobacteria bacterium
MSLEPNQTSRRVLCVFPRYEKSFGTFDNAYPLLGVKAFMPPQGMLVIAAYLPKRWQVRFVDENVKPASDADYRWADVVMTSGMHIQRNQINAINRRAHSFGKVTVIGGPSVSGCPEHYPEFDYLHVGELGDATDTLIQLLEVSVARPHEQVRFETKERLPLADFPTPAYDMAAMDKYFLANVQFSSGCPYRCEFCDIPELYGRNPRLKTPQQILKELDAIVAGGAIGAVYFVDDNFVGNRKAALELLPHLVEWQKKNNYPVEFACEATLNIVKSPDLLALMREADFWTIFVGIETPDPAALKLISKDHNNTVPVLEAIQTLNSFGIEVVSGIIMGLDSDTVETGERILKFVAESQIPVLTINLLEALPRTPLYRRLQAAGRLNDAPGRESNVEFVLPYDQVVAMWRKTFQNAFTPEAIYERFSYQQKNTYPHRVQPPPSGKANLRNMLRGFTTLAKLMWIVGVKSDYRRVFWKMARPALRELDIEDIIHVSLVSHHLISFAREAARGAQNAAFYSPELKAQTA

SEQ ID NO: 11935 - protein, 365 aa, Gentiana triflora
MAPPPPPSTLTALSKEKTLQQTFIRDEDERPKIAYNQFSNEIPVISLKGLEDGDERKGICEKIVEACEDWGIFQVVDHGVDLDVVNEMTRLAREFFDLPPEEKLRFDMSGGKKGGFIVSSHLQGEAVRDWREIVTYFSYPIKSRDYSRWPDKPEGWKSVTEKYSEQLMNLACKLLEVLSESMRLEKEALTKACVDMDQKIVVNFYPKCPQPDLTLGLKRHTDPGTITLLLQDQVGGLQATRDGGKSWITVQPVDGAFVVNLGDHGHYLSNGRFKNADHQAVVNSNYSRLSIATFQNPAPEATVYPLAIRDGEKPVLDEPITFAEMYRRKMSKDLELARLKKQAKEELKNVEKAKIEGKALEEILA

SEQ ID NO: 11936 - protein, 170 aa, Haemophilus somnus
MSNKAIYLAGGCFWGVECYFHRIDGVLDAISGYANGKTENPSYQDVLYNNTGHAETVKVIYEQNKLSLEDILQYYFRVIDPTSLNQQGNDKGTQYRTGIYYTDPQDREIILTALTQEQKKYSKPIVVEVLPLQRFDPAEEYHQDYLLKNPNGYCHIDIKKADEPLVKTYK

SEQ ID NO: 11937 - protein, 306 aa, Fusobacterium nucleatum
MLANSVIDLIGNTPLVKINNINTFGNEIYVKLEGSNPGRSTKDRIALKMIEEAEKEGLIDKDTVIIEATSGNTGIGLAMICAVKNYKLKIVMPDTMSVERIQLMRAYGTEVILTDGSFGMKACLEKLEELKKQEKKYFIPNQFTNVNNPKAHYETTAEEILRDMDNKVDVYICGTGTGGSFSGTAKKLKEKLPNIKTYPVEPASSPLLSKGYIGPHKIQGMGMSIGGIPVVYDGSLADGILVCEDDEAFKMMRELSFKEGILAGISTGATLKAALDYSKENANKSLRIVVLSTDSGEKYLSSSHGL

SEQ ID NO: 11938 - protein, 112 aa, Unknown
  Mycobacterium sp. MCS
MKLITAIVKPFTLEDVKTGLEQTGILGMTVSEVQGYGRQKGHTEVYRGAEYSVDFVPKVRVEVIVDDSAVDKVVDVIVQAARTGKIGDGKVWVSPVDTVVRVRTGERGADAL

SEQ ID NO: 11939 - protein, 365 aa, Gentiana triflora
MAPPPPPSTLTALSKEKTLQQTFIRDEDERPTIAYNQFSNEIPVISLKGLEDGDERKGICEKIVEACEDWGIFQVVDHGVDLDVVNEMTRLAREFFDLPPEEKLRFDMSGGKKGGFIVSSHLQGEAVRDWREIVTYFSYPIKSRDYSRWPDKPEGWKSVTEKYSEQLMNLACKLLEVLSESMRLEKEALTKACVDMDQKIVVNFYPKCPQPDLTLGLKRHTDPGTITLLLQDQVGGLQATRDGGKSWITVQPVDGAFVVNLGDHGHYLSNGRFKNADHQAVVNSNYSRLSIATFQNPAPEATVYPLAIRDGEKPVLDEPITFAEMYRRKMSKDLELARLKKQAKEELKNVEKAKIEGKALEEILA

SEQ ID NO: 11940 - protein, 433 aa, Unknown
  Frankia sp. EAN1pec
MERTYTTDLPKRAGEKVHLAGWVHRRRVLKNVTFLVLRDARGTAQIVVNEPDILSKISDVTEESVVEIDGQAVANPHAPGGVEVINPEIGILSEAVSPLPFEIFRPNLDVSLPVQLDHASLALRHPRRQAIFRLAAASVAGFREALTSEGFTEVHTPKIVASSTESGANVFGIDYFGSRAYLAQSPQFYKQTLVGVFERVFEVAPVFRAEPHDTARHLAEYVSLDAEMGFIEDHHTVIKMVSLAVRHMVEKVSATDPEESILADQTLPRIPEQIPIIHFSDAQEMIQRATGEQVIGEPDLAPAHERWLGEWALHEFGSDFLFVTGYPMRKRPFYTHPDPARPEFSNSFDLLFRGLELVTGGQRLHRYTDYVQAITLRGEDPEKYRAYIDTFRYGMPPHGGFALGLERWTARLTGAANVREVTLFPRDLHRLTP

SEQ ID NO: 11941 - protein, 466 aa, Unknown
  uncultured bacterium
MAARVGLWGGLAAFVVILLLPAPGDMPQAAWATCAIVVLMATWWMSQALPLTATALLPFLAFPMFGIMTATDTAGAYYSPILFLVLGGAMIALAIERVGLHRRLALSIIRRGGHTPGAMLFAFLAATAIISMIVSNTATTLIMIPIAVAVIKAAEIPEGDTGGFAGALAMGIAFAASIGGLGTLVGSPTNAISVGIIEKATGLRITFLDWAIFGMPLVVLAIPLCWLILMKVQRVQPTDFVPEKALEAIGETGPWSKAEKRLVPLIAIVLAAWIAIPFIAPLLPKDSLTDGTIAIAAALALFVIPDGSGRALLNWDEANRAPWGVIMMFGGGLALAAGMGASGLGDWLGVALQPLKAVHPLIVALVLVALVVLITEFASNVAAASAIIPVVAGVIAATGVDPILLALPAAWAASWGFMLPSGTGPNAIAWATGHIALPRMLKAGLLLDLAGIPLMVGTVWLIASIG

SEQ ID NO: 11942 - protein, 524 aa, Desulfovibrio vulgaris
MNNQKTFKGLRLAALGLVAVAAFTAGCSDVSTELKTPVYKTKLTAEEIRNSAFKPEFPKQYASYERNDETTVMTEYKGSVPFNKNDNVNPLPEGYRHAQPYLKNLWLGYPFMYEYREARGHTYAIQDFLHIDRINRYAEKGGLPATCWNCKTPKMMEWVKESGDGFWAKDVNEFRDKIDMKDHTIGCATCHDPQTMELRITSVPLTDYLVSQGKDPKKLPRNEMRALVCGQCHVEYYFNGPTMGVNKKPVFPWAEGFDPADMYRYYDKHGDLQVKGFEGKFADWTHPASKTPMIKAQHPEYETWINGTHGAAGVTCADCHMSYTRSDDKKKISSHWWTSPMKDPEMRACRQCHSDKTPDYLKSRVLFTQKRTFDLLLAAQEVSVKAHEAVRLANEYQGAKAAGYDDLMIQAREMVRKGQFFWDYVSAENSVGFHNPAKALDTLAQSQQFSQKAIDLAMEATQYGIGKDLSGDIKTIVPPILKMNRKLQQDPEFMKTHKWFQYLPVLPKADQVWDGQKRLVSAKQ

SEQ ID NO: 11943 - protein, 363 aa, Unknown
  Shewanella sp. MR-7
MNPVFTPNVAQKILFIDRDGTLIEEPITDKQVDSLAKLVFEPQVIPALLRLQKAGFRLVMVSNQDGLGTPSFPQEDFDAPHNMMMQILSSQGVRFEDVLICPHFNDENCSCRKPKLGLVKDFLTQGTIDFTQSAVIGDRHTDVELGNAMGIKSFQYQRGSLGWDAIADALLNKGRTATVVRTTKETDIRVTVDLDNASKGAINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRQAVKVEGDVLPSSKGVL

SEQ ID NO: 11944 - protein, 302 aa, Clostridium perfringens
MKYYNDIRDLIGNTPILKLNNISTKEGVNIYAKIEGTSPGGSCKDRVGIYMVEKAEKEGKLKSGSTIIEATAGNTGIGIALAAINKGYKIIFIVPNKFSIEKQKIMKALGAEIINTPKEEGMEGAINLANSLLSEIPNSLSLNQFKNEANPLAHYETTGRELYDGLDGQIDYFVAGAGSGGTISGVLKFLKENISEVKGILADPVGSIIGGGQCGTYKIEGIGNNFIPETMDMSLVDDVIKVNDEEAFDAVKLLAKKEGLIVGSSSGAAFAAVLKLAEKIEEGNIVTIFPDRGDRYFSTDLF

SEQ ID NO: 11945 - protein, 720 aa, Xanthomonas campestris
MATRKFTQRSRIREGRPNPLGATWDGLGVNFALYSRNATRVELCLFDERGREQERIALPEYTDEVWHGYLPDARPGQLYGYRVHGPYAPDAGHRFNHNKLLLDPYAKQIVGELKWAPHLFGYIIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLEKGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDSGQLAELATRLTGSADLFNHSGRRPTASVNFVTAHDGFTLRDLVSYETKHNLANGEDGRDGSDHNISSNYGVEGETNDPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGTEMDEAAWHDPEARALMLRLDGRSPTTGLREIAANVTLLMLINAASTAVSFTLPAMHDEHWRVLVDTARHGGRVVAGGSEWKAPAHSLTLLAVERDRIVSSARIVSEGAR

SEQ ID NO: 11946 - protein, 483 aa, Streptococcus thermophilus
MIVSTYYPKIFYCDKLVLLHLLEESMENHNYENEGQFQRKMTSRHLFMLSLGGVIGTGLFLSSGYTIAQAGPLGVILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAIFVFIILGLGAMFGLVSFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 11947 - protein, 239 aa, Methanococcus maripaludis
MKVILVGAGPGDEGLITLKGVEAIKNADVIVYDDLIGEKLLKYAKTGSELIYVGKRKGKHSYKQEEINEILIDKAKENKNVVRLKGGDSFVFGRGGEEVLALKKEGIEYEMIPGITSSISVPEIFGIPVTHRKVATSFTVVTGHEAGDKTEKEMQVKLSELNADTIVILMGITTLEKHVKELLKNPKRNENTPVAILMDGTRENQRMVKGNLSNIVEKAKLENVCPPGIIIVGNVVDVL

SEQ ID NO: 11948 - protein, 377 aa, Glycine max
MAIAAAAVVVPLGLLFFASGLLVNLIQAICYVVVRPVSKSLYRRINRVVAELLWLELVWLIDWWAGVKVQIFTDHETFRLMGKEHALVISNHRSDIDWLVGWVSAQRSGCLGSTLAVMKKSSKFLPVIGWSMWFSEYLFLERSWAKDESTLKSGIQRLSDFPLPFWLALFVEGTRFTQAKLLAAQEYATSTGLPVPRNVLIPRTKGFVSAVSHMRSFVPAIYDVTVAIPKSSPAPTMLRLFKGQPSVVHVHIKRHLMKELPDTDEAVAQWCRDIFVAKDALLDKHMAEGTFSDQELQDTGRPIKSLLVVISWACLVVAGSVKFLQWSSLLSSWKGVAFSAFGLAVVTALMQILIQFSQSERSNPAKIVPAKSKNKGS

SEQ ID NO: 11949 - protein, 246 aa, Griffithsia japonica
GTRNSSHLHPKHTLFIVMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGQ

SEQ ID NO: 11950 - protein, 123 aa, Fagus sylvatica
LMSLLLLSGRLVRERIGPAMLSAVQSQMGAVETNFDEIPNIFDTGSAKGLPGDSVEKIPKIIITTNNNVDASGDRVSCSVCLQDFQLGETVRSLPHCHHIFHLPCIDKWLLRHGSCPLCRRDL

SEQ ID NO: 11951 - protein, 964 aa, Spinacia oleracea
MSSLYNPIALASSFHHHYPNLRFLPFNFNFITKLPVSNSFAIGSSSRSFHSSPLKKDSSCFCCSMAVEVGSASSVSQSELQGSLNSCRAYWPSKYTFAWNVDIGNGSYYLFASKTAALKFTDAGIEGYDVKIKLDKDQGGLPANVTEKFPHIRGYSAFKAPATLDVDSLLKCQLAVAAFSADGACRNATGLQLPGVIDELYSYDGPLGAVFSENTISLYLWAPTAQAVSASIFKDPSGGEPLQTVQLIESNGVWSAVGPRTWEGCYYVYEITVYHHSTLRIEKSFAIDPYARGISADVKRTLLADLSSETLKPEGWENLADEKPHLLSPSDISLYELHIRDFSAYDLTVHPDLRGGYLAFTSQDSAGVNHLEKLSAAGLTHVHLLPSFQFAEVDDDKKKWKFVDTKRFETLPPDSEEQQAQITAIRDEDGYNWGYNPVLWGTPKGSYATDPNGPCRIIEFRKMVQALNRIGLRVVLDVVYNHLNSSGPSDDNSVLDKIVPGYYLRRDNDGAIENSTCVNDTASEHFMVERLILDDLKHWAVNYKVDGFRFDLMGHIMKHTMVKATNMLQGLSKNIDGVEGSSIYLYGEGWDFGEVANNARGVNASQLNLGGTGIGSFNDRIRDAVLGGGPFGPPLQQGYVTGLSLQPNDHDHSGKANADRMLAVAKDHIQVGMAGNLRDYILTNCDGKQVKGSEVYTYGGTPVGYAMQPIETINYVSAHDNETLFDIVSLKTPTYITVDERCRVNHLATSILALSQGIPFFHAGDELLRSKSLDRDSYNSGDWFNRLDFSYNSNNWGVGLPPKDHNESNWPLIKKRLANPSYKPDKNHIIAAVENFTNLLQIRYSSPLFRLRSAKDIEDRVRFHNNVPSWIPGLIAMSIEDGHAGAPGLSQIDPKFQYIVVIINVQPTETKFVNPDLRAKSLQLHPVQSTSGDTVVKESKYEPSTGCFTIPPKSTAVFVEPRHV

SEQ ID NO: 11952 - protein, 195 aa, Griffithsia japonica
ARGAPLFKPRLRPISSYLSTFYSSLPTHNSSHLHPKHTLFIVMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGQ

SEQ ID NO: 11953 - protein, 257 aa, Prochlorococcus marinus
MKPSRLSSLDPVKMPEWRWAPFLSHAINAFIPLKPEPYPVAPEFLQREGKTGSKSQPIRVTTCTWACRTKKFRQVRAACVEAGRSASVLNFVINPYHTFDLPFFGADLVTLPSGHLLALDLQPAITSDERHTKQVWERLMPIFEHWRVHLPEGGPIPEEAKPYFSPGFLWTRLPLSIEGNQLIDEVIMPAFKDYLNLYLDLVEMAEEVSPQRAFKLLEGQKRYLSYRAKKDPARAMLARFHGHQWTESYIHNVLFDL

SEQ ID NO: 11954 - protein, 237 aa, Unknown
  Synechococcus sp. CC9605
MLPSWLSPRGGAESSAPATHAVLGTPLKAPLMADQEEAIFACGCFWGAEKGFWRLPGVVSTAVGYAGGQTEQPTYNQVCSGRTGHTEVVRVVWSRPALDFSDLLKLFWECHDPTQGNRQGNDTGSQYRSAIYTFNPEHLQLALASRDAYQVALSAKGYGAITTEILADQTFYFAEDYHQQYLAKPGSRPYCSAMPTQTLLGEFEGSNYKLPKQVWDKYDWSINHCVLRSDNSPIAIG

SEQ ID NO: 11955 - protein, 567 aa, Dioscorea tokoro
  misc_feature (238)..(238): Xaa can be any naturally occurring amino acid
  misc_feature (303)..(303): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAXSIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPBHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 11956 - protein, 161 aa, Oryza sativa
MGGWAAEQASEAGCPTSGGGGSACAATGIPKMVYNCAGDETLDWGRGGAAMVGAGLAGVVVAAVVAVVIDTAIATALSESKPVYISVGCNLAGLSHPTFSREPVPLFISPRLSNKANLEYAVEAAADFLNKAVKPMMVGGPKFRVAKAKKAFAGIAESSGY

SEQ ID NO: 11957 - protein, 360 aa, Prochlorococcus marinus
MTTWVIKIGTSLLRGNDKYTTFDVINDYCSYISKAQRNGDKIILVSSGAVGLGCHQMRFKTRPKEIISLQASAAIGQLHLMALYEKAMSSFGYKVAQILLTRSELGSRNSYNSASQTLKRLLEWDVIPIVNENDITSDEELKYGDNDTLSALVATAISADQLILLTDIDHLYSSDPKINSKAKPIKDINNSKELNNLELANEQTSWGTGGIKTKLTAAKIATESGIKVQLADGRDPKILGELLDGKKIGTVFHPNPNPIGNRKSWLAHAIKPVGEIHLDDGASEAIKNKGASLLLVGVKKVSGDFIANQPVKVINTEGEEFAKGICSMSSDAIKIGINSRSETTGSPLVIHRDVLVLTSE

SEQ ID NO: 11958 - protein, 431 aa, Triticum aestivum
MAERLASSASLLPSAASPSSSTRRAAVASGLRLRPSPSRFSQAARRARGGAGAAGVVPRLRAVRCMAASEAAQLKSAREDIKEILKTTYCHPILVRLGWHDSGTYDKNIEEWPQRGGADGSLRFDPELSHGANAGLTNALKLIQPIKDKYPGITYADLFQLASATAIEEAGGPKLPMKYGRVDIAAPEQCPPEGRLPDAGPRIPAEHLREVFYRMGLDDKEIVALSGAHTLGRSCPDRSGWGKPETKYTKDGPGEPGGQSWTAEWLKFDNSYFKDIKEQRDQELLVLPTDAALFDDPSFKVYAEKYAEDQGAFFKDYAEAHAKLSNLGAKFDPPEGFSLDEDKGAVATEEKVVADPAPTSDTNGAGPQPEPFVAAKYSYKKRELSDTMKQKIRAEYEGLGGSPNKPMKSNYFLNIMIVIAGLAFLTSLTGN

SEQ ID NO: 11959 - protein, 991 aa, Acidobacteria bacterium
MLRRLSLPVLILLCTLAGYAQGPTQARIHYYRPDAQFAGWGLHVWNNTTDNVTWTTPLQPAGSDSYGIYFDVDLFDATTPLGFIIHKGDTKDPGPDMYMDVTQPGRNAWIISGDSTIYYTQPTKSQLLSANFHRLQAYWIDRNTIAIQAAYFHSGDTVRLHSDLSAGLAITDTGLTGGQSTLLTPDPSGLTPAQLATFPQLNGYAAFHLQNARSFNYAMYLKGQVAVSDVDSAGNLTYATGVQTPGVLDDLYFYSGKLGPSFRGTVPTVSVWAPTAQSVALQLFNAATDATPTQVVPMHESNGVWSVQGKPQWKNKYYLFNVKVYTPFTFSVVENVVTDPWSLGLSLNSTKSQIIDLDDASNKPLGWDLLPSPPLASWNDLSIYELHIRDFSATDSTIPAVQRGTYLAFTDQTSNGMKHLRSLSQSGLRAVHLLPNFDIASVNEDKTTWKTTGDLSVYPPDSDQQQAAVAAIQGQDGFNWGYDPLHYLTPEGSYAVNAASRTKEYRAMVESLHANGLRVIQDVVFNHTSSFGQNPNSVLDEVVPDYYYRLDANGANYFASCCADTATEHRMMEKLMIDAVTTFAKEYKVDGFRFDIMSFHLLSNIQHVRQALDQLTLRNDGVDGRKVYLYGEGWNFGETGNNALGKNAMQSNLYGTGIGSFNDRTRDGVRGGGPFNDVREQGFATGLFTDPNTTFSIGDSDTQKAKLLQESDWIRIGLTGNLRDYSFTDSNGNTVTGGSVDYNGQHAGYTAQPIEDISYASAHDNQTIFDAVQLKSNITDSIADRTRRQNLANSLILLGQGIPFFHAGDDILRSKSGDNNSYDSGDWFNKIDWTLQTDNWGVGLPIASQNSFQWSDLQPLLADPALMPQPANIQRAYDHFCEMLRVRYSSPLFRMSTEPQIQANLRFLNVGPNQIPGVIAVVLGTGRQQIVVVFNGSNASQTISDASLANLRLQLHPVLQHSTDPVVKQSTYNSNGSVTVPALTTAVFTPR

SEQ ID NO: 11960 - protein, 328 aa, Hordeum vulgare
MCGGAILAQLIPPSAGRPSKQAAAGGRAPPTSSKKGGVSKSRHSSTPDADDDVFEAAFEDFDDHFDLRAEEDGGDDHVVFASKPAFSPRPAYDGGRAAHAASRKKRTGHLHGIRQRPWGKWAAEIRDPHKGTRVWLGTFDTADDAARAYDVAARRLRGSKAKVNFPDAARTGARPRRASRRTAQKPQCPPARTTAYSATAAARAQPEQDAMMVKPELMEFFNVDAIVHLTTAVAALPPVTASTFADTMPRVDEDSSVGSGGGAMLGFADELGFDPFMMFQLPCSDMYESADSIFAGDAVIPDALSVDSGMDAVSLWSFDEFPMDSAIF

SEQ ID NO: 11961 - protein, 304 aa, Silicibacter pomeroyi
MLELGQKAAPAADLIKDTNEATFMADVVEASQTVPVIVDFWAPWCGPCKTLGPALEAAVTAAKGAVKMVKVNVDENQMIAGQMRIQSIPTVYAFYQGQPVDGFQGALPASEISAFVDRVIAAAGGEAPGAQLEEAVVAAEEMLEQGAAADAAETFAAILGEDPNHAAAYGGLVRAHIALGDLDQAEAILNGAPAEISTKPELEAAHAQLELARQASNAGPVAELAAAVEADPDNHQARFDLAQALHAAGQTEQAVAELLDLFRRDREWNEGAAKAQLFTIFDALKPNDPIVLNGRRKLSSMIFA

SEQ ID NO: 11962 - protein, 467 aa, Vibrio parahaemolyticus
MNSSQMKMILLVAIGCILWFIPTPEGLTDQAWQMMAIFVTTVLSLILAPLPLGAMALMGLTLATLLGVLPIKTALTGFAHPTIWMIAAAFFISRGFITTGFGRRVGYWFISKLGHNSLGLAYGLVLTDLLFAPATPSTTARCGGIISPLFRSVASAYDSDPEKGTENRIGAFLVQCIFQCNAITCAMFLTSMAGNPLAANFAKEQGVEITWAGWATAAIVPGLLCLFLIPLVMYMVFPPELKKTPEMREIARQKLAEMGKMTRDELMVCITFIGMVSLWVLGPTLGIHATVTALLGLVFLLLTHTITWDAVLGEKEAWHTITWFAVLVMMAAQLNKLGFISWFSESMAESLSGFGWVTTIVVLLLVYYYSHYLMASAMAHISAMYSAFLAIAISAGAPPMLAAIVLGIFSNLYMSTTHYSSGPAPILFGAGFHTLQNWWKIGFIFSLIVIPIFVFVGGAWWKLLGLW

SEQ ID NO: 11963 - protein, 359 aa, Unknown
  Synechococcus sp. RS9916
MSVTSTDQVQDPAATSEQDAAAEATMAEAFAEEDLSIPEDVPSADDPSSRANPRDLESAGFSLDEFAALLSKYDYNFKPGDIVNGTVFALESKGAMIDIGAKTAAFMPMQEVSINRVEGLGDVLQPGEVREFFIMSEENEDGQLALSIRRIEYQRAWERVRQLQKEDATIYSEVFATNRGGALVRVEGLRGFIPGSHISTRKPKEELVADFLPLKFLEVDEERNRLVLSHRRALVERKMNRLEVGEVVIGTVRGIKPYGAFIDIGGVSGLLHISEISHEHIETPHSVLNVNDQMKVMIIDLDAERGRISLSTKALEPEPGDMLTDPQKVFDKAEEMAARYKQMLLEQAEEGEEAYGMMG

SEQ ID NO: 11964 - protein, 358 aa, Sinorhizobium meliloti
MARFYPLQVTEVRRDTRDAVVVTLEPREEDRAAFDFTQGQYLTFRRLFGGEELRRSYSICAGLDEGALKVGIKRVDDGCFSSWANEELEPGDTLEAMPPMGAFFTPIEPEAAKHYLGFAGGSGITPVLSLVKTVLAREPRSAFTLVYANRHFSSIMFREELDDLKNLYLGRLSVLHVLESEAQEIDLFSGRLDREKCTALFRSWIDVRSADTAFICGPEPMMLGVAAALRAHGLGDDRIKFELFAASQPGRARRKVESAAGADSRARCEATVTLDGATRSFTFPKEGLSLLEAALENRMDAPFACKAGVCSSCRAKVLEGEVEMESNNALEDYEVEQGYVLTCQSYPLSDRIVVSYDQ

SEQ ID NO: 11965 - protein, 835 aa, Medicago truncatula
MMAVSSGCKDGSKIAMDNGKYVRYTPEQVEALERLYHECPKPTSLRRQQLIRECPILSHIEPKQIKVWFQNRRCREKQRKEAGRLQAVNRKLTAMNKLLMEENDRLQKQVSHLVYENTFFRQHTQNTTLATTDTSCESVVTSGQQHPQPRDASPAGLLSIAEETLAEFLSKATGTAVEWVQMPGMKPGPDSIGIVAISHGSPGVAARACGLVGLEPARVAEILKDRLSWYRDCRTVDVLNVMSTGNGGTIELLYMQLYAPTTLAPGRDFWLLRYTSLLEDGSLVVCERSLNNTQNGPSMPPVPHFVRAEVLPSGYLIRPCEGGGSIIHIVDHMLLEPWSVPEVLRPLYESSMLLAQRTTMAALRHLRQISQEVSQPSVTGWGRRPAALRALSQRLSKGFNEAVNGFTDDGWSMLDSDGIDDVTLLVNSSPSKMMGLNLGYNNGFPSVTSSVLCAKASMLLQNVPPAILLRFLREHRSEWADTSIDAYSAAAIKAGPCSLPGARTGAFGGQVILPLAHTIEHEEFMEVIKLENMGYYRDDMTMPGDIFLLQLCSGVDEHAVGTSAELIFAPIDASFSDDAPILPSGFRIIPLESGTDAASPNRTLDLASALEVGTTGNKAGGDNSGHSGITKSVMTIAFQFAFEAHLQDNIAAMARQYVRSIVASVQRVSLALSPSRFGSQNAFPLPPGTPEAQTLTRWICNSYRFYLGAELLKCEGSESILKSLWHHSDAVLCCSLKALPVFTFANQAGLDMLETTLVALQDITLEKIFDDNGKKTLCSEFPQIMQQGFMCIQGGICLSSMGRPITYERAVAWKVLNEEESAHCICFMFINWSFV

SEQ ID NO: 11966 - protein, 243 aa, Blastopirellula marina
MKDGSANSVIKELVESGIHYGHRTSRWNPKMAPYIYAKKNQIHIIDVRETIRGLLRAKKYLTQVSEGGSLVLFVGTKRQAGASIEREAERCGMPFINERWLGGTLTNFRTIRSRLTRLEELERILEGDELSKYSKKMQSSLAREYRKMYRNLNGLRTMNRLPETLVIVDPKKEKNAIREAHSLGITTVALTDTDCDPDEIDLPVPGNDDGIRSIELFTKHLADAVLDGKHNVAMKGKDAVPAS

SEQ ID NO: 11967 - protein, 96 aa, Retama raetam
GRVRCSMEEKPSVQESSPSMGVGASLMAAACAAATMSSPAMALVDERLSTEGTGLPFGLSNNLLGWILFVVFGLIWTFYFIYASSLEEDEESGLSL

SEQ ID NO: 11968 - protein, 349 aa, Blastopirellula marina
MAEKVLIIGSGPAGWTAAIYAARAELQPLVYEGAPLQEHYDVGRGPLGQLAMTTEVENFPGFPSGDMTAYLDGSIDNSIRQYMAPHMKHGVSGPELMELMRQQAKNFGTRIVGDDIVEVDFESRPFRLKSREGEWIEAHSVIVATGARANYLGLPSEAMYKNRGVSACAVCDGALPRFRDQPCIVVGGGDSAVEEADYMAKFSSKVYLVHRRDELRASKIMAERAEKNPKIEIVWNSVVDEVIGDDDNGVSGAKLTNVVDNTSKVYEASGFFLGIGHTPNTDFLVGKLDMTDKNYLKWTVPFRTNTSVEGVFAAGDVADDNYRQAVTAAGTGCMAALDAERYLAAQGHH

SEQ ID NO: 11969 - protein, 413 aa, Mycoplasma pulmonis
MYKKITLNDKEVEQAINNELKRQQEHVELIASENFVSEDTLKAVGSILTNKYGEGYPSKRYYGGCENVDVVENLAIERAKKLFNVKYVNVQPYSGSVANASAIASLANNGDTILGLSLKSGGHLTHGYKISFSGFFYNSHTYEVDENGFLNYDDILKIAKEVKPKVIICGYSAYPRIVDFKKFREIADEVGAYLLADISHIAGLIVTNNHPSPSEYADVIMTTTHKTMRSARGAIIMTNNEELAKKIDRWVFPGYQGGPLFHAIAGKATGFYEALQPSFKTYQDQVVKNAKVFADEFIKLGAKVISGGTDNHLLIVNVFDSYGITGKKAENILGKINITVNKNTIPFDTNSPMVTSGIRLGTPAMTTRGFKENEFILIARIMVKALKNPDDLSLHQELKNEVLEITKKFSLPW

SEQ ID NO: 11970 - protein, 463 aa, Blastopirellula marina
MQKISVRSALSADQVGNQVKLEGWVRTRRDSKAGFSFIELNDGSCMGNIQVVADGALTNYESEVKKLSAGCSVRILGEIVASQGKGQTTEIQASEVHVYGWADPESYPLQKKRHSMEKLREWAHLRPRTNTFGAVFRVRNCVSRSIHNFFQERGFLYVHTPIITASDCEGAGEMFKVTTLDLDAPPKTGGKVDYTQDFFERPSYLTVSGQLEGEIFATALGNVYTFGPTFRAENSNTSRHLAEFWMVEPEMAFVDLEGNMQVAEDFIKRIISDVMRDCGDDLQFFNDRIDDTVLATLTAMADGEFLRVSYTDAIDILLKSGRKFDYKVEWGTDLQSEHERFLTEVHFKRPVILHDYPRTIKPFYMRCNDDGKTVRAMDVLAPKVGEIIGGSQREERLDVLEQRMQEQGLNPADYWWYVELRKYGTIPHSGFGLGLERILQFITGMGNIRDVIPFPRTPGSADF

SEQ ID NO: 11971 - protein, 481 aa, Glycine max
MLDSATPHDKITTAASGFVLEDVPHLSAYIPHLQTYPDPLQDNPSYSVVAQYYVNVDDTIAQQIVVHKNSPRGTHFRRAGPAQKVYFDSEEVHACIVTCGGLCPGLNTVIREIVCGLYHMYGVHKVLGIQGGYPGFYSRNTVPLTPKVVNDIHKRGGSILGTSYGGHDTSKIVDSIQDRGINQVYILGGYGTQYEAAMIFEEVRRRGLKVAVVGIPKTIDNDIPVIDKSIGFDTAVEEAQRAINSAHVEAESAENGIGVVKLMGRYSGFIAMYATLASRDVDCCLIPESPFYLEGPGGLLEFIEKRLKEQGHMVIVIAEGAGQELLSGNPSIVNKPDASADKLFPDVGLWLSQKIKDHFEKRQKMAINLKYIDPTYMIRAIPSNASDNVYCTLLAQSAVHGAMAGYTGFTVGPVNGRNCYIPFHLINEGEKRVVITDRMWARLLSSTHQPCFLNPKEITGEREERTENQTTDGQNHSEIAD

SEQ ID NO: 11972 - protein, 552 aa, Mycobacterium smegmatis
MILSVDDDPAVSRAVARDLRRHYGERYRIVRAESGPDALETLHELKLRGDTVAVFVADYRMPQMSGIEFLESAMDLYPMARRVLLTAYADTNAAIAAINVVDLDHYLLKPWDPPEEKLYPVIDGLLEAWHAAGDRAIPYTKVIGHQWSPRSWEVRQFLARNQHTYRAFNADEPKGRQLLEAAGLDGMQLPVVITEGGTTLVEPTDAELADMLGLSTAPSLTMYDLAVIGGGPAGLAAAVYGASEGLKTVLIEGTTTGGQASRSSRIENYLGFPTGISGAELATSARRQAERFGAEVITTREAVKLEVAGSARTITFADGDTIGARAVILATGVDYRQLPVPGCWDDPDNPVNFIGRGVYYGASVSDAAECCDEDVYIVGGANSAGQAAMFMARTARSVTLLVRGPSLEASMSYYLIQQIEDTPNIHVRTCTEVVKAIGEDDHLVGLVLENKRTGEQEEVRSSRLCCFIGATPRTEWLDGVVARDEHGFILAGPDLRDVCGWTLERPPHHLETSVPGVFVAGDVRAESAKRVAAAVGEGSMAVMFVHRYLAES

SEQ ID NO: 11973 - protein, 335 aa, Unknown
  marine gamma proteobacterium HTCC2143
MEISFPPRLSLAQTPTPLIAIDRISEVVGGPRIWVKRDDMTGSAVSGNKIRKLEFSLAKALDEGCDTIITCGGVQSNHCRTTAVLCAQLGLKCHLILRGPEDSEIEGNLLLDRLVGAEISFYTNREYQQKSDEIIQHWMQHYHEQGSKVFSIPVGASDGIGLWGYIAACEELKDDFSQLNIQPGHIISATGSGGTQGGLTVGSELFQLGAKVWGMAVCDDANYFINKVKQDIAQWRQWYSPLISPSFDCDSLCVNVIDDYIGPGYAQATPDIFATISMAARLEGLILDPVYTGKGFHGMLDQIRQGRFDDTNDIVFVHTGGIFGLFPQRDQLGLS

SEQ ID NO: 11974 - protein, 417 aa, Streptococcus thermophilus
MLSRVRIGWLLLEDFFRMNEFEELLNSVSEVSTGDVVTAEVISVDNDQANVVIEGTGIEGVLTRRELTNDRDANVADLVKDGETLEVLVLRQVVGKDTDTVTYLVSKKRLEARKAWDKLVGREEEVVTVKGTRAVKGGLSVEFEGLRGFIPASMIDTRFVRNTEQFVGQEFDAKIKEVDPAENRFILSRREVVEAEAIEARKEVFSKLEVGSVVTGKVARLTSFGAFIDLGGVDGLVHVTELSHERNVSPKSVVSVGDEIEVKVLAIDEEAGRVSLSLKATTPGPWDGVEQKLAAGDVIEGKVKRLTDFGGFVEVLPGIDGLVHISQISHKRVENPKDVLSVGQDVTVKVLEVNADAERVSLSIKALEERPANAEGENNEKRQSRPRRPKRQEKRDYELPETQSGFSMADLFGDIEL

SEQ ID NO: 11975 - protein, 367 aa, Allium cepa
MAPAQTPFLPTISDEKTLRSSFVGDEDERPKIAYNVFSDEIPIISQDGIDDANGKRGEICRKIVEAREDWGVFQVIDHGVEQEVIKDMTKMAREFFALPPEEKLRFDMSGGKKGGFIVSSHLQGEAVQDWREIVTYFSYPIRARDYSRWPDKPEGWISVAEKYSEKLMDLACKLLGIPSEAMGLDTEALTKACIDMDQKMVVNFYPKCPQPDLTLGLKRHTDPGTITLLLQDQVGGLQATKDGGKTWITVQPVEGAFVVNLGDHGHYLSNGRFKNADHQAVVNSNYSRLSIATFQNPAPEVIVYPLAIREGEKPILEEPITFAEMYRRKMSKDIELAKLKKLAKKNKEISEKTQIAALPKAIDEILA

SEQ ID NO: 11976 - protein, 335 aa, Allium cepa
MEVERVQAIATLTANLGTIPSEFIRSDHERPDLTTYHGPVPELPVIDLANSSQENVVKQISEAAREYGIFQLVNHGIPNEVINELQRVGKEFFLLPQEEKEVYATVPDSGSFEGYGTKLQKDLEGKKAWVDYLFHNVWPKHKINYKFWPRNPPAYRKANEEYTKHLQVVVDKMHSYLSLGLGLESHVLKEAVGGDDLEYLLKINYYPPCPRPDLALGVVAHTDMSSLTILVPNEVPGLQVFKDDHWFDAKYIPNALICHIGDQLEILSNGKYKSVLHRTTVNKEKSRMSWPVFCSPPGDTMIGPLPQLVNDGNPPKFKTKKYKDYAYCKINKLPQ

SEQ ID NO: 11977 - protein, 457 aa, Unknown
  Acinetobacter sp. ADP1
MEIFPISLKLQQQRCLIVGGGHIAYRKAILLVKAGAILDIVAPDIDPQLMSLIEQSAGTAYVKLFEDHDLDRVYRLVIAATDNADVNKRVFEQAELRNLLVNSVDDIPNCRFMVPAIIDRSPLLISVASNGASPVLSRQLRTQIETLVPHGMGKLAEFSGQWRSRVKAQITNPDERRIFWEELYASPLKEQVFNDNLDIANQMMTQSLAEWTAPKGEVYLVGAGPGDPELLTLKALRLMQQADVVIYDRLVSAPILELCRRDAEKVYVGKARSNHSVPQEGINALLVKYAQAGKRVCRLKGGDPFIFGRGGEEIQELFAAGIPFQVVPGITAASGCSAYAGIPLTHRDYAQSVRFLTGHLKEGSPELPWSELVYENQTLVLYMGLVGLEHICQQLIAHGQRPDMPVALVSKGTTPEQKVVVGTLSNIASKIAEYQIHAPTLTIIGEVVSLREQLQWL

SEQ ID NO: 11978 - protein, 213 aa, Xylella fastidiosa
MSHSKSSQRWLKEHFSDPFVKKAQAEGMRSRAAYKLEEILKRDRILRPNMVVIDLGAAPGGWSQQIRKQMGDRGRVIALDIVKMAPLVGIEFLQGDFRDKAVLSQLEIMLKGQPVDLVLSDMAPNKSGMDAMDQPRMMYLAELAMDFADIHVKPGGSFLIKLFHGVGSDDYIRQLRHRYKKVAIRKPLASRKRSPEVYILGDGKLTQNEVSCS

SEQ ID NO: 11979 - protein, 377 aa, Bradyrhizobium japonicum
MSTSTKRCYYETLEVERDADESKLKSSFRKLAMKFHPDRNPGDDTSEVKFKEINEAYEVLKDKDKRAAYDRFGHAAFEQGGPGGGAGFGAGFASSFSDIFEDLFGMAGQRGRGGRERGADLRYNMEITLEEAFGGKTAQIEIPVSVTCEACSGIGAKAGTKPKTCSTCGGAGRVRQSQGFFTLERTCPGCQGRGQMIEDACPSCSGQGRVTRERTLSVNIPQGVEDGTRIRLAGEGEAGVRGGPPGDLYIFLSLAQHQFFQRDGADLHCRVPISMVTAALGGEFEVPTIEKGKAKVKVPAGTQSNRRFRIASKGMPVLRSRQTGDMYVQVVVETPQNLTKKQQELLAEFEKLSSGNTQPESEGFFTKVKDFFGSRAN

SEQ ID NO: 11980 - protein, 145 aa, Novosphingobium aromaticivorans
MTKFLHTMIRVTDPDATIAFFELIGLKETRRFDSEKGRFTLIFLAAPGEEGIAEVELTYNWPPEDGSPAEGYSGGRNFGHLAYRVDNIYDTCRRIMDAGHIVHRPPRDGHMAFVKTPDGISIELLQDGHLPPQEPWASMENTGTW

SEQ ID NO: 11981 - protein, 553 aa, Acidobacteria bacterium
MPDSAGILPLPLFSSSLKRDTSRPVMLIGFQHQGNLGLGYLASTLREHGYSVLTCDFEAETSEIIESARQSKPMIVGFSLIFQFYIRKFDALMQALRAAGVDCHFTIGGHFPSLSHEETLRMLPELDSVVRFEGEMTLLELADVIGTGRDWHDLQGIAYRGTTGVVTNPMRSLVDDLDSLPYPERNFEPEKALGRKALPLLASRGCARTCSFCSIQTFYRTAPGKIVRTRKPAKVIEEMQAMHEERGISIFLFQDDDFPLFGPVWRRWAYDFVDCMHRSGLAQRVIWKINCRADAVEPEIFTAMRDAGLYLVYMGLESGNEEGLKTLHKQVSVEQNIRAVEMLKQVGLLFEFGFMMFDPGSTLESIKQNLRFLRTILNDGCAAAVFCRMLPYDGTPIKDELERAGRLLGDVCAPSYDFLDPRVSKMYNSLSQIVDVWGWIHGYRALSPQLNWAWNEVAIMERLYPGIDGLEEYRRRLAAVTKKSNDVLFSVMDNLLEVAEFDAAERWDNARLDALRREFLEELLRERDAFVEHNQSTMLRVLRAQPVQEAASA

SEQ ID NO: 11982 - protein, 134 aa, Unknown
  Enterobacter sp. 22
MSSMLQNLNNIRTLRAMARDFSIDVLEEMLEKFRIVTEEKRNEQNEMQQQQAEQQQKINALLERMKADGISPEDLLGKDVLKGASQSQKRQVREAKYRFTDVNGEEKTWTGQGRTPKAIATALANGKSLEDFLI

SEQ ID NO: 11983 - protein, 139 aa, Oryza sativa
MAPKAEKKPAEKKPVEEKAEKKPKAEKRVPGAKEGGGEKKGKKKAKKSVETYKIYIFKVLKQVHPDIGISSKAMSIMNSFINDIFEKLAQEAARLARYNKKPTITSREIQTSVRLVLPGELAKHAVSEGTKAVTKFTSS

SEQ ID NO: 11984 - protein, 154 aa, Bacillus cereus
MGYVEELRKIVGHRPLILVGAVVLVINEHGYVLLQQRTEPYGKWGLPGGLMELGESPEETACREVYEETGIEVKNLRLINVFSGANYFTKLANGDEFQSVTTAYYTDEYNGDFVMNKEEAVQLKFFPLTELPDYIVGSHKKMIGEYMKIMEKKI

SEQ ID NO: 11985 - protein, 439 aa, Arabidopsis thaliana
  misc_feature (411)..(411): Xaa can be any naturally occurring amino acid
MGKECYYLSWILKFHLLLVLIQLVDSGSTIRFLPGFQGPLPFELETGYIGVGEAEKDQMFYYFIKSESNPEKDPLLLWLSGGPFCSSFTALIYENGPIAFKAEEYNGSIPSLVSTTYAWTKVASILYLDQPVGTGFSYSRNPLADIPSDTGVAKPVNEFLHKWLDKHPEFLSNPLYVAGNSYSGIVIPTIVQEISNGNHLDSKPQINLQGFVLGNPATDTDIDLNSRIPFAHGKALISDEHYESLKRSCQGNYISVNPRNTKCLKLLEDFKKCVSGISEEYILKPDCMWLYSCMANLHSLSEYWANEKSVRKALLVNEGTVRKWIRCNTEIAYNKDIRSSVPYHKYISIEGYRSLVFSGDHDMLVPFLGTQAWIRSLNYSIVDDWRPWMVQNQVAGYTRTYANKMTFATVXKQGGGHTSEYKPVETYIMIKRWLSGQPL

SEQ ID NO: 11986 - protein, 261 aa, Unknown
  Erythrobacter sp. NAP1
MDAPSPISQGMEIGTIYLVGAGPGDPDLLTLRAARLIERAEVIVHDGLVSREILAMARPDALLISVAKQRSRHTLPQDQINALLVREAKAGRDVVRLKGGDPLIFGRGGEEAEDARASGVSVEIVPGISAANGAAAATQIALTHRDASSVVSFVAGQCKGLSDQDWTGLAGKGRTLVIYMGVKTAPQIAEKLMADGLAPDMPLAVIENAARPEMRVLRGPLAALPDLVVREAVKSPALIVIGDVTAREDADIAKLAVEAHQ

SEQ ID NO: 11987 - protein, 221 aa, Yarrowia lipolytica
MTRRIASIRRETKETKIQIAISIDGGALELPGPTMLPEGADVSHAYQKTDTQHISVWTGVAFFDHMLHALAKHSGWSLLVECIGDVHVDDHHTVEDTAIALGGCFKEALGHLRGIKRYGYAYAPLDEALSRCVVDLSNRAYCVTELGLKRERVGQLSCEMVPHIFESFAHSAAITIHVDVIRGANDHHRIESAFKATALALRMASSITFGDEVPSTKGVLR

SEQ ID NO: 11988 - protein, 653 aa, Streptococcus pneumoniae
MNKKKMILTSLASVAILGAGFVASSPTFVRAEEAPVANQSKAEKDYDAAVKKSEAAKKDYETAKKKAEDAQKKYDEDQKKTEAKAEKERKASEKIAEATKEVQQAYLAYLQASNESQRKEADKKIKEATQRKDEAEAAFATIRTTIVVPEPSELAETKKKAEEATKEAEVAKKKSEEAAKEVEVEKNKILEQDAENEKKIDVLQNKVADLEKGIAPYQNEVAELNKEIARLQSDLKDAEENNVEDYIKEGLEQAITNKKAELATTQQNIDKTQKDLEDAELELEKVLATLDPEGKTQDELDKEAAEAELNEKVEALQNQVAELEEELSKLEDNLKDAETNNVEDYIKEGLEEAIATKKAELEKTQKELDAALNELGPDGDEEETPAPAPQPEKPAEEPENPAPAPKPEKSADQQAEEDYARRSEEEYNRLTQQQPPKAEKPAPAPQPEQPAPAPKIGWKQENGMWYFYNTDGSMATGWLQNNGSWYYLNSNGAMATGWLQYNGSWYYLNANGAMATGWLQYNGSWYYLNANGAMATGWLQYNGSWYYLNANGDMATGWLQYNGSWYYLNANGDMATGWAKVHGSWYYLNANGSMATGWVKDGETWYYLEASGSMKANQWFQVSDKWYYVNGLGSLSVNTTVDGYKVNANGEWV

SEQ ID NO: 11989 - protein, 138 aa, Oryza sativa
PSRSAVEAAGGQSGDGGARARARAVTAACRPFGMGTVRGSLFHFLKGTYNSPNGERLVGGAQAVLMNAAGGRQLRGVFMHQKEDLWNSIIAGAATSGFLSMRQGLNTAGRSALMGGMLLALIEGAGLMLNRVLASPRR

SEQ ID NO: 11990 - protein, 730 aa, Kluyveromyces lactis
MSSDVSSPISEVPFVEKFLGEVECEEYLPTFEKFRLFDEDRLYYLDREILEELGVKKIGDKIKILKQSRQLRRDASGFNPKKELVEITAKINALNSNPLSINEELVTDKHSVIFILNDGSAKKVNVNGCFNAHSIKKKLIKRLPSEFISIDPVTKEATHSSQDYDVFVVDYVKNVLHLLYDVELVTICHSSDRLEKNRLIFVSKDQTPSEKAIFTSKKVYLKTLSVMQQMGSQPGAGRPLLSGPGTNALRIENRSDNIREIFTQRPPTELISTNLPEYFPHTDINRLKKTLRNSMRQSIRASMIRGKNGSLVSLAGSNKIGDILVNQSHAVDRALLESIQNDGSASNSADHAVPMHNTSTNGSDASTASLTPLMKRTSISSNSRNSKSSVRGRSGSESGTSESNDKIELYSTDTDTEGEEDDAEDTISLPTKVEAPKSWLKGARIGSGSFGSVYLGMNAETGELMAVKQVELKPTAVTAGVVSIADESKKAHSPGGGNTAVKNTSQIHRKMIDALQHEMNILKELHHENIVTYYGSSQEGGNLNIFLEYVPGGSVSSMLNNYGPFDEPLVKNFTRQILIGLAYLHKRNIIHRDIKGANILIDIKGGVKITDFGISKKLSPLNKQQNKRASLQGSVYWMAPEVVKQVVTTEKADIWSVGCVIVEMFTGKHPFPDFSQMQAIFKIGTNIIPEIPSWVSEEAKAFLFKSFELDYRKRPSSLGLLQEPWLNTVL

SEQ ID NO: 11991 - protein, 271 aa, Unknown
  delta proteobacterium MLMS-1
MNQPQNIIHFVGAGPGDPELITVKGSRLLAAAELVVYTGSLVPRELLRGLAAEIHDSAGLTLAEVIDLLAAGWRAGKNVVRLHTGDPTIYGAIGEQMARLAELGIPWRVVPGVSSATAAAAALDAELTLPEISQTVIITRRGGRTPVPAAEDLTGLAAHQATMLILLSAGMIEQVVAELLAGGYPSTTPAAVVEKASWPEQRIVRGTLADIAAKTTAAGITKTAIIAVGRVLAAAPPPVLSKLYDAGFSHGYRSGGGQQTADRKRERKRRN

SEQ ID NO: 11992 - protein, 321 aa, Magnaporthe grisea
MFGRSAPKFDPAKDIPNQAGRIAFVTGGNGGLGLETVIQLAKAGMERIFIGARNEEKALKAIKEISTNLNCSTTFTFVKMDLTSFDSVCRAADQVISQTDKLHLLINNAGVVGTAPGLTPEGYETQWGTNHMGHALFTRLLLPLLKQTAEGGRVDVRIVNVSSLSERMCALHGCGDLEVFKRAEAKGPLWGAGLFWGYGASKLATILHARMLAKKHPSVKAVAVHPGTVKTTITGSFSKTSPFIGGYVMPFITALFFVDVSEGARNQLWAATSDQANTGEYYAPVGRPNMGSGKSRNMKEAERVWEWTERELDAYLRKTGR

SEQ ID NO: 11993 - protein, 318 aa, Herbaspirillum seropedicae
MSTTPKHAKVLILGSGPAGYSAAVYAARANLNPVLITGVEQGGQLMTTTDVENWPGDPLGVQGPELMQRLLQHAERFKTEIIFDHIHTTKLSERPFRLIGDSGEYTADALIIATGASAQYLGLPSEQAFMGRGVSACATCDGFFYRGKEVAVVGGGNTAVEEALYLSNIASKVTIIHRRDKFRAEPILIDRLLHKVSEGKIAIQWHHTLDEVVGDDSGVTGIKIKSTQDDAITEIPVHGLFIAIGHKPNTSIFEGQLSMQNGYLKTRTGTEGFATATSIDGVFAAGDVQDHVYRQAITSAGTGCMAALDAQRYLEGLE

SEQ ID NO: 11994 - protein, 128 aa, Vibrio parahaemolyticus
MKFLHTMIRVVDLDKSIEFYTKVLGMSVLDRFENQEYRYSLVFVGSPDQPDGATIELTYNWDTGSYDLGNAFGHMALGCEDIYAACEKIKALGGNVTREPGPMKGGETHIAFIKDPDGYPIELIQTKQ

SEQ ID NO: 11995 - protein, 242 aa, Fagus sylvatica
STFAAAPLVPIIRDNLNLTKADIGNAGVASVSGSIFSRLAMGAICDLLGPRYGCAFLIMLSAPTVFCMSFVSNAGGYIAVRFMIGFSLATFVSCQYWMSTTFNSKIIGLVNGTAAGWSNMGGGATQLLMPLLYDLIQRAGATPFTAWRIAFFIPGWLHVIMGILVLILGQDLPDGNLSTLQKKGDVAVDKFSRVLWYAVTNYRTWIFVLLYGYSMGVELSIDNVIAEYFYDRFNLKLHTAGL

SEQ ID NO: 11996 - protein, 112 aa, Blastopirellula marina
MKKVEAIIRHHKMEDVKMALNDMGVHGMTVSEVQGYGRQKGHTENYRGAEYSVDFVPKHKIEIICSDGNLQLVIDTILKSAQTGQIGDGKLFIYDVKQAIRIRTGEMGEDAV

SEQ ID NO: 11997 - protein, 340 aa, Ginkgo biloba
MAPTRVQYVAESRPQTIPLEFVRPVEERPINTTFNDDIGLGRQIPVIDMCSLEAPELRVKTFKEIARASKEWGIFQVINHAISPLLFESLETVGKQFFQLPQEEKEAYACTGEDGSSTGYGTKLACTTDGRQGWSDFFFHMLWPPSLRDFSKWPQKPSSYIEVTEEYSKGILGVLNKLLSALSISLELQESALKDALGGENLEMELKINYYPTCPQPEVAFGVVPHTDMSALTILKPNDVPGLQVWKDEKWITAHYVPNALIIHIGDQIQILSNGKFKSVLHRSLVNKEKVRMSWPVFCSPPLDTVIGPLKELIDDSNPPLYNARTYREYKHRKINKLGQ

SEQ ID NO: 11998 - protein, 424 aa, Blastopirellula marina
MSILENQDLAQYCLETALRAKEASAALALVSGAQKNGWLRESAKQLRAAEKAIIAANAIDLAAAPEYGLTAAEIDRLKLDSKRIEGIAAGLEEIAMLADPIGSVIDSTVRPNGLDIQKIRVPLGVVFFIYESRPNVTADAAAICVKSGNAVILRGGKEAAHSSRAIVEVMQETALDFDIPSSAVQLVNTTDRAAVGHFLKLNQYIDVAIPRGGEGLIRRVADEATMPVIKHFNGNCHVYVDRDADLDMAMSITVNSKCHRYGVCNAAESLVVHQDVADQFLPAIGAALIERGVEIRGDSITQSLILKAKTATDEDFAAEYLGPIISVKVVESLDAAIRHINLYSSKHTESIVTRNLAAAREFASRIDSSAVMVNASTRFNDGGEFGLGAEIGISTDKFHARGPCGLEALTCYKYVVYGDGQIRS

SEQ ID NO: 11999 - protein, 574 aa, Lotus japonicus
MEGKGYTLDGTVDLAGRPVLSSLTGKQKACTYILVYRVLERFAYYGVGANLVNFMTTQLNKDVVSSITSFNNWSGLATLTPILGAYIADTYTGRFWTITFSLLIYAIGLVLLVLTTTLKSLRPACENGICREASNLQVALFYTSLYTIAVGSGAVKPNMSTFGADQFDDFRHEEKEQKVSFFNWWAFNGACGSLMATLFVVYIQEKNGWGLAYSLSAIGFLLSSIIFFWGSPVYRHKSRQARSPSMNFIRVPLVAFRNRKLQLPCNPSELHEFQLNYYISSGARKIHHTSHFSFLDRAAIRESNTDLSNPPCTVTQVEGTKLVLGMFQIWLLMLIPTNCWALESTIFVRQGTTMDRTLGPKFRLPAASLWCFIVLTTLICLPIYDHYFIPFMRRRTGNHRGIKLLQRVGIGMAIQVIAMAVTYAVETQRMSVIKKHHIAGPEETVPMSIFWLLPQNIILGVSFAFLATGMLEFFYDQSPEEMKGLGTTLCTSCVAAGSYINTFLVTMIDKLNWIGNNLNDSQSRITIMPFFSVISALNFGVFLWVSSGYIYKKENTSTTEVHDIEMSAEKTVKY

SEQ ID NO: 12000 - protein, 331 aa, Flavobacteria bacterium
MEKNKKFAVIGGGSWATAIVKMLCENLDQVGWYMRSVYAIEHIKRNDHNPSYLSSVEFDVTQLKLSNDINEIVAEADVCIFAIPSAFLYTELQNLTVDLKGKIIFSAIKGIVPETGLIVGEHFNEHYNIPFEDIGVLTGPCHAEEVALERLSYLTIACADEEKANYVASKLSSDYINCKTTDDIIGTEYAAVLKNIYAIAAGIAHGLGYGDNFQSVLMSNSIREMKRFIKKVHKMKRNINDSAYLGDLLVTGYSVFSRNRLFGNMLGKGYTVRSAQLEMSMIAEGYYATNSAYKINSEKGARTPILDAVYSILYDNKNPKKVFKKLADKLD

SEQ ID NO: 12001 - protein, 335 aa, Allium cepa
MEVERVQAIATLTANLGTIPPEFIRSDHERPDLTTYHGPVPELPVIDLANSSQENVVKQISEAAREYGIFQLVNHGIPNEVINELQRVGKEFFQPPQEEKEVYATVPDSGSFEGYGTKLQKDLEGKKAWVDYLFHNVWPEHKINYKFWPRNPPAYRKANEEYTKHLQVVVDKMHSYLSLGLGLESHVLKEAVGGDDLEYLLKINYYPPCPRPNLALGVVAHTDMSSLTILVPNEVPGLQVFKDDHWFDAKYIPNALICHIGDQLEILSNGKYKSVLHRTTVNKEKSRMSWPVFCSPPGDTMIGPLPQLVNDENPPKFKTKKYKDYAYCKINKLPQ

SEQ ID NO: 12002 - protein, 435 aa, Arabidopsis thaliana
MKSTPKLLLLLLFIINHHVDSGSIVKFLPGFEGPLPFELETGYIGIGEEEDVQLFYYFIKSERNPKEDPLLLWLSGGPGCSSITGLLFENGPLALKSKVYNGSVPSLVSTTYSWTKTANIIFLDQPIGAGFSYSRIPLIDTPSDTGEVKNIHEFLQKWLSKHPQFSSNPFYASGDSYSGMIVPALVQEISKGNYICCKPPINLQGYILGNPITYFEVDQNYRIPFSHGMALISDELYESIRRDCKGNYFNVDPRNTKCLKLVEEYHKCTDELNEFNILSPDCDTTSPDCFLYPYYLLGYWINDESVRDALHVNKSSIGKWERCTYQNRIPYNKDINNSIPYHMNNSISGYRSLIYSGDHDLVVPFLATQAWIKSLNYSIIHEWRPWMIKDQIAGYTRTYSNKMTFATVKGSGHTAEYKPNETFIMFQRWISGHDL

SEQ ID NO: 12003 - protein, 1401 aa, Schizosaccharomyces pombe
MGLEHTFYPAEDRFEPLLEHSEPVNFVPKENAKSYVRQGFASPHQSLMDNLVDSTESTKRSENFVSHIPLTPSHSGQSEKLMSTRTSHSPYISPTMSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 12004 - protein, 543 aa, Bacillus halodurans
MKAVRSVLDYLAKGGVDTVFGIPAGSVNAFFDELYSMPQMTPVIAKHEGAASYMAAAYAKYSGQLAVAIGCSGPGSTNLLTGAANAMREQLPILFLTGAVPTNTEGLNASQELDVQPLYAPVTKYSVTVRKGSDLLSEVEKAVTIALSPVPGPVHVAMPIDVQLETIEPPDLPSYPTQPRTMPSNQSVKQAARELTELKNGIVFIGQGVRRAVREAIEMAERLRWPIVTTPQAKGYIPSGHPLNKGVFGFAGHTTASDLLNGEEGDGLFIIGSSLGETATNNYNKKLTDGRYVIQLDHDKTVFNRKYKIDFPIVGDVKITLTELNLELERLGRDHQPQPIARVENKVNKEYTTQHLLLSIQQALPPTTRYHIDIGEFMSYVIHYMDVYEPDTFNINVHFGAMGTAIGSAIGAAMVDRKRPTVCITGDGCFFMHGMEVLTAKEYGLPILFVIVNNARLGMVYHGHALQYERTHPRFEQAPVNLSKLLESVGIPTARIESLADLKEERISSLLPTDGPAILELAIVDSQIPPMGDRVKFLSSFGK

SEQ ID NO: 12005 - protein, 151 aa, Agrobacterium tumefaciens
MHSPPRKAIRTAGSKEATMSSETVTLYEAIGGDATVRALTRRFYELMDTLPEAARCRAIHPADLSGSEAKFYDYLTGYLGGPPVYVEKHGHPMLRRRHFVAPIGPAERDEWLLCFRRAMDETIENAKLREIIWAPVERLAFHMQNQEADNP

SEQ ID NO: 12006 - protein, 543 aa, Pseudomonas fluorescens
MQTAYTVLILLMLVSVSRLVGRVIPLPLPLVQIAAGALLAWPTLGLHVALDPELFLFLFLPPLLFSDGWRMPKRELWRLRGPVLTLAVGLVLFTVVGAGYFIHWLLPTIPLPVAFALAAVLSPTDAVAVSAISQNRLPTPLMHMLQGEALMNDASGLVTFKFALVAAVTGAFSLANASLTFVLVAVGGLAVGVALSWLVGRLRAWMIARGWDDPATHVVFMLLLPFAAYVLAERLGASGILSAVAAGMMQSWLDLLPRQTSTRLLNRSVWSLLEFAFNGLIFLLLGLQLPDIVKAVVSHETSLWPTLFYRCLDVVAIFLALVLLRFIWVQSIWRLSVLLRRLRGKGDLTQVPTARSCWLLTVGGVRGAVTLAGVMSVPMLMGSEAFPERDLLIFIAAGVILLSLVAACIALPLLLRGIEKSPDDKRRQEVRDAWRKTAEAAIHALETEEVNPQDAAQAALAAELKARIMSEYRHQLEVFNDSAEAQALAFQMDLLERRLRLKALRAQRLELYSLSRQHQIGDDVLREVLGELDLSEANLGSVK

SEQ ID NO: 12007 - protein, 177 aa, Euglypha rotunda
LTGKTITLDVEASDTIENVKQKIQDKEGIPPDQQRLIFAGKQLEDGRTLSDYNVTKEATLHLVLRLRGGSGMQIFVKTLTGKTITLDVEASDTIENVKQKIQDKEGIPPDQQRLIFAGKQLEDGRTLSDYNVTKEATLHLVLRLRGGSGMQIFVKTLTGKTITLDVEASDTIENVKQ

SEQ ID NO: 12008 - protein, 433 aa, Arabidopsis thaliana
MELTLKLLVLLLFILNHHVGSGSIVKFLPGFEGPLPFELETGYIGIGEEEEVQLFYYFIKSERNPKEDPLLLWLSGGPGCSSITGLLFQNGPLALKSEVYNGSVPSLVSTTYSWTKTANIIFLDQPVGAGFSYSRAPLIDTPTDTGEVKRIHEFLQKWLSKHPQFSSNHFYAGGDSYSGMIVPALVQEISKGNYICCNPPINLKGYVLGNPITHEDDPNYRIPFSHGMALISDELYESIREACKGNYFNVDPRNTKCLKLVEEFHKCTDKLNEFHILSPDCDTASPDCYLYPFYLISFWANDESVRDALHVNKRSIGKWERCNYLSKPYNKDIKSSVPYHMNNSVSGYRSLIYSGDHDLVVPFLATQAWIKSLNYSIIDEWRPWMIRDQITGYTRTYSNKMTFATVKGSGHTAENKPQESFIMFRRWINGQPL

SEQ ID NO: 12009 - protein, 530 aa, Coprinopsis cinerea
MWQSGRLPMDSPLWKNEKPWLQRLGSNAVMLVEDMKNAVVQFLPASNRRSNRTLTAAPNNSNIAFIFMCGLWYTSSALSSNTGKAILTQFRYPITLTFVQFGFVAAYCLLFMSPLVRFTRFRPPTKEIVFSTFPMGLFQVGGHIFSSIAISRIPVSTVHTIKALSPLFTVAAYALLFGVSYSTKTYISLLPLTIGVMLACSFDVSASNAVGLLCAFGSALVFVSSNIFFKKIMPTNPSGSSAPSHKLDKLNLLLYSSGMAFLLMIPLWLYHDLPVLLASRNHNHVVHPSHGHEPRHSVSYYFFMNGTVHYAQNLIAFILLSSTSPVTYSIASLIKRVAVICIAIVWFSQRIHPIQAFGICLTFAGLYMYNNAKGDVEKGEKKIRRMEAVNSLTLPSTKEDSRMMMGTDTPPEFEVTETTGLGSGTYNPSTYSRARGLSLSSKDGQGLYHNTSSYPHHRTPQAPPTNSFVKTVDARLQSMKEEPEHFRKNSYPSPPPSVDSHSPPVRNAPLPKNVGYAGMQHYNRVAAVAG

SEQ ID NO: 12010 - protein, 466 aa, Unknown
  Shewanella sp. MR-7
MSIASVASVFKGEHAVGSTVTVRGWVRTRRDSKAGISFLAVYDGSCFNPIQGVVPSSLENYDNEVLKLTAGCSVIVTGEIVESPGAGQAYELQVTHVEVTGWVEDPDTYPMAAKRHSIEHLRELAHLRPRTNIIGAVARVRNCLSQAIHRFYHENGFVWVSTPLITASDCEGAGEMFRVSTLDMENLPRTSDGKVDYDKDFFGKEAFLTVSGQLNGETYACALSKIYTFGPTFRAENSNTSRHLAEFWMVEPEVAFATLSDIASLAEGMLKYAFDAVLAERMDDLQFFAQHVDKTVIERLQSFVSSDFAQVDYTDAVEILQKCGREFEFPVSWGIDLSSEHERYLAEEHFKAPVVVKNYPKDIKAFYMRLNEDGKTVAAMDVLAPGIGEIIGGSQREERLDVLDMRLEEMDLNKEDYWWYRDLRRYGTVPHAGFGLGFERLVSYVTGVSNIRDVIPFPRAPRTANF

SEQ ID NO: 12011 - protein, 339 aa, Unknown
  Mycobacterium sp. JLS
MSEPVADFSPLRVKRVVRETSDAVSLVLDVPRHCSGRFRYQVGQFLTLRVNLDGQELRRCYSMSSAPVEEELRITVKRDPGGLVSNWLNDTVSEGAEIHAAPPEGRFLLRDTDSEIVAFAGGSGITPIMSLIRTALATSARSIRLFYANRNRGSVIFADDLARLVEHNADRLVLTHHYDDDSGVVTPAAIESFVAGAGDADFYICGPGPFMDTVEGALATRGAPRDRVHLERFQVAQVPAGADASEAQATEEIVIELDRKTTTVPYRSGNTLLQTARTAGLRAPSSCETGSCGTCMAQVVSGSARMLNNDALDDDEVADGWVLTCQSLPTSRSVHVVYE

SEQ ID NO: 12012 - protein, 414 aa, Thermus caldophilus
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDMALASMGNYIFRTEALFELLEADARDETSAHDFGKGVIPRAIRVGYRVYAYDFHRNPIPGQEGPNLYWRDVGTLDAYYEASMDLVKVDPVFGLCSPVWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 12013 - protein, 177 aa, Euglypha rotunda
LTGKTITLDVESSDTIENVKQKIQDKEGIPPDQQRLIFAGKQLEDGRTLSDYNVTKEATLHLVLRLRGGSGMQIFVKTLTGKTITLDVEASDTIENVKQKIQDKEGIPPDQQRLIFAGKQLEDGRTLSDYNVTKEATLHLVLRLRGGSGMQIFVKTLTGKTITLDVEASDTIENVKQ

SEQ ID NO: 12014 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADIGYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVREKQWSPDDADAADEPPSSGKIPVFGELLGALKDLPRPMLLLLIVTCLNWIAWFPFILFDTDWMGREIYGGTAGKGKLYDQGVRAGSLGLLLNSVVLGLTSIAVEYLVRGVGGVKILWGVVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 12015 - protein, 245 aa, Pseudomonas fluorescens
MSQVNMRDMLKAGVHFGHQTRYWNPKMGKYIFGARNKIHIINLEKTLPMFNEALTFVERLAQGKNKILFVGTKRSAGKIVAEEAARCGSPYVDHRWLGGMLTNFKTIRASIKRLRDLEVQAEDGTFAKLTKKEALMRTRDLEKLDRSLGGIKDMGGLPDALFVIDVDHERIAITEANKLGIPVIGVVDTNSSPEGVDYIIPGNDDAIRAIQLYMGSMADAVIRGRNNVAGGTVEFAAEETQAAAE

SEQ ID NO: 12016 - protein, 346 aa, Unknown
  uncultured bacterium 560
MPDLDRSALIENRINSGILGQWYPVAKSVEVKSISPLGIEVLGEKLVLWRGDNGKVHCIKDQCPHRGAPLSFGRLHEGHISCRYHGIVVSGEGVVVRVPAMQNCKFEGQKIVRAFEVTEIYDAIFIYMPSAENEKAPRMVFPKEFLSDSWSGFLCTAVWKTNYRYALDNLADPMHGSYLHAESFTLAYGAKEDLFKVDHTENGFIVSRTGQLGKNFDWAEFEMHDGTMFCFLDIPYPKAAGPGGNMRIVGFVLPINENSCKVFFWRMREVSGIQRDCWRFLYRTELESKHWTVLEQDREILEAMSDDVRGNEKLYQHDVGVNRIRQTLLKQAKSNVDFELNIEGKS

SEQ ID NO: 12017 - protein, 596 aa, Deinococcus radiodurans
MLVSPDTPRFLAARLLLGAWLACGAGAQAQTLLDTSAAIGVQNTLNQIQPGVTQVPGSLSVQFDACKMAPESCKDGQPIGAAPAPATSGQSAQNAQSAQPAPSQVAPAAPTTPTQTTPTPAGEAPATRPVPTVVPLTAEQQQLLQAAQAQFAAGRYPQARNEFEALIVRNYNNPEPHFGLGLALYQLGDLRGATFEFGQFMQFAPQRYEGPYNLGVIATREGRYPDALRLYGEALTLAQSAPPAARQVLLRALATEQGRVKDYVALAATYADLRAADPENVEYIFRHAQALYQAGQVADALPVTYAVLERKPSSLQAALLLADLYVAQGLPDRAVRELSAAAARVLTGTDRATLLLRQSDLLLAQNNLRGALNAASEARQEDRRLPAAIIREAELLAQFGQRPAAVRAYRDALALTPKSAPIQAALAALYLEGNQYPEAAQAAQQALKLTPDASTRARALYVQGVVAYRQGQYTQARTALNSSVLAVPDADSLLWLGLSYYALKDYASAVPVLSESVRLRPTPAARQNLAAALLATARYAEAEALLRGLVTDEVKNAEGWYLLGLSQRAQQRPDDARQSFKTAAGLGSARAKDALK

SEQ ID NO: 12018 - protein, 609 aa, Unknown
  Magnetococcus sp. MC-1
MCGILAEVGQQSPAAARQRALDRLRHRGPDHGGQWSAQQPVPVWLGHRRLAIVDTSSAGNQPLHLHAADLHLVGNGEIYNAPALQKTLEALGHVFHSHSDNEAILHAYREWGSDCLAHLEGMFAFVLWDARQQTLLAARDRMGIKPLFYAATPAGGLVLASEASALVGLDGVAQQGYEPQALSHVLAYGHIPDPYAIWRGVNKLSPGQFLRWTPQQGLRLHTYWSPPSQSDAPSDDQAWGQRFEQVLQEHLLSDVPLSLFLSGGLDSTSVAVGVKRLGHQLKAFSLGFPGHPRDESALAQATAERLGHPFEAVVMDGRDLLQQVDAALLQQDEPHLFGSYLTMLNICSAVAKEYKVVLSGDGGDELFAGYNWYRDIPTALPTLAPWKAALAKPLLRHSPLPAALLERARLAFACCSPLHRHAWRTSQRFLPAEVEALLRPAAIRYDDEAFLAPLQRWFTPELPLVRALQRIDLMSFCSNHVCAKVDRASMAHALEVRVPYLDRRLVEWAISRPADPREAQGSKPLIRDYIAPHVPAQVLEQRKQGFSLRTTPPANLESTFVAWIEQSPLISQSILRRDWPRFLRADDRLRAQKLWHLALLARWMHHHPA

SEQ ID NO: 12019 - protein, 883 aa, Streptomyces avermitilis
MQHPRQGPPSRHTRRSLGRSLALTMTAVLGAAGLALSPAASADSGPTTADPTEAHGLKGEYYTQSAPGAFDFAELKATGFDPGLDFDSLESRLSAATGRADDVSVRWTGEVVPEKSGPTTFSITGDNGFRLWVDGKLTIDHWVDDWDREQTSQPVDLTAGRAYDIKVEYFEHFGGSNLHLRWTPPGGSKSAVPQSAFRLPDGFDYNGALSATVLGDGRTVRLDFPQALASAPATVLDHLTVTSGGKWPLSSVKTDPSDARALLVGLGEPVVGNKAGTAKGGVNVTYDGKGALADTSGTPVKAFWSSGPNKSTYELRTKWADQVGPKNALPEYPRPQLTRKAWQNLNGTWQFAGAKAGEEPPTGRTLAERILVPYPVESQLSGIERHEDRMWYRRTFTVPADWKVGHGKRLRLNFGAVDWQSEVYVNGTKVAEHKGGYDKFSADVTDALKPGRTQELIVGVYDPTDAQGGENPPLGKQRLDPSGIWYTPSSGIWQTVWMEPVAADHVDTLKLTPDVETSTLTVEPKGVRDGLAVTATAYDGKKKVATVRGRTGTPLTLKLAEPRLWSPDDPFLYDLKVDVGADRVGSYFGMRSIAVEKVDGTPRTVLNGKPVFMMATLDQGFWPDGLHTAPTDDALAHDLKMHKQMGFNSVRKHIKVEPDRWFYWADRLGLLVWQDMPAMTAGVNPNAASRAEYEREMKQLIDEHISSPSVVMWVTFNEGWGQYDEARIADQAKAWDPTRLVNSMSGLNLGVDGGTGDVMDEHGYPSPALPPHPDGRRALVSGEYGGLGLGVPGHAWSVQMSYVDVDPAAYTDTYLARLDEVRRLACRGGNGAVYTQISDVEGELNGLMTYDRKIVKPDVQRLRTAHEALIEAVAQSTLPCATS

SEQ ID NO: 12020 - protein, 444 aa, Prochlorococcus marinus
MNEENGKNNKPFEYETNNLIRSNFNEKESVQDLENIAPKPSNQLTNGLLGWYSVSSSESIKEGKLNHFTIYNEPLVLYRDREGIVRCVKDVCPHRGASFLGGEVINGQLVCPYHGARFSSQGSCTNLDRITCQHIIDSNYDSYAKSIKLFQYPCVEKEGYIYIYYTGTPLANIEDFQIKSSINSLLPDSYGFPSLEYEYEEVYVDFKADWARIIENHLDILHVFWMHGDTIPDKNVNRETITSFNQKIKRDNRQIESIYSYKTNGQEEFIRIKFVPPGRIFIYKGSPESTRYIQVLDHIPLGNNKARVIVRHYRKFLKNKLFTNLVLFSHLQRRTFYKIFTEDYLVLKTQTFNDQMGYIQKDNVKLLGEDKMVQYYWDWLQNALNKEKPWDIHPTNSLTNTVHEDRGMQYPPENPNMAIKNNRQIIIKLLTRLLFPISFILLLI

SEQ ID NO: 12021 - protein, 462 aa, Vibrio cholerae
MNRNDSVPLPTNTREWFLHRNSLIVLADVALFLALYHFLPFEHNVVLGISMLAFIAVLWLTEALHVTVTAILVPVMAVFFGIFETQAALNNFANSIIFLFLGGFALAAAMHHQGLDKVIADKVLAMAQGKMSVAVFMLFGVTALLSMWISNTATAAMMLPLVLGVLSKVDADKQRSTYVFVLLGVAYSASIGGIATLVGSPPNAIAAAEVGLSFTDWMKFGLPTAMMMLPMAIAILYFLLKPTLNGMFELDRAPVNWDKGKVVTLGIFGLTVFLWIFSSPINAALGGFKSFDTLVALGAILMLSFARVVHWKEIQKTADWGVLLLFGGGLCLSNVLKQTGTSVFLANALSDMVSHMGIFVVILVVATFVVFLTEFASNTASAALLIPVFATVAEAFGMSPVLLSVLIAVAASCAFMLPVATPPNAIVFASGHIKQSEMMRVGLYLNIACIGLLTAIAMLFWQ

SEQ ID NO: 12022 - protein, 424 aa, Unknown
  Photobacterium sp. SKA34
MAAIAVFISIFNHKFGRFQTTIAITGWSIAISLILLALTQFGFISVEKENALIELIQHIKFEDFLLKGVLGFLLFAGALNIDLDHLKDQKFEITFLALVGTLFSTFFIGITIWFIFSLIGIELNFIYCCLFGALISPTDPIAVLAIVKKLKAPQRISTQIEGESLFNDGIGLVIFVTIFEIAFSKTAPTVSETAMLFIREALGGLAFGAVLGSIFHYLIKGSNDNMLRLILTMLIPTCGYVIGEHLEVSAPLAMVVSGILIGNITRKYISEQSADQMAHLWELVDEILNAVLFLLIGFVMITFSFHSIDIIAVIIAVPLVLLSRYLSIRLSYVGFKRYRQYNPESVKILTWGGLRGGLALAMAMAMAMAMAIPTHIYLPSHPDVSIKEIIVLMTYAIVIFSILIQGSTITSMIMKAKAVDNKPF

SEQ ID NO: 12023 - protein, 240 aa, Escherichia coli
ATVSMRDMLKAGVHFGHQTRYWNPKMKPFIFGARNKVHIINLEKTVPMFNEALAELNKIASRKGKILFVGTKRAASEAVKDAALSCDQFFVNHRWLGGMLTNWKTVRQSIKRLKDLETQSQDGTFDKLTKKEALMRTRELEKLENSLGGIKDMGGLPDALFVIDADHEHIAIKEANNLGIPVFAIVDTNSDPDGVDFVIPGNDDAIRAVTLYLGAVAATVREGRSQDLASQAEESFVEAE

SEQ ID NO: 12024 - protein, 724 aa, Kluyveromyces lactis
MAAKIPHVDSNYRNDYTGKKYTFRSWLYDVAVFIFDIVFTIFFREIQVRGSYHVPTKNTPTILVCAPHANQFIDACLVMSQTRKITGSRSKQTCFVTAEGSMKNNRFVGLFGSWTGAIPVPRVQDNLAPVASHFKLYIPNYDSDPTLVKLMSFEGPVRATSHFTPKSLIGLPGYIGSAQIETVVDDETIRLRKPFPDNNRVKNCVSKPTSFLYAEKIDNSKVFENVFNHLHTRGCVGIFPEGGSHDRPSLLPLKAGVAIMALGAAAADPTMEVHVVPCGLHYFHRNKFRSRATLEYTEPIIVTGEMGAAYLKDPRGATSSLLKRIEEALYSVTMNADDYDTLMAVQTARRLYQLSKRSTTGSTLPLSDNDSNHRIPLPLVVEMNRRLLVGYSKFKGEPRIQHLKKAIQDYNRMLFKMGLKDHQIMNLHPKDEKWIVLVTLLIRCVQVYFIVLMSFPGVILFSPIFITCKYFSRKKALEGLKKSTVKIKGQDLIATWKIVVAISMAPTLYTIYSLIMVYITRKHPSLYNWLIVPHFIFKSKLLYFIYCYVVLILATYVSFVTGEIGMDIVKSFPPLLVSLLYPGHTCEKLKKTRMKLSQDITEVCNDLGPMVFPDLKEKRELRKEFFENDGSEIEDKDSDREADEEPNTRSRSSSVYSNDSSVSNALSKINSRGSLVDIPIFSDGPHCYQTEDQDFPTSSVDIEPLQPHSKIASLIRQRREKEED

SEQ ID NO: 12025 - protein, 428 aa, Tropheryma whipplei
MNHGVYQNLFIDSLDSVDPQIAEVLDLELRRQRDFLEMIASENFVPRAILQAQGSVLTNKYAEGYPQNRYYGGCECVDLAEDLAISRVRDLFGSEFANVQPHSGSTANAAALMALTEVGSTIMGLELDHGGHLTHGMPLSFSGKHYKAVTYRLDPKTCLIDMDSVRDLALRHRPSVIIAGWSAYVRHLDFEAFRSIADEVGARLWVDMAHFAGLVAAGLYPSPIPWADVVTSTTHKTLAGPRGGFILAKKEFGKAINTAVFPGQQGGPLMHVIAAKAVAFKIAASEEFRERQRITIEAARTVAKRIGEDYRLRDRGIDILTGGTDVHMVLIDMRKSDMDGLTGQNLLHEVGVTVNRNSMPYDKRPPRITSGIRIGTPALVTRGLSLDEFDEVADIISNALLTIDLPKQKQRALRIARAHPVYEGLRQY

SEQ ID NO: 12026 - protein, 437 aa, Arabidopsis thaliana
MGSTLKHLLLLLLVLIRHVDSAAIVKSLPGLEGRLPFELETGYIGIGEEEDIQLFYYFIKSENNPKEDPLLLWLDGGPGCSSLGGLLFENGPVALKSAVYNGSNPSLFSTTYSWTKMANIIYLDQPVGSGFSYSRTPIGKSSDTSEVKRIHEFLQKWLSKHPQFFSNPFYVTGDSYSGMIVPALVQEISKGNYICCKHLINLQGYVLGNPITYAEHEKNYRIPFSHGMSLISDELYESLKRNCKGNYENVDPRNTKCVRLVEEYHKCTDKINTQHILIPDCDKKGHGITSPDCYYYLYFLIECWANNERVREALHVTKGTKGQWQRCNWTIPYDNNIISSVPYHMDNSINGYRSLIYSGDHDITMPFQATQAWIKSLNYSIVDDWRPWMINDQIAGYTRTYSNKMTFATVKGGGHTAEYLPNESSIMFQRWISGQPL

SEQ ID NO: 12027 - protein, 460 aa, Schizosaccharomyces pombe
TGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 12028 - protein, 720 aa, Xanthomonas axonopodis
MATRKFTQRSRIREGRPNPLGATWDGLGVNFALYSRNATRVELCLFDERGREQERIALPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLEKGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFDHSGRRPTASVNFVTAHDGFTLRDLVSYEGKHNLANGEDGRDGSDHNISSNYGVEGETNDPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGTEMDEAGWHDPEARALMLRLDGRSPTTGLREIAANVTLLMLINAASTAVSFTLPAMHDEHWRVLVDTARHGGRVVAGGSEWKAPAHSLTLLAVERDRIVSSARIVSEGAR

SEQ ID NO: 12029 - protein, 267 aa, Archaeoglobus fulgidus
MKEKRLIIKRSGYPSKGEIVIGTVKRVLDFGAFVSLDEYEGREGMVHISEVASGWIKDIREHVKKGQKVICKVLDVNPKRGHIDLSIKDVNERQRREKLQQWKNEMKAFKWLEIIGEKLNIDFKELEKIGKKLMKEYDSVYSAFEEAAFEGYEVLAPIVGEEFAKEMAEIARENIKPKRVKVRGYFELKSSASDGIERIKKALLEAKKALVNGVEMKLEYVGAPKYRIVVEADDYKTAENVLKKATENVLKAIKKLGGEGNFIREAA

SEQ ID NO: 12030 - protein, 609 aa, Kluyveromyces lactis
MSGKLNHRGILLPMSVQNESRFIEKRFTPLITSLKSVGEQYLLIGTHSINVTQSRISSILDSGASCVVIHSGKNSDLKQLSQRFYGNNDVVLLDREFQLSDLTTLGRVAVGKIVDRVFVNLDSKQSLLIRDIFEQCQKLRIPINTHQRPEYSTFSICSTYNDPGQSGLQIAITTNGQGCLLANRIKREIVSRLPQNISKVVSNMGHLRERIIYEDHNQIIHSHFLNKDLQDLGFGIDEDVWESHKLNKLVYEFNVSEKQLKMKRSRWLSQIMEYYPLQSLAELSVDQLADQYHKISQEDNSKENASKKQRNTPDKKASNVNDADVQVSTTASSILDVPKKGSISLVGSGPGSVSMLTIGALHEIKTADLILADKLVPEKVLQLIPQGTETFIARKFPGNAERAQEELLEKGFDGLQKGLKVVRLKQGDPYIFGRGGEEFLFFQDKGYTPLVLPGLSSALAATVVSNIPATQRDVADQVLICTGTGRKGALPNIPEYVETRTTVFLMSLHRAQVLIDALLEKGWDENVPAAIVERASCPDQRITRTLLKNIPQTVEEIGSRPPGLLVVGNAINVLTDPELLKYDSSNTYHIEEGYEHVGFEDNVQKLLNI

SEQ ID NO: 12031 - protein, 157 aa, Triticum aestivum
  misc_feature (80)..(80): Xaa can be any naturally occurring amino acid
  misc_feature (101)..(101): Xaa can be any naturally occurring amino acid
  misc_feature (106)..(106): Xaa can be any naturally occurring amino acid
  misc_feature (110)..(110): Xaa can be any naturally occurring amino acid
  misc_feature (113)..(113): Xaa can be any naturally occurring amino acid
  misc_feature (132)..(133): Xaa can be any naturally occurring amino acid
  misc_feature (138)..(138): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVGLXLIRPKWVPCLEFNKVGFIFRXEHNAXPGVXYNXRYWTMWKLPMFGCTDATQXXNEVEXVKKGVPDAYVRINRIPKNA

SEQ ID NO: 12032 - protein, 762 aa, Myroides odoratus
MQRTILAALLTGALLGAPAWAAINPNKLGAAYDATKANVTFKVYSSKATRIELYLYSTATGSAEKAKYVMTNSGGIWSVTIPTSTLSGQGLGGTLYYGYRAWGPNWPYNASWTKGSSLGFISDVDAAGNRFNPNKLLSDPYALELSHDPTTATMTNGSIYASGATYRNIDSGSSAPKGIVLAGDTQATGTKPTRALKDDVVYEAHVRGLTMNDTSITAAYRGTYKGAGLKAAALAALGVTAIEFLPVQETQNDTNDNDPSSTSGDNYWGYMTLNYFAPDRRYAYDKTPGGPTREFKEMVKAFHDNGIKVLVDVVYNHTGEGGAWSPTDKTTYNITSFRGLDNPTYYSLTADFQNSWDNTGVGGNYNTRNTIAQNLIVDSLAYWRDKLGVDGYRFDLASVLGNSCQHGCFNFDKMDAGNALNRIVAELPPRPATGGSGVDLIAEPWAIGGNSYQVGGFPSGWAEWNGAYRDVVRQAQNKLGSVAITTGQMATRFAGSSDLYGDDGRKPWHSVNFITAHDGFTLKDLYSCNSKNNNQVWPYGPSDGGEDNNNSWDQGGIAADQRKAARNGMALMMLSAGVPMIVGGDEALRSMNCNNNPYNLDSSANWLNWSRTTDQNNFQSFSKAMIAFRKAHPALRPANFYSSVDNNGNVMEQLRWFKPDGGVADATYFNDANNHAIAWRIDGSEFGDTASAIYVAHNAWSAQVNFTLPWPGAGKSWYRVTDTCGWAEGASQVQAPGSEALVGGENTAYGLCGRGTLLLIAK

SEQ ID NO: 12033 - protein, 335 aa, Haemophilus influenzae
MITSQTPITVLGAGSYGTALAITFSRNGSPTHLWGHNPAHIAQMQTERQNYRFLPDVIFPEDLHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKSAQDVAISLLGRACKGE

SEQ ID NO: 12034 - protein, 431 aa, Desulfotalea psychrophila
MPMRILLVNPPNSGRSIPEERYGITSLKQIFRGEPLGLEVLAASLSKHEVRILDLKVVPQLLEETLELFAPDIVAFTAMTCEAQAVLQLASQVRACDERILITVGGVHASSDPEFFNREMIDWIIIGLGVQSFPLLAEALERGLLVEIDGVARSQAGKKLVYRPRSFSQDDLLTISPRYDLVHEYRPSYILETLGLQLGFVSTAAGCPFDCSFCCIGPLTGGRYFTAKIENVIRDIQRVPTPVIRLVDANTFGKPKHAEELARAIGHYGIKKQFIADVRSDTVVLHPQLMRQWREIGLRAVIIGFEEIDDSALGAMNKKNSAATNKHAIEILHDLGITIVGDFIISPDYREEQFERLDAFVQAQAIELPMYTVLTPLPGTALHREVRDQIILDDLDYYTLTNAVLPTYLDEQLFYQRYADLLAKGHRSAKV

SEQ ID NO: 12035 - protein, 274 aa, Oryza sativa
MAIAAITGGGRRPPCRRGPAAVAPPARFSCRCGTHPVPRRNVLSTMLSTSTVILFGSKQITLAEITGATFREYIDTFDGYSFLYPKTWIQVRGAGADIFFTDPFVLDENMSVEISSPSSSKYVTVEDLGPPEKAAERVLQQYLTEFMSTRLGVRRTSNILSASSKVADDGKLYYEVEVNIKSFASNNELAVMPQDRVQRLEWDRRYLSVLGVENKRLYELRLQSPEQVFKEEEGDLRRVMDSFRVNKTLSEARCGDLGIPNNGSHQFRVRARFH

SEQ ID NO: 12036 - protein, 541 aa, Vitis vinifera
  misc_feature (122)..(122): Xaa can be any naturally occurring amino acid
  misc_feature (144)..(144): Xaa can be any naturally occurring amino acid
  misc_feature (149)..(149): Xaa can be any naturally occurring amino acid
  misc_feature (154)..(154): Xaa can be any naturally occurring amino acid
MGFELGSVVMKLGMVSTSDHSSVVSMNLFVALLCACIVVDHWLEEYRWMNESITALALGLCTGIIILLTTRGKSSHILVFSEDLFFIYLLPPIIFNAGFQVKKKQFFRTFMTIMLFGAIGTXISFGIISLGAIHFFKKMKIGSXDIEDXLALGXIFSATDSVCTLQVLNQDETPLLYSLVFGEGVVNDATSVVLFNAIQSFDLSHIDSSIALQFIGNFLYLFITSTMLGVFAGLLSAYIIKKLYFGRHSTDREVAIMILMAYLSYMLAELFYLSAILTVFFCGIVMSHYTWHNVTESSRVTTKHAFATLSFVAEIFIFLYVGMDALDIEKWRFVSDSPGKSIGVSSILLGLVLVERAAFVFPLSFLSNLTKKSSSEKIHIEQQVTIWWAGLMRGAVSMALAYNQFTRAGHTQLRGNAIMITSTISVVLFSTVVFGLMTKPLVRLLLPSPKPFSSMISSEPSSPKYLVVPLIGNGEETETDQASQNVPRPTSLRMLLSTPSHTVHHYWRKFDDSFMRPVFGGRGFTPFIPGSPTEPNLGQWR

SEQ ID NO: 12037 - protein, 893 aa, Eubacterium acidaminophilum
  misc_feature (350)..(350): Xaa can be any naturally occurring amino acid
MVLVKIDGRELEVPKDYTILKACEAAGAKIPTFCYDERLSRHGAGACRICLVEIEGQRNLMPSCTEKVWEGISVFTKSERVIKERKGILELMVQNHPLDCLTCEKSGDCKLQDYCYEYGVTGIKGLEERVLPVDESNPFYTFDPDKCILCGKCVRVCEELQGTRAILISERGPVAKVSTQFEEGLENSPCVSCGNCVSYCPVGALLPKSKTEHRVWETKKVRTTCSYCGVGCQLELIVKGDEVVGVQPAMGAGNDGLLCVKGKFAYNFVNHPDRLKKPLIRKDGVLVEATWEEALSLVAKKISDIKSQHGADSIAGLTSARCTNEENYLFQKLLRAVVGTNNVDHCARLXHASTVAGLATTLGSGAMTNSIAETRYNDVIFVTGSNTTENHPVIAAQMKQAVKNGAKLIVADPRRIELADYADVFLQITPGTNIALLNAMMNVIISEGLQDKKYIEDKTENYEELVGLAKRYTPEEAARICGVDAEDIRKAARIYASADKAGIYYAMGITQHISGTDNVMSISNLALLCGNIGKEAAGVNPLRGQNNVQGACDMGGLPGDLPGYQKVISPEVIEKFEAVWSAKLSSKVGLTVPEMLTEASNGNIRMIYIMGENPMVSDPDITHVKHALEHLDFLVVQDIFLTETAELADVVLPAASFAEKDGTFSNTERRVQRVRKAVNPVGDSKPDYEILINLMKKLGYNAFYKDASEIFDEIASVTPQYAGIDYKRLEDINGLQWPCPTKEHPGTKYLHSKGCARGKGLFVPCEYAQSAEMPDSTYPLVLTTGRILYQYHTTTMTGKTEGISSNYSESFIEVNPSTANKLGIEDGEMVRVVSRRGSVETNVRVTEIVEEDVVFMPFHFAKGAANMITNSKLDPKAKIPELKVCAVRIERIK

SEQ ID NO: 12038 - protein, 510 aa, Streptococcus mutans
MALDAEIKEQLGQYLQLLESEIVLQAQLKDDANSQKVKEFLQEIVAMSPMISLEEKELPRTPSFRIAKKGQESGVEFAGLPLGHEFTSFILALLQVSGRPPKVETDIVKRIQAVDEPMHFETYVSLTCHNCPDVVQAFNIMSVVNPNISHTMVEGGMFKDEIEAKGIMSVPTVYKDGTEFTSGRASIEQLLDLIAGPLKEDAFDDKGVFDVLVIGGGPAGNSAAIYAARKGVKTGLLAETMGGQVMETVGIENMIGTPYVEGPQLMAQVEEHTKSYSVDIMKAPRAKSIQKTDLVEVELDNGAHLKAKTAVLALGAKWRKINVPGEKEFFNKGVTYCPHCDGPLFTDKKVAVIGGGNSGLEAAIDLAGLASHVYILEFLPELKADKILQDRAEALDNITILTNVATKEIIGNDHVEGLRYSDRTTNEEYLLDLEGVFVQIGLVPSTDWLKDSGLALNEKGEIIVAKDGATNIPAIFAAGDCTDSAYKQIIISMGSGATAALGAFDYLIRN

SEQ ID NO: 12039 - protein, 255 aa, Unknown
  uncultured bacterium 560
MKVATISLNIAWQDVEKNLERAEKFVLQAKADGCDVVVLPEVFNTGFIADVGKYAELPNCKTHHALQQFALNNLINIVAGASEKKPNEKAHNIALVFDSHGNEVAKYSKLHPFNYANEGKYFASGNETIKFELDGVACSVFICYDLRFPEIFRQIAKEVEVIFVVANWPHTREMHWQNLLIARAIENQCFIVGVNRIGNDGVGLKYNGSSMVINPLGEVLLQTDKETEYASCDIDTSMVSKTRKDFPFLEDIRFI

SEQ ID NO: 12040 - protein, 380 aa, Oryza sativa
MRALPMAAGRAAAVAACASPAVPRRSLLLSTAAAGEPPYRPPADSSSPSKFSRFDRSAVRLLGWTAALQPEPVRLSRGASAAPKLRASPPDAAQAATAAAAFGSKEEAFAWAKSDNRRLLHVVYRVGDIDRTIKFYTECLGMKLLRKRDIPEEKYTNAFLGYGAEDNHFVVELTYNYGVDKYDIGAGFGHFGIAVDDVAKTVELIRAKGGKVTREPGPVKGGKTVIAFVEDPDGYKFEILERPGTPEPLCQVMLRVGDLDRAISFYEKACGMELLRKRDNPEYKYTVAMMGYGPEDKNAVLELTYNYGVTEYDKGNAYAQIAIGTDDVYKTAEVVKLFGGQVVREPGPLPGINTKITSILDPDGWKSVFVDNIDFAKELE

SEQ ID NO: 12041 - protein, 91 aa, Eragrostis tef
QVLKQSDVGSLGRIVLPKKEAEIHLPELKTRDGISIPMEDIGSSRVWNMRYRFWPNNKSRMYLLENTGDFVRYNELQEGDFIVIYSDVKSG

SEQ ID NO: 12042 - protein, 75 aa, Glycine max
  misc_feature (34)..(34): Xaa can be any naturally occurring amino acid
  misc_feature (47)..(47): Xaa can be any naturally occurring amino acid
  misc_feature (60)..(60): Xaa can be any naturally occurring amino acid
SISWPGDTTVNRAGAGMDAPFTGLKSMAGLPTRXTYNDITSIGCNCXRVQCMQVWPPIGXKKYETLSYLPDLDDA

SEQ ID NO: 12043 - protein, 163 aa, Oryza sativa
  misc_feature (76)..(76): Xaa can be any naturally occurring amino acid
  misc_feature (102)..(102): Xaa can be any naturally occurring amino acid
  misc_feature (139)..(139): Xaa can be any naturally occurring amino acid
MALWAAAAASTFLGTRLTDPAPHTGRIEARFWFGGSKNAVANKAARPSAPSTDRSVRFPGAETPDYLNGSLVGYYXFDPFRLGKPPEYLQFELDSVNQILSXNNASYIIGTRFETGKVKSTPIQPYTEAFSLQCLRECXLMHGRWTMLATLCALCVKWLTGIT

SEQ ID NO: 12044 - protein, 412 aa, Zea mays
MAADADTARRRAPLPGARNTQPRPLVPRPLKTQLPVAAVPHQYSTDGRDRGIGVAVGGSGLATWPRRVRAPRTRTGTAPPAPYSTNSRRLLFACRSPPVATVPCASVKKSDACATLTDSTVDTRHHLTSPRTARRARPRATDASARPAVNISEAVRVTRTDRAWSTDPAPEEPGRRPVPPFAGVDLRRPKGYPVAVAKEEERPAPGGDPCPRCGSRDTKFCYYNNYNTSQPRHLCKSCRRYWTKGGSLRNVPVGGGTRKSSSSSSSSSSSATTTSTSPGAAPKATKRSKNSKRRRVAPAPDPAAPGTDASTADVASTAPSAATVTASEKPSATEHAAAAVATEKPPAALPVSVGAFADTSPAPDAGSGGVRELLPHPSRFEWPSGCDLGPPYWGWGTSVFADTDPALFLNLP

SEQ ID NO: 12045 - protein, 284 aa, Unknown
  Mycobacterium sp. MCS
MAVVTMKQLLDSGTHFGHQTRRWNPKMKRFIFTDRNGIYIIDLQQTLTYIDKAYEFVKETVAHGGSIMFVGTKKQAQESIAEEATRVGMPYVNQRWLGGMLTNFSTVHKRLQRLKELEAMEQTGGFEGRTKKEILMLTREKNKLERSLGGIRDMQKVPSAIWVVDTNKEHLAVAEARKLNIPIIAILDTNCDPDVVDYPIPGNDDAIRSAALLTKVVASAVAEGLQARAGGGNGNKPEAEAAEPLAEWEQELLAGATASPTAAGAAPGTPEADIQTEPTAPQNP

SEQ ID NO: 12046 - protein, 331 aa, Phaseolus vulgaris
MMGNNLPSANEVINLYRSNNIRRMRLYDPNQAALQALRNSGIELILGVPNSDLQGLATNADTARQWVQRNVLNFWPSVRIKYIAVGNEVSPVGGSSWYAQYVLPAVQNVYQAIRAQGLHDQIKVSTAIDMTLIGNSYPPSQGSFRGDVRSYLDPIIGYLLYASAPLLVNVYPYFSYSGNPRDISLPYALFTSPNVVVRDGQYGYQNLFDAMLDSVHAAIDNTRIGYVEVVVSESGWPSDGGFGATYDNARVYLDNLVRRAGRGSPRRPSKPTETYIFAMFDENQKSPEIEKHFGLFKPSKEKKYPFGFGAQRDAKIVVDEFNATYPLKSDM

SEQ ID NO: 12047 - protein, 461 aa, Haemophilus influenzae
MGEMASLRSHKNGIIFILDIVLFFVLLNVLPFEPKANSGLALLAFIAVLWLSEALHVTITALLVPLLAVALGLVSTKQALVGFADPTIFLFFGGFSLATALHIQKLDKLIANKIMALARGNLFIAVIYLFLITAFLSMWMSNTATAAMMLPLAMGILSQLDREKDHNTYVFVLLGIAYSASIGGMGTLVGSPPNAIVASNLNLTFSDWLWYGLPIMIILLPLMIGILYIIFKPKLHLNFEQTFENIEMNPMRILTFIIFPVIALTWIFSGKINPFISGLLGLQKNIASFDSIVALLAAIVICSTGVASWKQIQSNTDWGVLMLFGGGLTLSAVLKDSGASKILADSIVFMIDGQHFYLIGLLVAAFIIFLTEFTSNTASAALLVPIFISIAQSLGMPEIGLALIIGIGASCAFMLPVATPPNAIVFGSGQVKQSEMVKVGFLLNLVCVVVIATMGYMFWLK

SEQ ID NO: 12048 - protein, 561 aa, Bacillus cereus
MIHLKTQYTVSTYLLDRLSELGIEHIFGVPGDYNLAFLDDVLAHKNLEWIGNCNELNAAYAADGYARIKGIGALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAEPILHKPILSNKETMDKMLLHAISKINSAKKPIILADFEVDRFHAKEYLYQFVEKTGFPIATLSMGKGIFPEKHPQFIGIYTGDVSFPYLRKRIDESDCIISIGVKLTDTITGGFTQGFTKEQVIEIHPYTVKITDKKYGPVVMKDVLQQLSDIIKHRNEETLDIKPFISESLSMTEEFNPKAHMVTQKRFWQQIYHFLQENDVLLAEQGTPFFGSAAIPLPNNTTYVAQPLWGSIGYTLPALLGTQLANLSRRNILIIGDGSFQLTVQELSTMLRQNLKPIIFLINNNGYTVERAIHGQNEPYNDIQMWEYTKLANVFGTEEKSQTFKVENETELQEVLTKISIDKDQLTFVEVVMSQGDQPELLAKLGKRFGQQNS

SEQ ID NO: 12049 - protein, 112 aa, Prochlorococcus marinus
MKKIEAIIRPFKLEDVKIALVNSGIVGMTVSEVRGFGRQKGQVERYRGSEFTVEFLQKLKVEVVVENEKVSSVIDAIAEAAKTGEIGDGKIFISPIDSVVRIRTGDTDKEAL

SEQ ID NO: 12050 - protein, 308 aa, Desulfovibrio vulgaris
MDIASSMTDLVGKTPMVRLNKVTLGCVAEVVAKLENFNPCSSVKDRIALNMVEAAIARGEIAPGAVLVEPTSGNTGVGLAFVCAVRGLKLVLTMPESMSAERRALLKAFGTTLVLTPAAKGMRGAVEEAERIVADTPGAVMLQQFANPDNPAAHEATTGPEIWADTDGMIDCFVAGVGTGGTITGTGRYLKGRNPDIRVIAVEPAESAVLSGGAPGPHAIQGIGAGFVPPVLDTSVYDEVMPVPGADALTMARRLLQEEGILCGISSGANVHAAIAYARRPENAGKRVVCIICDTGERYLSTPLFAPE

SEQ ID NO: 12051 - protein, 438 aa, Brucella suis
MSQANAATKASSDVFFNASLEDIDPEIFGAIRNELGRQRHEIELIASENIVSRAVLEAQGSILTNKYAEGYPGKRYYGGCQYVDVVEELAIERAKKLFSAEFANVQPNSGSQMNQAVFLALLQPGDTFMGLDLNSGGHLTHGSPVNMSGKWFNVVSYGVRKDDHLLDMDEVARLARENKPKLILAGGTAYSRIWDWKRFREIADEVGAYLMVDMAHIAGLVAGGQHPSPVPHAHVCTTTTHKSLRGPRGGMILTNDADIAKKINSAVFPGLQGGPLMHVIAGKAVAFAEALKLEFKLYAKNVVDNARALAEELKSHGLDIVSGGTDNHLMLVDLRPKNATGKRAEAALGRANITCNKNGIPFDPEKPFVTSGVRLGTPAGTTRGFGVAEFKEIGSLIAEVLDGLKVANSDEGNAAVEQAVKEKVIALTGRFPMYGYQG

SEQ ID NO: 12052 - protein, 549 aa, Spiroplasma citri
MNKINFQEAIVYEIHPQSFYDSNHDGVGDLQGIIQKLDYLAMLGVNYLWLNPIYVSPQKDNGYDVSDYKNINPLFGTMNDFEMLVTEAGKRNIYIMMDMIFNHCSTEHEWFQKAQTGNLDYLQRFFFLPGDKAKCPNNWQSKFGGSVWEYHDELKMFYLHLFDKTQVDLNWKNESLRQHIYQIVNYWLQKGVRGLRFDVINLIGKPNIFENDLTGDGRKYYTDTPQVHTYLQEMAQNTYLKTNDIITVGELSSTSIKQAILYTKPVSQELNMAFTFHHLKIDYLNNEKWKLAPYDPAKLVAKIKEWQIPVQAAGGWLANFLNNHDQPRALSRFGDPENYRFESATALAAVVLLLRGTPYLYQGEEFGMENNNYTKIEQLKDVESINYYHILQKEGEQPNAILEVLSARSRDNARTPMQWNNQQFAGFSTHKPWIDVNTNYLKINWEKDYHSSQSIFKAYQMLIQLRKNNLAFSYGEIEFVEIDPTILSFYRYYEKNKFLVLINLSDQTIMIPDNLLSEKTIYNNYSTFEKKINPYQVIVFDYLMAKSFK

SEQ ID NO: 12053 - protein, 454 aa, Oryza sativa
MAAHPFPLPFLPQCTSILCDADTDDLWLASGNAQSSAAVRSRLLAAEREEAKAVLSLFLRQKGLRSILAARIANKADGFIEHLVSKLHITYRSRYAEGRELSTPEIRDALIPYLEALSKEHGDGLVEVVENFPDPFAMEREALSSSMVLTPTSSNKHKAIARVSAPTSGGALPELVLYLLDLGMDHEEIKNVVRKFPAFAYYNVDRKIKPLVALLLELGVPRSNIPGIIKKRPQLCGISLSDNLKPMMTYLENVGINKDQWSKVLSRFPALLTYSRQKVETTVSFLTELGVPKENIGKILTRCPHIMSYSVNDNLRPTAEYFQSIGADAASLIQKSPQAFGLNIEAKLKPITEFFLERDFTMEEIGTMANRFGIIHTLSMEDNLLPKYEYFLTMGYPRNELVKFPQYFGYSLEQRIKPRYARMIDCGVRLILNQLLSVSDSRFEDILRKRMDGI

SEQ ID NO: 12054 - protein, 416 aa, Thermotoga maritima
MPEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRNELERLSRRFFSEIQVIIGPYNDIPAPDVNTNADVIAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 12055 - protein, 234 aa, Pseudotsuga menziesii
QARITMRRTVRSAPESIWYGPDRPKYLGPFSEQTPSYLTGEFPGDYGWDTAGLSADPETFAKNRELEVIHSRWAMLGALGCVFPELLAKNGVKFGEAVWFKAGAQIFSEGGLDYLGNPNLIHAQSILAIWAFQVVLMGLIEGYRVGGGPLGEGLDPLYPGGAFDPLGLADDPEAFAELKVKELKNGRLAMFSMFGFFVQAIVTGKGPIENLFDHLADPTANNAWAYATNFVPGK

SEQ ID NO: 12056 - protein, 265 aa, Viscum album
IAAGVQFGWALQLSLLTPYVQELGIPHKWASIIWLCGPLSGLFVQPLVGVMSDRCTSRFGRRRPFIFAGSLLIAISVLIIGHSADIGWWLGDRGGVRPRAIGAFVFGFWILDVANNMTQGPCRALLADLTGKDHRRTRVANAYFSLFMAIGNILGFATGSYNGWYKVFPFTVTSACNIDCANLKSAFYLDVVFMAITACISISAAQESPLDLPARSMLADEEMLGQSNSVQEAFLWELFGTFRCFPSTVWIILLVTALNWIAWFP

SEQ ID NO: 12057 - protein, 76 aa, Crocosphaera watsonii
MSKQDLIEMEGTVTESLPNAMFRVDLDNGFNVLAHISGKIRRNYIKILPGDRVKVELTPYDLTKGRITYRLKGSKK

SEQ ID NO: 12058 - protein, 897 aa, Eubacterium acidaminophilum
  misc_feature (349)..(349): Xaa can be any naturally occurring amino acid
MINVTINGTTVSVPRKSTLLEACNAAGVSIPTFCHDERLQAHAACRICVVEVAGARGLMTACSTPAVDGMDVQTHSERVIEARRGVLSLMIANHPLDCLTCVKSGDCRLQDYCYEYGVKEPEFEGAKKNYEIDDSNPFYISDQNKCISCGRCVRVCNELQCTGAIDLAERGFDTHVATPFDVDLEKSKCVSCGNCVAVCPVGALMPKSKELFRQWETKKVRTTCSYCGVGCQMDLVVKGDTVVGAEPANGPANEGLLCVKGRFGYKFLSHPDRLTKPLIRKNGELVESSWDEAYSLVAKKMKQTKEEFGADSLVGLTSARCTNEENYLMQKLFRAVIGTNNIDHCARLXHSSTVAGLAATLGSGAMTNSITEVKDSDAIFVIGSNTTENHPVIGAMMKQAVKKGAKLIVAEPRRIELADYADVFLQIKPGTNVALLNGMMKAIVDEDLHDKEYIEERTEDFDKLKELLGRHTVEEYAAICGVDAEDVRKAARIYAEADKAGIYYAMGITQHSDGTNHVKSVSNLALLCGNLGKESAGVNPLRGQNNVQGACDMGGLPNSFPGYLSVTSPEIREKFEKAWDAKLSGNVGLTIPKMLSGIDSGDVRLMYIMGENPMVSDPDLTHVEKSLRKVDFLVVQDIFLTETALLADVVLPAAAFAEKDGTFSNTERRVQMVRKAVNPPGEAKADWKIFMDLMNKLGYSNYYRNTSEIMDEIASVTPQYGGISYDRLEEKGSLQWPCPTKEHEGTKFLHKGQFARGKGLFTAVEYKGPAEITDEEYPLILTTGRVLYHYHTMTMTGKVEGLMQKSPESFIELSPNAAENLGVADGEMVKVSSRRGTINVKAAVKDILADNVVFMPFHFAVGAANMLTNTALDPTCNIPEFKVCAVKVEKIATEKTA

SEQ ID NO: 12059 - protein, 524 aa, Unknown
  Candidatus Desulfococcus oleovorans Hxd3
MSRTPLRPVQRVLLLFPPMHDVKIIDTMVVPPMGIASLAAYVRDMVDVALLDCVAEGYRQKVSVARHIARVGLSDDEILARVRAYRPDMVGLSCIFSNQFACVKDLSRKIREKVDPDMVIVTGGTHPSFLPEQTLSEADVDYVVLGEGELGLKQIIETHNSGGRIEDIDGVAFRTENGVQVTPRTTWIEDLDTLPFPARDLLPMETYFEAKVPMALHWRKVRNTPIVSSRGCPFKCPFCSSWRHWGQRFRKRSAENVLAEITHLKSRYNIQELKWQDDNLTADRNRAKAIFQGMIDRGLVMPWNTPNGIALWTLDGEMLDLMKKSGCFEITLAVESGDPETFRRFVKKPFTLDQAAKVARMARERRITTVAYFILGFPGETVRQVKSSIRFGLRMGVDYLVPFIFNPLPGSELWQECMQKGFLSDSLQYERSNNYMDPGALVSAGPDGKVSGGGDEVSYVQGMAYLQNLAKLPFRNPREFMANYSRKLLTAPWFLVDFLKVLWNTRSIIVSGIRQSSLFVKRNR

SEQ ID NO: 12060 - protein, 488 aa, Treponema pallidum
MGADIGFIGLAVMGENLVLNIERNGFSVAVFNRTTTVVDRFLAGRAHGKRITGAHSIAELVSLLARPRKIMLMVKAGSAVDAVIDQILPLLEKGDLVIDGGNSHYQDTIRRMHALEAAGIHFIGTGVSGGEEGALRGPSLMPGGSAQAWPLVSPIFCAIAAKADDGTPCCDWVGSDGAGHYVKMIHNGIEYGDMQIIAEGYWFMKHALGMSYEHMHHTFTRWNTGRLHSYLIEITAAILAHQDTDGTPLLEKILDAAGQKGTGRWTCVAALEEGSPLTLITESVMARSLSAQKQARCKAHRVFGSPVKVSKAETLSAQQREELVSALEDALYCAKIVSYAQGFELLSHTAKRRGWTLDFSRIASLWRGGCIIRSGFLSKISAAFAQQHDLENLVLAPFFAEELKRACPGWRTIVAESVRQALPVPALSAALAWFDGFTGAALPANLLQAQRDYFGAHTYERTDAPRGEFFHTNWTGTGGDTIAGTYSI

SEQ ID NO: 12061 - protein, 213 aa, Unknown
  Acidovorax sp. JS42
MVQWRRVRAFCPPRHPCTMPRLTLPLLLCATLLGPAAQAADVAATPAVDAQACPALLQHTVPRLQDEAPQALCQYAGKVLLVVNTASYCGFTGQYQGLEELYARYRDQGLVVLGFPSNDFAQETGSNTEIAQFCENTFGVRFPMFAKSHVKGGEALPLYRQLAAASAGQTPRWNFHKYLVSRSGKVVGSYGSSVEPHSKALIQAIEQQLAAPR

SEQ ID NO: 12062 - protein, 520 aa, Unknown
  Candidatus Desulfococcus oleovorans Hxd3
MADISRPLRPIRRVMLLFPPMYDVKLIDTMVVPPMGIACLGAYIRDMVEVSLLDCVAEGYRQAAPVNREVELVGLSADEILARIRACAPDMVGISCIFSGQIACVEQLSRRIRDEIDPDMVIATGGTHPSFLPEQTLTRTAVDYVVLGEGELGLKQIIEAHNSGNRIDNIDGIAFRTENGVHVNPRTTWIEDLDTLPLPARDLLPMETYFSARLPMGFHWRKTRNTPIVSSRGCPFGCPFCSSWRHWGQRFRKRSPENVLAEIEHLKTRYNIQELKWQDDNLTADRNRAKAIFSGMIDRGLVMPWNTPNGIALWTLDEEMLDLMKKSGCFEITLAVESGDPASFEKYVRKPFTLDTAKRIAGLARERGIATVAYFILGFPGETIDQIKNSMRYALDLGVDYLSPFVYTPLPGSDLWQQCVETGLVTDGYSYKDANNFFKPDFDTQLFDIDEVYRLQGRAYLTNLAKLPFRNPAEFLAWYSRRLIFRPVFLRDFFQNLWKFRLQVFINRRVVRTADRKGRQ

SEQ ID NO: 12063 - protein, 502 aa, Unknown
  Candidatus Desulfococcus oleovorans Hxd3
MTVRTLRSVRRVMLIFPPMHDIRHVDTMVCPPMGIASLAAHIRDRVEVQLLDCLAENGARRVAVSEKIERVGLPYDDILARIRGFAPDMVGLSCIFSSQFSCVTEIARRVKKEIDPEMIVVTGGTHPSFLPEMTLEHPYIDYVVLGEGELGLERIIEAHNSGGRIEDIDGIAFRTKSGVQVNPRTTWIEDLDVLPLPARDLLPMENYFAATVPMGLHWRKKRNTPIVSSRGCPFGCPFCSSHLHWGKRFRKRSAENVLAEIEHLKSRYNIQELKWQDDNLTADRNRAKAIFSGMIDRGLTMPWNTPNGIALWTLDEEMLALMKKSGCYELTLAIESGDPLSFARYVRKPFTLDKARHVAALARRTGIATVAYFIIGFPGETLAQIENSMRYALLLGADYLVPFIYNPLPGSELWKRCVDEGLISDTYAYEGGNNYFQSDLSGADFTSKDLRRIQSLTYFKNLLRLPFRNPREFAAWYSRQLFAHPDFLRTFFLHVRQTLLRQ

SEQ ID NO: 12064 - protein, 204 aa, Unknown
  Acidovorax sp. JS42
MKLIGSNTSPYVRKVRVVLAEKKLDYQFVEENVWADDTAISASNPLGKVPCLIMEGGEAVFDSRVIVEYLDTLSPVGKLIPALGRERAEVKTWEALADGLLDAAILARLEATWAGRQDGERSQAWIDRQLAKARASLQSMSKGLGDKPYCSGIHLTLSDIAVGSALGWLEFRFPDIAWRTDHPNLARLMDKLMQRQSFIDTQPR

SEQ ID NO: 12065 - protein, 452 aa, Unknown
  Acinetobacter sp. ADP1
MNNDSSKLQRGLKNRHIQLIAMGGAIGTGLFLGSAQVIQSAGPSIILGYAIGGLIAFLIMRQLGEMIVHEPVAGSFSHFAYKYWGKFPGFLAGWNYWVLYILVAMTELTAVGKYINYWWPQIPAWQSVLFFFVVITLVNLTNVKFYGESEFWLAIIKVVAVISMIIFGLYLLFTADSSSTASFSNLWAHGGFFPNGFEGLFYMLAFLMFAFGGIELIGMAAAEAENPAKTIPKAINQVVFRILVFYVGSLTILLSLVPWNQLDLGGLDKSPFVMIFSQLGIGWAAHLLNFIILTAALSVYNSGMFANSRMLFGLAQQGNAPKIFTKVNKQGVPIPAVLFSALLIFGCVLLNYFVPEDALGHLMYVVVGALVLNWAMISLTHLKFKAAVKKLKLNVTFPALWAPVSNYLVLIFIALVLFIMWQQGFKESVIMIPVWIVLMFGLFHLLTNKDHT

SEQ ID NO: 12066 - protein, 534 aa, Yarrowia lipolytica
MVHLGPRKPPSRKGSMADVPRDLLEQISQLETIFTVSPEKLRQITDHFVSELAKGLTKEGGDIPMNPTWILGWPTGKESGCYLALDMGGTNLRVVKVTLDGDRGFDVMQSKYHMPPNIKVGKQEELWEYIAECLGKFLADNYPEALDAHERGRDVDRTAAQSFTRDKSPPPHNQHISCSPGFDIHKIPLGFTFSYPCSQPAVNRGVLQRWTKGFDIEGVEGEDVVPMLEAALERKNIPISITALINDTTGTMVASNYHDPQIKLGNIFGTGVNAAYYEKVKDIPKLKGLIPDSIDPETPMAVNCEYGAFDNEHKVLPRTKWDIIIDEESPRPGQQTFEKMSAGYYLGELLRLVLLDLYKDGFVFENQGKNGQELGNGNINKSYFFDTSFLSLIEEDPWENLTDVEILFKEKLGINTTEPERKLIRRLAELIGTRSARISACGVAAICKKAGYKEAHAGADGSVFNKYPGFKERGAQALNEIFEWNLPNPKDHPIKIVPAEDGSGVGAALCAALTIKRVKQGLPVGVKPGVKYDI

SEQ ID NO: 12067 - protein, 326 aa, Oryza sativa
MKQTLDVHRSLRPPMPMAQQQMDEFWRDRQKEIEMTKDFSEHMIPMARLKKIVSSQKGNMMMTFDMPAFLSKMCELFVQELAARAWACAQSHNRCIILDMDIAEAVASTESYDFLVDILHNHSVKQKSTPCSSTKRWAPLNPPNSQSYNCTMDIINSNDACGSNNSSVIVANQANIAPSGHFYPIALQSSCSTFLHSNNNDTITAILEGVDISDIMHVTSDVDAATKVFSGQEEQHEKETNVEWHHQNEIYESIDIRIINATTRDGNKCSISWDELGMADDSLLDNFLEELQVRKDDVSDTRIAFNKDPFLDDAVLSNPSTSNGNK

SEQ ID NO: 12068 - protein, 273 aa, Unknown
  Synechococcus sp. WH 7805
MSDFLAAAVQLTSTSDPETNFSAAEEQIDLAARRGAELIGLPENFAFIGEPEQRLAIAPALADQASQFLITMARRYQVVILGGGFPVPVGDGAHTWQRAQLVGRDGQVLASYDKIHLFDVDLPDGSSYRESSSFMPGSSPPPVVDVPGLCRVGVSICYDVRFPELYRHLVGAGAELLMIPAAFTAFTGKDHWQVLLQARAIENTAYVLAPAQTGSDVGRRFSHGHSMVIDPWGTVLADAGVSQGAAVAPVDLDHLARIRSQMPCLQHRRSTVF

SEQ ID NO: 12069 - protein, 459 aa, Amycolatopsis methanolica
MTLHLDDLRVRLLGECRYDSPFAEVLSTKRTSPHYVAEGDRVLLEDTVAMLAEHSLPSVQAPSFEAAGPRRKIYFDPARVTAGIVTCGGLCPGLNNVIRGLVQELSVHYRVKRIVGFRNGPGLTAAHRDDTVELTPEVVRDIHNLGGTILGSSRGGQDADEMVETLALHGVDVMFVIGGDGGMRAATFLSGAIRARGLDIAVIGVPKTIDNDLPFTDQSFGFQSAFARATDFISAVSVEAAASPNGVGIVKLMGRHSGFIAAYAALAANSADVVLIPEVPFALDGDDGLLAHVERLVRAKGFAVVVVAEGAGQDLFDAHGLPQLNGRGTDASGNVKLGNIGELLRTSIEAHLTAAGLAPTMRYIDPSYAIRSIPANAYDSVYCLRLAHAAVHAAMAGRTEAAVARWRRRFVHVPFSLMTRRRNQVDPDGDLWMSVLETTCQPAEFGAVAARERISSGFC

SEQ ID NO: 12070 - protein, 322 aa, Salmonella typhimurium
SKIYEDNSLTIGHTPLVRLNRIGNGRILAKVESRNPSFSVACRIGANMIWDAEKRGVLKPGVELVEPTNGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 12071 - protein, 521 aa, Rhodopirellula baltica
MSDQQPRSFGWLILLTALTALATFGVVALLVNIFERKQEARAPFTKVVEVTEISTDPKPWGLNFPQQYEDYLKTVNDDYTDFGGNHALPPSKLEESPWLKRLFAGYAFSIDYREARGHAHMLADQEVTKRVTDVQQSGACLHCHASIAATYRRIGLEEQGEPADAKALANGFQQEAVLAGFRSVSTKKYEEIHAELEKTPDGFDATSGDPHIGGAHPVSCVDCHEPETMAIRVTRPGFILGIDKLAKSDAEVPHLPSIQSWRDSGKKGDYDPNTMATRQEMRSFVCGQCHVEYYCANKMTLTYPWSNGLKMENLEAEWDATTFPDGGEFYDYVHKTTGTKVYKAQHPEFELWSQGIHARAGVSCSDCHMPYEKVGATKVSSHWVRSPMMNINKACQTCHKVPEAEIKARVDVIQDRTRALIDRAASAMTEMLDAIIEVQAAGATEEQLKPIRDLQRKAMWRLDYIASENSKGFHASQESARILGESIDYSRQAIAKAYRIDAKPAASEVASPEDSEASTEE

SEQ ID NO: 12072 - protein, 461 aa, Haemophilus influenzae
MGEMTSLRSHKNGIIFILDIVLFFVLLNVLPFEPKANSGLALLAFIAVLWLSEALHVTITALLVPLLAVALGLVSTKQALVSFADPTIFLFFGGFSLATALHIQKLDKMIANKIMALARGNLFIAVIYLFLITAFLSMWMSNTATAAMMLPLSMGILSQLDREKDHNTYVFVLLGIAYSASIGGMGTLVGSPPNAIVASNLHLTFSDWLWYGLPIMIILLPLMIGILYIIFKPKLHLNFEQTFENIEMNPMRILTFIIFSVIALTWIFSGKINPFISGLLGLQKNIASFDSIVALLAAIVICSTGVASWKQIQSNTDWGVLMLFGGGLTLSAVLKDSGASKILADSIVFMIDGQHFYLIGLLVAAFIIFLTEFTSNTASAALLVPIFISIAQSLGMPEIGLALIIGIGASCAFMLPVATPPNAIVFGSGQVKQSEMVKVGFLLNLVCVVVIATMGYMFWIK

SEQ ID NO: 12073 - protein, 267 aa, Cichorium intybus
TRSVALIPKEIAPTRREKIPCKLISKTSVSHDVRLFRFALPSPDQVLGLPVGKHVFVCATIDDKLCMRAYTPTSTIDEVGYFELLVKIYFKGVEPKFPNGGLMSQHLESMELGSSIEIKGPLGHIEYMGRGTFSVHGKQKFARKLAMFAGGTGITPDLSSDASYLKDPEDDTEMYVVYANRTEDDILLREELDAWADKYSDRVKVWYVVAKSIREGWKYSEGFITEDIMREHVPEVSEDTLALACGPPPMIQFAINPNLEKMGYDIK

SEQ ID NO: 12074 - protein, 356 aa, Brassica napus
MSLLTDLVNLDLSDNTEKIIAEYIWVGGSGMDMRSKARTLPGPVTDPSKLPKWNYDGSSTGQAPGEDSEVILYPQAIFKDPFRRGNNILVMCDTYTPAGEPIPTNKRHAAAQIFSNPDVVAEVPWYGIEQEYTLLQKDVKWPVGWPIGGFPGPQGPYYCSVGADKSFGRDIVDAHYKACLYAGINISGINGEVMPGQWEFQVGPSVGISAADEVWIARYILERITEIAGVVVSFDPKPIPGDWNGAGAHTNYSTKSMREEGGYEIIKKAIDKLGLRHKEHISAYGEGNERRLTGHHETADINTFKWGVANRGASIRVGRDTEKEGKGYFEDRRPASNMDPYTVTSMIAETTLLWNP

SEQ ID NO: 12075 - protein, 461 aa, Desulfovibrio vulgaris
MQRTQIVDALAATAPQPVIRLCGWVRTRRDAKGFSFLEINDGSCLANIQAIVDEGIPAYANIGAVSTGAAVDITGELVESPGKGQKWEVRVQTLTLLGAADAETYPLQKKRHSDEFLRSIAHLRARTNKYGAAFRIRSEAAFAIHEFYRERGFFYVHTPILTGSDCEGAGEMFRVTTLPVEGSATPASGNRYENDFFGKECNLTVSGQLEAETLALGLGKVYTFGPTFRAENSNTPRHAAEFWMIEPEVAFADLEEDMNLAEDMTRTVVRRILDRCAADLDLFNRFVDTTLVERLRQIADEPFARCSYTEAIELLLKSGKKFEYPVSFGLDLQTEHERYLAEEHFGKPVIVYNYPKEIKAFYMRLNDDGRTVAAMDVLVPRIGELIGGSQREERLDVLEARINEMGQNLEDYWWYLDLRRFGSVPHAGFGMGFERLLMLLTGITNIRDVIPFPRTPGNLEF

SEQ ID NO: 12076 - protein, 954 aa, Vibrio parahaemolyticus
MTELLQSLSTQNEFVGRHNGPKLSDQQKMLEAINAVSLDALISETVPANIRLEQPMTLAEAKSEADMLATMKQFAKQNQVKRTFIGQGYYNTFTPNVILRNVLENPGWYTAYTPYQPEISQGRLESLLNFQQMVIDLTGMEIANASLLDEATAAAEAMTLCKRAGKSKSNVFFVADDVHPQTIEVVKTRAKFIGFEVLVGSLESLPEQDVFGALVQYPSTTGEVRDLTDIIAKAQANKTLVTVATDLLACTLLKPAGEMGADVAIGSAQRFGVPMGYGGPHAAFMATRDKHKRTMPGRVIGVSIDAKGNQALRMAMQTREQHIRREKATSNICTAQALLANMASFYAVYHGAEGLRTIARRTHHMTAILAAGLTKGGFELAHNSFFDTITINTGEKTQDLYTKALAADINLRVLPGKLGISLDETTTVADVEALFAIFGVKEDVTALSTEVAGNEFAAIPEALRRTSEYLTHPVFNTYHSETQMMRYLKQLENKDFSLTHGMIPLGSCTMKLNAAAEMIPITWPEFGSIHPFAPAEQAAGYAALAKDLKEKLCEITGYDAFSLQPNSGASGEYAGLIAIQRYHESRGEGHRNVCLIPSSAHGTNPATASMVSMKVVVVKCDDEGNIDIDDLAAKIEKHKDNLSSIMITYPSTHGVYEEKVKEVCEMVHAAGGQVYLDGANMNAQVGLTSPGFIGSDVSHLNLHKTFCIPHGGGGPGMGPIGVKSHLAPFLPGHIENGVEGEDFAVSAADFGSASILPISWAYIAMMGEAGLSNATKVAILNANYVMERLRPHYPVLYRGKNGRVAHECIIDIRPLKEETGISEEDIAKRLMDYGFHAPTMSFPVAGTLMVEPTESEDLAELNRFCDAMISIREEMTKVKNGEWPLENNPLVNAPHTQVDLSAEEWDRPYSRELGCFPSKATKSWKYWPTVNRVDNVYGDRNLICSCPSIDNYED

SEQ ID NO: 12077 - protein, 307 aa, Oryza sativa
  misc_feature (117)..(117): Xaa can be any naturally occurring amino acid
MEGGGARNGSTTGAARTGGSGGDAAAGGGGGSAGNGKPLPPCCVKARAAAPESEAKCHATVVSGWFTEPRSRGGKTSKVQYYNNPMWPGEAHSLKVEKILYQGKSPYQEVLVFESSXVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEMHRAAFVLPTFARRELEAYCTTVEREQQEETTAEPLKMNIMPNSEILTAS

SEQ ID NO: 12078 - protein, 546 aa, Arabidopsis thaliana
MNHSTSDQSLYIESDDGDDERKHLSDDEDDDGTLSDTSDAYNQNQHHLSKASPYSTAWPKSYRQSIDMFGSVPSPNLGFLANSSMSRRGSSFMSSTLTRRHTPESLPCVTKPLLEDEEAPKHKLSTHSLLPSKPSSSMVVSHDMGISNDSSFGQAVLNGVNVLCGVGILSTPYAVKEGGWLGLIILFAFGILCFYTGLLLRYCLDSHPDVQTYPDIGHAAFGSTGRILVSVILYMELYAMSVEYIILEGDNLSSMFPNASLSIGGFHLDAPRLFALLTTLAVLPTVWLRDLSVLSYISAGGVIASVLVVLCLFWVGLVDDVGIHSKGTPLNLATLPVSVGLYGYCYSGHGVFPNIYTSMAKPSQFSAVLLASFGICTLMYAGVAVMGYSMFGESTESQFTLNLPQDLVASKIALWTTVVNPFTKYPLSRNIQRLFIYLFAMSLEELIPSNYGKSRFYAIAIRSALAISTLLVGLAIPFFGLVMSLIGSFLTMLIFLDTDADTTASLFLEHLKEKSNPYSGDNLYLNYDSRSSMFSHWHIFSPCKDH

SEQ ID NO: 12079 - protein, 431 aa, Vibrio parahaemolyticus
MNKSYPNHSLENFFSTNLSATDDAVFAGIQAEFTRQNEQIELIASENIVSKAVMQAQGTCLTNKYAEGYPGRRYYGGCEHVDTVEAIAIERAKKLFNCEYANVQPHSGAQANGAVKLALLQPGDTILGMSLDAGGHLTHGARPALSGKWFNAVQYGVDRETLEINYDDVRALALEHKPKMIIAGGSAIPRTIDFAKFREIADEVNAILMVDMAHIAGLIATGAHPSPLPHAHVVTTTTHKTLRGPRGGMILTNHEDIIKKINSAVFPGLQGGPLMHVIAAKAVAFGEALGPEFKTYIDSVINNAKVLAEVLQTRGCDIVTGGTDTHLMLVDLRPKGLKGNKAEEALERAGITCNKNGIPFDTEKPMITSGIRLGTPAGTSRGFGAEEFKLIGNWIGDVLDGLVNNPEGDAIVEKRVRKEVKELCSRFPLYQ

SEQ ID NO: 12080 - protein, 97 aa, Brassica napus
MFNRWLCYACGRRFICKYAMGYFPISLHVEDYNAFDSSRAYVFGYEPHSVLPIGVAALANHVGFMPLPKLKVLASSAVFHTPFLRQIWTWIGLIAAT

SEQ ID NO: 12081 - protein, 414 aa, Bifidobacterium longum
MTKNPKILSIVLAGGEGTRLMPLTRDRAKPAVPFGGVYRLIDFPLSNLVNSGYRQVVVLTQYKSHSLDRHISQVWRFSPLLGSYVSPVPAQQRLGKHWYLGSADAIYQTINIIEDVQPDIVVIVGADHVYRMDFEQMVQQHIESGAEFTVAGIRQPIEESNQFGVIEVDPDHPNMIKNFQEKPPTTTGLPDNPNQILASMGNYVANTKALFEALALDEKAADTKHDMGGDIAPYFASRNEAGVYDFNSNEIPGSTATDHAYWRDVGTIKQFYDAHMDLIAYVPEFNLYNQDWPIYTMSGNLPPAKFVHAGRDRLGHATDSIVSPGVIVSGGEVHHSVLSPNVRIHSWAQIVDSVLFDGVVINRRARVYKAILDKNVVLTENSTVGIDTEHDLARGFTVTPDGITVVPKNTIVDD

SEQ ID NO: 12082 - protein, 469 aa, Kluyveromyces lactis
MPYALSDSHKNLVSAHLSESDPEVEQIIKDEIDRQKHSIVLIASENFTSTSVFDALGTPMCNKYSEGYPGARYYGGNEHIDRMELLCQKRALEAFNLTADKWGVNVQTLSGSPANLQVYQALMRPHERLMGLFLPDGGHLSHGYQTENRKISAVSTYFESFPYRVDPKTGIIDYDTLEKNAILYRPKILVAGTSAYCRLIDYKRMREIADKVGAYLMVDMAHISGLIAAGVIPSPFEYADIVTTTTHKSLRGPRGAMIFFRRGIRSVNPKTGKEIPYDLEGPINFSVFPGHQGGPHNHTISALATALKQANTPEFKEYQTQVLKNAKVLEESFKKLGYRLVSDGTDSHMVLVSLREKGVDGARVEYVCENINIALNKNSIPGDKSALVPGGVRIGAPAMTTRGFGEPEFARIVDYIDKAVQFAAKTQQSLPKEANKLKDFKAKVNEGSEELTQLKNEIYQWAGEFPLPV

SEQ ID NO: 12083 - protein, 124 aa, Crocosphaera watsonii
MTATYKVRLIKTVKRKNKETGKKEEINQLDISLDVPEDEYILEAFEDAINHDQIEYPDGLEELPSSCRAGSCSSCLGRMVEGEVDQEDQSFLDDEQLEKGWVLLCVAYPRSDCTIKTHQEANLV

SEQ ID NO: 12084 - protein, 304 aa, Unknown
  Nostoc sp. PCC 7119
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVATY

SEQ ID NO: 12085 - protein, 406 aa, Kluyveromyces lactis
MSVRYCTKNLVGRAPFALRSGAVRLQSSSSKASSSDESNAIKGENGEELQSVDVAAARQSEFNGSISQLLHQAMNTPIEELGDLETKLKSPLTEKEQQLDEKLTAFLRKYSKYNKVLDLPEDTNKFDFSSKVLSQPLHTREFPYLSHTSKEKPYSEQELYVRQLKHAAHTSKLGANIQDVYFPHKDVFNPPSLQQVSIEKLMAAGVHLGQSTALWRASTQPYIYGEYKGIHIIDLNQTLSHLKRAAQVVEGVAENGGLILFLGTREGQKRTLIKAAERVNGYYVASKWVPGTLTNPTEISSSWERHEVDYFGNPTGRELTLNESMSIIKPDLLVVLNPTENRNALKEAMKARVPTIGIIDTDSEPSLVTYPIPANDDSLRSVSLLTSILAKAGERGVQTRLNRASV

SEQ ID NO: 12086 - protein, 309 aa, Xanthomonas campestris
MAPSHWRVILNGKSTDNMDLREAVGTLRKRGIQLDVRVTWEDGDAERYVGEAVADGVHTVVAAGGDGTLSEVAAALAHHEGDAASLPSLGLVPLGTANDFATAANLPIAPLEALTLIAERVAQPVDLLRIDADHGPHWCANVASGGFGTQVTVETDEGLKKMLGGLAYLITGMSRLGRIDPISARFSGPEFSWEGEFIALGLGNGRQAGGGQALCPEALIDDGLLDVTIVPDLDGEVAATLGTLVIGGKQAALERVAVRARVPWLEIVSQQPLTLNLDGEPETSRHFRIECVPARLRMHLPGECPLLGG

SEQ ID NO: 12087 - protein, 351 aa, Antirrhinum majus
MEGGGGSSSNSCMIGFGENTSSNNGFCPMTMMMMPPPSMASSHPNGNTLFFPLPSTNNSHQGLNHRTSASTMLEDQHNNNTITSTGYYFMDGNDNDSVKAKIMAHPYYHKLLAAYINCQKIGAPPEVAVKLEEACASAATMGRNSVSRIGEDPALDQFMEAYCEMLSKYEQELSKPFREAMLFLSRIECQFKALTLSSSDSACGEAMDRHGSSEEEIDVDNSLIDPQAEDRELKGQLLRKYSGYLGSLKQEFMKKRKKGKLPKEARQQLLDWWSRHYKWPYPSESQKLALAEQTGLDQKQINNWFINQRKRHWKPSEDMQFVVMDAAHPGHYYMDNVLGNPFAMDILPTLL

SEQ ID NO: 12088 - protein, 480 aa, Gloeobacter violaceus
MQIHTPNWVKHAIFYQIFPDRFSRTQQLKQKLLQAVSFEDWAAAPTLYGYKGGDLWGVIERLDYLSDLGINAIYFTPIFQSASNHRYHTHDYYRVDPLLGGNEAFKALLDAAHARDIKVVLDGVFNHASRGFFFFHDILENGQLSPWLDWFKIEGWPLSPYNVEQPANYACWDNNRALPQFNHANPMVREYIMEIAEYWIKAGIDGWRLDVPACVEAEGFWQEFRERVKAINPEAYIVGEIWEDARQWLDGTQFDGVMNYLFAAPTIAFTAGDRVQVQYVQDRSYRPYPALFAVEYKEAIDKLLGLYDWEIQLAQLNLLDSHDTARVLTIAGGDRASVELATLLLLTFPGAPSIYYGDEVGLPGGIDPDSRQGFPPESQWNGELLALHRDLIALRHRHEALRIGKYKSVYASGQCYVFERRLEAEVLLVAVNAGTEPARVTLEAPGETYPRKVLFGPGQVEAAEGHLELSLPARSGLVLG

SEQ ID NO: 12089 - protein, 415 aa, Thermotoga maritima
PEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMDLPFGGGKGGVRVDPKKLSRNELERLSRRFFSEIQVIIGPYNDIPAPDVNTNADVIAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKKAFNDVMKVKEKYNVDMRTAAYILAIDRVAYATKKRGIYP

SEQ ID NO: 12090 - protein, 353 aa, Antirrhinum majus
MEGSGGGGMMAFGENNNNNSNNGFCPSNMMMPQLASNCEGGYSTTPFVPLVPFTNHHHHHQEMNRQRSTVVGGSSMVYEEGHQNNSNAITSTGYYFMDSTNCDESSLKAKIMAHPHYHRLLAAYVNCHKIGAPPEVVSRLEEAAAAMARHGTISVGEDPGLDQLMEAYSEMLSKYEQELSKPFKEAMLFLSRIESQFKALTVSAARGEAMFRNGSSEEEIDVNNSFIDPQAEDIELKGQLLRKYSGYLGSLKQEFMKKRKKGKLPKEARQQLLEWWSRHYKWPYPSESQKLALAESTGLDQKQINNWFINQRKRHWKPSEDMQFVVMDAANPQYYMENILGNPFPMDISPALL

SEQ ID NO: 12091 - protein, 129 aa, Dechloromonas aromatica
MENTATTYEKIGGEPVVGKLCDRFYELMGTIPQFAELRAMHPEDLQGSRDKLYMFLSGWFGGPDLFVEKFGHPRLRGRHMPFAIGVKERDQWVACMALAMEDVGLSEDIRKVLLNNFFNTADFMRNKSE

SEQ ID NO: 12092 - protein, 362 aa, Ipomoea batatas
MVTTITVPSRVERLAGSGIERIPKEYIRPEEERPSIGDIFAEEKMGGGPQVPTVDLKGINSEDLEVREKCREELRKAAVDWGVMHLVNHGIPKELTGRVKAAGEGFFGQSIEEKEKYANDQAAGNVQGYGSKLANNASGQLEWEDYFFHCVFSEDKTDLSIWPKTPSDYIAATREYAKQLRALTTTVLAVLSLGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 12093 - protein, 367 aa, Agrobacterium tumefaciens
MCFRWQKPRQASRLRIVTYERFVMTKFKLEYIWLDGYKPVANLRGKTQIKEFDEFPTLEQLPLWGFDGSSTQQAEGHSSDCVLKPVAIYPDPARTNGALVMCEVMMPDGVTPHASNSRATILEDEDAWFGFEQEYFFYQDGRPLGFPEQGYPAPQGPYYTGVGFKNVGSVAREIVEEHLDLCLEAGINHEGINAEVAKGQWEFQVFGKGSKRAADQIWIARYLLLRLCEQYGIDVEFHCKPLGDTDWNGSGMHCNFSTKFMREVGGKDYFEALMAAFAKNWQEHIDVYGPDNHLRLTGKHETAPWNKFSYGVADRGASIRVPHSFVNNGYRGYLEDRRPNSQGCPYQIASVVLKTIAEVPLAKSAAA

SEQ ID NO: 12094 - protein, 886 aa, Zea mays
METGAAAAPASRADGVRRCKILVPWRFQPGFVRQPLKQAANDAAVNGDGGNTAGAPDAKSCRADGAASDGGETNVFRDAKKFGSGRATRGKNGEVDGGEEHSERCTSSQSLKSPDVENGGRPGPGDACNLGESVRGGWVKSSPLEGTGNSRGANGGVEAGEDYNLGSSNCDASWKDARTQEFRGAGDGAACDPEVIESNVGAEKCFAKGLKKPFMDQTGSKSNGSSAPGLESEDPEGNVGLEDSSYQAAKGCSMGDGAAKENEATANGCSSATPGSIGNGTYVRKGRKAAVPWRFQARYKRSFSDAFGSNNESPDLPAYMFDSSSTQCTPATRSTVRCYASAHSGVRVSAMNNFSVKGDTECKKRKTNNDYQDESMLNNGGVVVRERIMRSLQDLRLIYRDLLDEEDNSREKVLNVRPDLKAYRIFRERFCTDFDDEKYIGSVPGIYPGDIFHLRVELCVVGLHRPHRVGIDCTKKDDGTTVAVSIVSCAQSHDIKYNLDAFVYTGLVAVAVNQRIEGTNLALKKSMDTNTPVRVIHGFTTFNGKKKFPAYIYGGLYLVEKYWREKEHGDRYVYMFRLRRMEGQKHIDIQEILQTGNSGSNDNVIIKDLSRGLERVPLPVVNKISDERPMPYCYISHLRYPRNYRPTPPAGCNCVGGCSDSNKCACAVKNGGEIPFNDKGRIVEAKPLVYECGPSCKCPPTCHNRVGQHGLKFRLQIFKTKSMGWGVRTLEFIPSGSFVCEYIGEVLEDEEAQKRTNDEYLFAIGHNYYDKSLWEGLSRSIPSLQKGPGKDDENETGFAVDASEMGNFAKFINHNCTPNIYAQNVLYDHEEISVPHIMFFACDDIRPNQELAYHYNYKIDQVHDANGNIKKKKCLCGSVECDGWLY

SEQ ID NO: 12095 - protein, 1697 aa, Cryptococcus neoformans
MSIANSSSSPEDQNITSLLENHSRETGELPSPPLVEDRAAPNGMKLDGENIVGQSNGISAAQAAVTTSRTSSLTSNLNRPQSVSGAQPAVASSSRSTINSPPRRYLLISQQSPSSRTTPCRSAGTASPTSRPPTPPLPPTQSTPVTVSGLSAPSILSPVPAASSAISPTIPSIPLHAPLPYPTLSLPPSATPALPNSFTLSASTILPADSSTSALPSTSAAGLPVMPVFISPATSSPAGPEPSTLQSASEVTKSSNQKESPRKTDSKQAPSPSSTHGLWTNTRPFHASSNLSATSGKSSAASSRSTSRTLLPGRAATSDNVAGPSKTTSVSSTHPPARAPSLSLPSEPEKQVHPRSPSHEGVGKREKKSKALSSGTGQSTPSRSSLSTYDVASNRKTKSTGLNALPQKPSSAGKTSSIPQRTSTLATAMAIRPFIRSPTSPCRPSSFEASGPIQSSGGAVKAAQTQDKIHPLSTTSSISSHSRETTTKAATPSHVTISSPSPSQSTSALTTVHVTQDAQKSATTSPTREKIHPSRRKSQTSDCVVAPTTSQTAASLSYPAGTSDGTGEAGKKAAETSVHAGPSSADFGAFVVPPTTAIASTTVSPSVTPPEDAPFLKSGPSVHPLFHAASAIGGQDTLTETGAVGDVLSQGSKGRASSPRITTTGAVSHLVLPIDVGSEIKPTAAPSLFASGVTIENVDDQAAAQPQNQAPLPSALSVLSKKNLGSSSKESSVKSAASSVSSSSTLGDSVSGLGRKSHHKSTQSIPQSPLPTTNTSNSSGIEVNSWLNPQPFGPSFAASHLNTHAKKKWKGKEREKEREKEKAREKEKAKEENEQLRRRRMADLEKISATLEKYKGRMGVESRTRSIPRADGENRKRPPSPGISASTDGEVRVVKRSKPAWAIGPENGHVAAAMEKETNDNKKTTDAIKINHQPAAFYTPQFATPTSAAKTTTTPLSVTAGLGPPVNSSSSSSTPSLLSRSINLDIPRETPEERMDDDDGNDSTGGLLVRKTGKNDAVEEQVEQVRLDLDDVSIHGSSPVGPISTFTSRFRNVSITPSQTQKILEQPGEDVPIRRSAIKINGKQKAQRSKDKSDGSESEDDVPLNWPSRKGKGKAAPEPQDNSETQRDDDGVNLGSSNGEEGSSDDHSNPVLPPFLFKDRPAHVRQPLQTLFKGGFVAKHSYQRPLVKSSAVSPVPNANRTSSEPSAKADLLPQKRKRRPKKLTREQWHHIAQNHLSDVDDLLDESSKKRLSPKSAEKLGADLSKLTSPRVFSIVSRSEPRSKGAPIEENDNEYFTDSDSHTSDIALFLQHPDPPPPPERIREAKRNFGTRTIDPWNRQKHTFRSNPALHRAIFEAYIMQSTSMEESGGDDIKVTNEVDADGGPPDFEFVYSDTMLYPDGIPPPELGLGCDCDGPCDPDSETCTCVKRQELYFYDLGLKGFAYDENGKIRENSASIWECNELCGCPPECMNRVIQRGRAKDTGIEIFKTKEKGWGIRARSFIPSGTYIGSYTGELIREAESERRGVTYTAIGRTYVFDLDGWQIRHPPKGLEKIDKRAAELAEAVKMRAKAAMRESQEDAYNAYSVDAFHYGNFTRYFNHSCDPNLAITQAYVKDFHPERPLLVIFTRRDIKKHEELCISYKGIPDDDVPSPEPVKKKKGNKGKKQMSKTSASAHPPEMIALNSDKGPVEVKDICRW

SEQ ID NO: 12096 - protein, 401 aa, Unknown
  Candidatus Desulfococcus oleovorans Hxd3
MVAGLAADTSIVVPDKKLEDAGIKVLQDEVVQVDAAGKTVTLAGGNTVPYDKLYLATGSRSFVPPIEGKDLEGVMTLRGIEDARRIRTFLTEKTPRHIVFVGAGFISMETATLLAEHMPGQFDISVVELIDRPLPLMLDKDMADMVTAYLTEKGLNLLTGEKVEKLAGENGKVTGVALASGKTLDADMVFINVGVRPNIELAQAVGLEMGRFGIKVNPFQETSNPDILAGGDCVEKINFITKAPCPGQLRGPAVMQGRVAAKRLAGLDVPFPGVVDAGGCKMFDMTITATGLSESAAAREGIETVCASVDSRSKHAMIPGAKESRIKLVFEKKTKKLIGGQIVSHDIAPARAIDTVTAFILGGKTVADLTTFTSACNPDISSEPSAEFITVAAEQALQKLR

SEQ ID NO: 12097 - protein, 350 aa, Glycine max
  misc_feature (21)..(21): Xaa can be any naturally occurring amino acid
  misc_feature (52)..(52): Xaa can be any naturally occurring amino acid
VGGTWRRLETPLCYVGVARPXSLAFRLKKQKGWERGEGLGKEKQGTKDTVRXVKSQHDTIGIGLEKPNNLGPFDTTQFDNIPTRPKVQAPQSHDTEEKVETKPSVPVGNEHSVSKTTRPQGRYTRRERGKLVSQYSLKDLEGILVKKGDISGSTENSNGELDMLNTSEIQNFEDEGSQYPAIPPDWWGYKYGFVSGGFLGAELKKKKSMISGKAERTAFFEEDQENLYNLVQEKSTTGKQGLGIKDRPKKVAGCYFQGKKKSFDDSDEDSADNDSLEQAANDDLIKVEKIVEGKVKLKKLCKHILQQVPGESLKLKQLTVPIDEHSSSILSDFSSRRESVAYLKQKLTGS

SEQ ID NO: 12098 - protein, 481 aa, Elaeis guineensis
LTFVDLSRNNLSGEIPAEIAGIRILNYLNVSRNHLEGSIPPSIATMQSLTAVDFSYNNLSGLVPSTGQFSYFNVTSFVGNAELCGPYLGPCGFTNSSGSTHARGPLSASFKLLLGHWSPPLFHCLRHRRHHQKLGSFEEGRARPGHGSLTAFQRLDFTCDDVLDWLKEENIIGKGGAGIVFQGCDAQRRTVAVKKLPAINPGSSHEHGFSAEIQTLGRIRHRHIVRLLGFCSNHETNLLVYEYMPNGSLGEVLHGKKGGHLRWDTRYKIAVEAAKGLCYLHHDCSPLILHRDVKSNNILLDSDFEAHVADFGLAKFLQDSGTSECISAIAGSYGYIAPEYATLKVDEKSDVYSFGVVLLELVTGRKPVGEFGDGVDIVQWVRKVTDTNKEGILKIIDPRLSSVPLHEAMHVFYVAMLCVEEQSVERPTMREVVQILTELPGTPAKQGEDPPPPPPVGGETPPRESKPRQEQQSPPPDLLSI

SEQ ID NO: 12099 - protein, 104 aa, Oryza sativa
MSAGVGGLRQLLAAAVTTGVAEARAAIFGHALNPTGKRAATKLLRKKMVGEQLAQWYPYDIKRDDPLVMAREEKARLSKLEMLKRRGKGPPKKGQGRRAVKRSK

SEQ ID NO: 12100 - protein, 72 aa, Desulfovibrio vulgaris
MAKEDAIEVDGVVQEALPNAMFRVELQNGHEVLAHISGKMRKFYIRILPGDRVKVELSPYDLKRGRITYRMK

SEQ ID NO: 12101 - protein, 383 aa, Unknown
  delta proteobacterium MLMS-1
NLAMLTGNVEKQECGVDPLRGQNNVQGACDMGGLPAMLPGYQPVADEECRRRFEQAWGVEIPTRPGKTLLEMTHGRLPPDHRRPAAGRQQPATPLRGLFIMGENPLLSDPDLTRVRKNLAGLELLAVSDIFLTETAARAHVVLPAACFAEKDGTFTNTERRVQLIRQAVAPPGQARPDGEIIAALARRLGYEMAGSPAHEIMEEIALLTPIYGGIYHDRLASGTGLQWPCWDRRHPGTPYLHKYYFTRGKGRFVVAAQEEPAEAPDADYPLLLNSGRLYHHYHTGAMTRKSPLLEREARVARLQVNPADAESRGIRDGERVRLRSRRGQVELAAELTTMVPPGMVYGTFHFQEAPINRLTIAACDQRAKCPEYKICAVELSKE

SEQ ID NO: 12102 - protein, 196 aa, Haloquadratum walsbyi
MVDINFLGVGIGATLTLLAVSLHYARGTGWTPTADISQEVLEKRASTVPETEFPEPMNRSIGGGAIPAGSVTGGGGELEETDTEVDESEQVPGDIPDEEAEYFEVEFEKQGSTIEVASNQTVLTAGENESWDLPYACRQGQCVSCAGQITSGGNAEDYVEHDNQQMLDDAELEHGYTLTCVAYPKDDFTIETGEAP

SEQ ID NO: 12103 - protein, 327 aa, Candida glabrata
MTWDPSELPYYNPQVDDRVAVVTGGNSGIGWFTVLHLYMHGFRVYVCGRNSHKVSRAMDDIIEEAVRRHNLYLKGLHDQKPTRYLGSLQYLHTDLTDLKCVDRAAAKILRMENHLDVLVNNAGVMAVPYEITKDGFEIQMQTNYIAHFLLTMRLLPLLRCSHGRVVTLSSLGHHIIFKYSKLDETWNYFPNFVFTWFRYAMTKVASIQYTKMLAIKNPDILFVSVHPGLVMNTNLFSFWTRLPLVGIFFWLLFQVVGFMFGVSNEQGAYSTLRCSLSQELTTTNDNGKYFTTGGKESRSSYVANNLDDAASTWIWTMKQLRNRGFDI

SEQ ID NO: 12104 - protein, 306 aa, Haloquadratum walsbyi
MQLGVVGLGRMGQIVVDRLVTAGHDIVAFDLDAEAVATAADIGATPADSLDTLLDTLGETKRLWLMVPAGEAVDATLTQLEPSLTETDIIVDGGNSHFEASIRRAETSDATYLDCGTSGGPAGAELGFSLMIGGQQWAYDELIPVFDAIATGPDGHDRMGPVGSGHYVKMVHNGVEYALMQTYGEGFELLANGRYDLDLAAVARTWNNGAVIRSWLLELCEEAFRAEGVDLGNVADYIAGGSTGTWTVQEALEQEVPVPLIYQALAERFGSRATGATGDPDGRFSRRVANRLRYGFGRHDVARRDE

SEQ ID NO: 12105 - protein, 1019 aa, Adiantum capillus-veneris
MDPYQQDAASSSGTGYSLHRPPPPDASSSTSGVPTVPRDTHGSLEVFSPAGYIPSGPTSSMFARGSDKQFKPGVHIADRQPVIDFGKFPSPLRPYEEDVASEDFSIEPAEAEKAEESGKEDLHTDWPTEAEKASPAPAEKGDHKILSDDGVAERAAQWGLVVKGRAGVGARTSNEEKRTDSFQQQRGTSLSVRSSEDSEHGGLYIPRVSKDLKDALETFQQTFVVSDATRPDYPILYASAGFFKMTGYSSKEVIGRNCRFLQGADTDPDDVERIRESLAEGKNYCGRLLNYKKDGTAFWNLLTIAPIKDEEGNVLKFIGMQVEVSKHTEGHKVKALRPNGLPESLIKYDARQKDRAVMDVSELIQAVKHPHHNGHAPQHHPPSSVKSTIAEVPSVATVPPMTDRRSSLGPGKSDSMSDGIPKRHRSSGFRSLIGLDKFGKSAQQEPIEFIEPEILMTRDEETDSLDELDDKERLQEIRRGIDLATTLERIEKNFVITDPRLPDNPIIFASDSFLELTEYTREEIIGRNCRFLQGQDTDQKTVQKIRDAIREQREITVQLLNYTKTGKRFWNLFHLQPMRDQKGELQYFIGVQLDGSEQLEPIQKRLSEKTEKEGAKIVRATALNVEEAVGELPDANLTPDDLWANHSKSVSAKPHKVHSDLWKALQKIRERGEKIGLKHFRPVKPLGFGDTGSVHLVELRGSGELFAIKAMEKSVMLNRNKVHRACAEREILAVLDHPFLPALYASFQTQTHVCLVTDFCPGGELFLLLDRQPRKVFSEETARFYLAEIIIALEYLHCQGIIYRDLKPENVLLQRDGHVVLTDFDLSFITSCNPQLVRPPSPPGRRRKYKQMPPPFFMAEPVTTSNSFVGTEEYIAPEVITGAGHSSAVDWWAVGILLYEMIYGRTPFRGKNRQKTFANVLHKDLTFPSSIPASLAARQLINGLLHRDPANRLGSATGAYEIKNHAFFRGINWPLIRDMVPPPLEAPLELVGKDPDFDSREALEWDELEASSTFVSDVF

SEQ ID NO: 12106 - protein, 667 aa, Desulfovibrio vulgaris
MPNLRIIVVDDEQIVALDLRRTLEGLGYIVPAVETDADGAIDAAKRLRPDLVLMDIRLRRGDGVDAAHVITNQFDIPVVFLTAFSDEATLSRAMKAGPFGFLVKPFAERELYSTIEVALLKHRAVREIDEARQAAEHASLAKTSFLAGMSHEIRNTLNGIVGMTELVLDTPLSGEQRESLNTVLASSETLLTLLHDVLDFSRLEARQLRLVERPFSLDRLLKQVVQASRSEAERKNISLDFRVTPDVPDRLTGDATRLTQVLANLVGNAVKFTHKGSVIIEVSAIPQDQTLLESLFPDGPPSSLTLLFSIRDTGIGIADEHLRTIFEAFSQGAEETVQRYGGTGLGLAICRNLVEIMGGSIWARSSEGQGSSFHFTCRLRPETPAINTPSEHAQAPTSSATPASGARPLRVLVVDDDATGRTITCKMLRKRGHVCACAHDGATALQRLTADRFDLVLLDVKMHPMGGLELLRRIRNAQYPGVDRNIPVVAVTAHALKGDRERFLASGMTDYIAKPINARAFNAMLDRFALSASSARDIPVIPDRSALLAPSEVVRRHGGDHNLVEPVWKAFCDEAPRHFALLAGALEEGDAQQAARFNKRLRLASEHAGAVALAMLTERVGLCLVEDDTAGARQLVPRLESLLSRTIGLILSGMGTTEVPPIEHTTD

SEQ ID NO: 12107 - protein, 353 aa, Oryza sativa
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGGAAVAPAKSVAAAPVNNKPAAKKEKRAADVDRSLPFKKRCKMVDHVAAAVAATKPTAAGEVVAAAPKDQDHVIVVGGENAAATSMPAQNPISKAAATAAAAAASPAFFHGLPRDEITDAAMLLMTLSCGLVHS

SEQ ID NO: 12108 - protein, 434 aa, Arabidopsis thaliana
  misc_feature (107)..(107): Xaa can be any naturally occurring amino acid
MELTLKLLVLLLFILNHHVGSGSIVKFLPGFEGPLPFELETGYIGIGEEEEVQLFYYFIKSERNPKEDPLLLWLSGGPGCSSITGLLFQNGPLALKSEVYNGSVPSXLVSTTYSWTKTANIIFLDQPVGAGFSYSRAPLIDTPTDTGEVKRIHEFLQKWLSKHPQFSSNHFYAGGDSYSGMIVPALVQEISKGNYICCNPPINLKGYVLGNPITHEDDPNYRIPFSHGMALISDELYESIREACKGNYFNVDPRNTKCLKLVEEFHKCTDKLNEFHILSPDCDTASPDCYLYPFYLISFWANDESVRDALHVNKRSIGKWERCNYLSKPYNKDIKSSVPYHMNNSVSGYRSLIYSGDHDLVVPFLATQAWIKSLNYSIIDEWRPWMIRDQITGYTRTYSNKMTFATVKGSGHTAENKPQESFIMFRRWINGQPL

SEQ ID NO: 12109 - protein, 220 aa, Euphorbia esula
MGRRPARCYRQIKNKPYPKSRFCRGVPDPKIRIYDVGMKKKGVDEFPFCVHLVSWEKENVSSEALEAARIACNKYMTKFAGKDAFHLRVRVHPFHVLRINKMLSCAGADRLQTGMRGAFGKPQGVCARVAIGQVLLSVRCKDNNSHNAQEALRRAKFKFPGRQKIIVSRKWGFTKINRADYPRLKSENRILPDGVNAKLLGCHGRLANRKPGRAFIDAVA

SEQ ID NO: 12110 - protein, 870 aa, Dechloromonas aromatica
MKRMLFNATQAEELRVAIVDGQKLIDLDIESAAKEQRKSNIYKGVITRIEPSLEACFVDYGADRHGFLPFKEVSRAFFQPGTEVGRARIQDALKEGQELIIQVDKDERGNKGAALTTYVSLAGRYLVLMPNNPRGGGVSRRVDGDERAELRDVMDQLEVPNGMSLIARTAAIGRQAEELQWDLNYLLQLWTAIDGAAQQQSGAFLIYLEGSLVIRAIRDYFQPDIGEILIDTDEVYEQARAFMGTVMPGNINRVKRYRDDVPLFSRFQIEHQIETAFARQVNLPSGGAIVIDHTEALVAVDVNSGRATKGSDIEETAFKTNQEAAEELARQLRLRDLGGLIVIDFIDMENQKNQREVENRLRDALRFDRARVQMGKISRFGLMELSRQRLRPALAETSYIPCPRCTGTGHIRSAESAALHILRILEEEAMKENTGAVHVQVPVDVATFLLNEKRPDIQAIELRHKVTILLIPNVHLETPAHTITRLRHDDLNQDDLREPSYKMVDMPIEEAIKQATQAEAAKPRQEAAIKGISPDQPAPIMPEKAEAPVAAPAQPEGGLFSKIFSWFRSSPKPVEPVAAPEPAKKPREGRGDGRRDGRRGGRNGNRRDEERGERKERPERKERNAVDKAPQDGTPASNGERKERRPRGERKERGERQQQAETVENKLVQQTAAADAAVAPLLANEAPDAQGNEEQGNRRRGRRGGRGRGERRNEADSTPVAEVLPVIEPAVEPINQEPVVVVIPAAEPVVVAAEVVTPVVEPVASPIVEPVQVAEVIEAAPAAIIEALPVEIQESPKAEAPAPAPAPVVAEPVNLEATLAESGLVMVQTTSAAVAAAQPEPPVKLGRPRKAKPASKQAESESLVMVETAK

SEQ ID NO: 12111 - protein, 796 aa, Coprinopsis cinerea
MDTGRPASSAQASILNAIKATQAYRPTVEYGDEGGVVDEESLILPGLWRDMNEIVPGLWLGGLPSALNAANLKEKGIGSVVSVLRGSVKIKETFIRHQIEIDDVEDSDILSHLLPAVKFIEAELGKGRGVLVHCQAGVSRSSTVVAAYLMYTQKLSPEEALEVVRKARPVIEPNAGFRRQLDLFHEAKHQVSQDNPYVRRFYMERNASSIAAAGSSAPNSGKPAMLGELPAKQTASPSTPATESTPAKKLSRRIRCKKCRHELAAREHMLDHGQIGPPTPPPTPARSLDEDPTPTSALDDLKELDKALDASSPSSPSSTSSAAQAEKRGQDASNSIQALVHTVKRNGNSSLPSTLPISIAPDGSRFIDLSGRPAAGTTATLRPNGGSQSHPPAPPPILINHKCSGYYVEPMKWMEDPFNGETAGKITCPNKRCKAKLGNFDWAVPLVQQLPEMSTMAEEGHMQESTKGKVPSSPPGPSQTLALPPTFYADKLSNAAKARKPCPIHDLFAVGSKSGILSMVLGQPNPSTFPFEKLTIQVKPTTAAGAGDDNVRDVTTNLVLELQEELEVALQYGQTAGVTELVEWIQEMMSDVHDDPYYFLYYGNLPRPPSYFSLERELGGELGRVLRLDSFSKVLAPGFRLGWATGPRELLDAIERHNSISVAQASTFSQIITLKLLREWGLNGFLAHTRQIAEVYKKRRTVFNAYLERHLSGLAEWRVPDASMYFWVKLNLLTADSSTFIREKAISNGVLVLPGQVAYPDGRTTAFVRVAFGMLSDEDMEEAVRRLAKVLKEEER

SEQ ID NO: 12112 - protein, 919 aa, Ostreococcus tauri
MTSGNLAYFTKTRNLRLHHKIHTVRELRAAVCRTQPSTDISNGAVDEASVCTSTSDSESERVRCEISSSRQYVDREEFGEHGAAFLSGNYYPVVQEVTASCSCNERKAVDENPSMRVVGTIPTDFPLGQYAYVGPNPKFPVEHYKRWGQGPGQQDFGLGVGWHHWFEGDGMIYATDFCAGEKVKYRNRFIRTTSWERETKHGARIFRPLMNADGPTFLANALANFVQSGKFMKDSANTALLHFAGRTYALQDTCPPWELDAETLDTVSASTFDGKLPWYVPFTAHPKILPWTGELVFFGFNPVSPPHCTVGTLTPQGEVSSVNPLWSLPFVGSIFMHDFCVTEHFTIIFEGSMDIKPIRQILGIHPLQYNEGKRARFGVLNRGARSNNVSWFNCSCAQMVYHFINAWEDKNAKGEQLIVIVGVREDGFFHEAMRPNGSSAWVQQAVRIGDKIPRVHEWKINLVTGEVAEEYLFHVPMETPRINDKFVGMQNRYAYAGRILLSELETSTQLKFDAIVKIDLHERKTTVYEHGPNRYGMEAQFIARPGSEEEDDGWLIMYVHDESNMSADYQGCTQCVILDARNLEAGPVASISLPERVPYGAHCMWRADMIRPGETFKGAAHDTNVVAVDAKINPQNRPKLFAFTDSQKGELLDATARGISRLALGLFVHGWSPRIAFDDVSRYAFVRGAGLRLQELNGLEKARARQSNAEKMSDGLLIPTLELYDIEDDGSCRLVREVLNILDVAYVCKPCSQHLSKYRSELELLRGVPTGSEQIPYLRDTRDERVKKIGPDAIIQYLYNEYLDGEKPSFLVSLVGWFSKASARTNKTSGFTGSSTVLEQPLVFWAYEASPFCAVVRKALYELGLPHVVLPCARGSIRRDALYKRVGAFQVPFLEDPNTGVSLFESSDIVDYLKRMYTS

SEQ ID NO: 12113 - protein, 590 aa, Cryptococcus neoformans
MLIPFLALASLSRITTAQLTPSPTYSPPTSSAGLTASSETPNTQWSNILGNSLWFYDAQRSGRLDEGTYGNRVDWRNDSALEDGSDWGLDLVGGWYDAGDYIKATFPLSFTLFALSWGALTHGQGYGLANQTAYLDGTLRWGFDWLMKAHPSDDVLFIQVGSGDVDNNYWGGDQDIPSPRPGYPINSSYPGTDGWAAASAAFSLGSLLYTPGVSYRPTSSSSPPTSPSLENSTYASQLLAHAESLYSVANSTTPRQTYYTALGDEVAAYASSDWRDNLCASALALALATNNSAYYADAYNYYVQYGLSGTHEVWNWDSSQPAIYVMFAEIASAKPELAQGAGLDVNLTGWQTEVENYFDGLIKEDFSNSYLTEGGLLYWDGDSDEASLNPAMAAAMLMFKYAPMASSTDKTNSYNSFAQSQLNYLLGSNPMSVPYIVGQHPNSPSNPHSAPASGGFNINNIRDDPPTEAHVLYGAVVGGPLSSDQFWDWRDDWVQTEIALDYNAMIPTLASMQLMNNTADPPYVDIAAGTYSIPSGQPCDAALPCRGGGGLSGGEIAGIVVGVIVGVVLLVIVGVWWWWRKRGKRWGSKW

SEQ ID NO: 12114 - protein, 428 aa, Treponema pallidum [sequence omitted]

SEQ ID NO: 12115 - protein, 369 aa, Unknown
  uncultured bacterium 560
MAQRDYYEVLGVKKGSAEAEIKKAYKRLAMKYHPDRNAGDKASAEKKFKEVRKAYDIISDPQKRSAYDQFGHAGVEQQGAGGFGGGNPFGGGAGGFGDIFGDIFGGGNTKPDNRGPDLRYDLEIDLKQAAKGDTVRIRVPKNDTCDTCSGTGAKPGTKVKTCGNCHGSGQIQMQQGFFSIQRPCNQCHGTGEKIDTPCRTCGGQGIVRKQKTLSVKIPAGVDTGNRIRLSSEGEAGLRGGPSGDLYVQIHIKDHQIFQREGNDLYCEVPIDFAKATLGGSIEVPTLDGKLKINIPSGTQTAKLFRLRGKGMPAMRYNGSGDLLCQVKLETPVNLNSKQKQLLKDFSSSCNAKQYPESNSFFGKMKSFFE

SEQ ID NO: 12116 - protein, 356 aa, Oryza sativa
MVAPATPRPSRILPRASHSHSQPAAVGLASDRAAAATVSSRRRRNFVFVVNPSGANGRTGNQWKQLLPHLRTRFADQCDICECITSAPFDAIDITREAVKDGADAVIAVGGDGTLHEVVNGFFCKGSPVHALDQGPDHSTALGLIPLGTGSDFARTFGWTNDPHEAIDRIVRGVKSKLDIGMMEGPDGNPHYFVNVADIHLSAKAGYFSSMYKRFGNLCYVFGALRAFWGHSNRDLRIKVNGGEWKTIRKVTALCIGNAKYFGGGMKITPTADPFGGDLEVVILQDFKWHDFLLKLHRLYGGTHLSVTGVSSIRVQSIEVAEKEVSADIFVQSDGEHFGFLPTKFSVLPGAVDFFC

SEQ ID NO: 12117 - protein, 240 aa, Unknown
  Synechococcus sp. WH 7805
MLPNWLTGSTGTREQGDGVERHVVLGSPLKAPLMEDQEEIIFGCGCFWGAEKGFWRLPGVISTSVGYAGGETDHPSYDQVCSGRTGHTEVVRVVWSSPAIDVSDLLKLFWECHDPTQGDRQGNDCGSQYRSAIYTTNARQIERVQASREWYQNALSAAGRGAITTEIAADRPYYFAESYHQQYLARPGSRPYCSAMPTGVTLGAFEGAEYRLPAKVWTHYDWSISHCVLRGDNSPINLNP

SEQ ID NO: 12118 - protein, 415 aa, Methanococcoides burtonii
MSDVSAGSTTEKKFSDMDSNGEEHNTDEIQEVDIQKVISENDLLKVQNETMKAKLLETSMMVNKYLSEMDQLKDQLDHLTTPPLFIASVMEVEDDMALLRQHGNNQEVMTRIPPEMEGTIGPGMRVSINAAFAIIAIISRAADVRAQMMELIDSPGIDYDMIGGLDDVLKEVIESVELPLTEPELFENIGIEPPSGVLMYGSPGTGKTLIAKAVASRAHATFIRMSGSDLVQKFIGEGARLVKDVFQLAREKSPSILFIDEIDAVGGMRTHDGTTGSAEVNRTMLQLLAEMDGFDPSGNVKIIAATNRIDLLDPALLRPGRFDRIIEIPIPDEKAREEILKIHTRKMNLEKDIDLAKIANMTDGLSGADLNVIVKEAGMFVLRRRGDMIKMQDFLEAFEKVVSEEEVNTPAGMFA

SEQ ID NO: 12119 - protein, 102 aa, Zea mays
  misc_feature (6)..(6): Xaa can be any naturally occurring amino acid
  misc_feature (30)..(30): Xaa can be any naturally occurring amino acid
  misc_feature (56)..(56): Xaa can be any naturally occurring amino acid
RGLPDXKIVIYDHGINRDGGDEHRYCLHLXFRERENGSQCTQLDVDQVGCIKYMHXFSIKDALHLKDPEHPHHVMSINKSLSCAGADMLHIGLKDHYDKNKD

SEQ ID NO: 12120 - protein, 577 aa, Lachancea kluyveri
MFTRGVNGANRDIDALADNIGQLSFDASDPNKFIFEPTTPSKYKENGSTTGTPSPTKSTLYDDNAGDVSKLSMMDIDERTQDEIDVTKSPKKLPLNFYAKASSSKTKRLVNVCQMYFLDYYCDMFDYVISRRERTRQVMKYLEQQRGQGIQPQQISNEWQGYLNKETNTLRKRRLKPKNKDFEMITQVGQGGYGQVYLARKKDTKEICALKILNKKLLVKLNETNHVLTERDILTTTRSDWLVKLLYAFQDPQSLYLAMEFVPGGDYRTLLINTRFLQAPHARFYISEMFCAVDALHQLGYTHRDLKPENFLIDSKGHIKLTDFGLAAGTVSMERIESMKLRLEEVKNLEFPEFKERSMDDRRRMYKKLRESDVNYASSTVGSPDYMALEVLEAKSYDFTVDYWSLGCIMFESLVGYTPFSGSSTNETYENLRRWKQVLRRPRCENGRYAFSDRTWDLITRLIADPVNRVRSFEHVKRMKYFAEIHFDSLRSMSPPFIPQLDSETDAGYFDDFSNEADMAKYADVFKRQDRLTAMMDDSSADSKLVGFTYRHRKGKNGSSGVLYGGAEHADPFATFY

SEQ ID NO: 12121 - protein, 249 aa, Prochlorococcus marinus
MIKKIIKYLTLIIDKLYSVKSIEKTNKKLQHTILKNDLTAKLKDNEQEILFGCGCFWGAEKGFWRLPGVITTSVGYAGGEKENPNYREVCSGLTGHTEVVRVVWNNNEIDLSDLLKLFWECHDPTQGNRQGNDSGSQYRSAIYTTSKEQLSKAIESKNSYQIELKNNGFGIITTEIENDIKFYFAEDYHQQYLAKPGSRPYCSAMPTKVTFKNFSGANFKLNEKIWSNYNWDITHCILRGENTPIESNL

SEQ ID NO: 12122 - protein, 118 aa, Panax ginseng
LCSGGELFDRIIQRGHYSERKAAELTKIIVGVVESCHSLGVMHRDLKPENFLLVNKDDDFSLKAIDFGLSVFFKPGQVFTDVVGSPYYVAPEVLLKHYGPEADVWTAGVILYILLSGV

SEQ ID NO: 12123 - protein, 589 aa, Kluyveromyces lactis
MAGPPPPPAPPPPMFGGNSSNAGSAATPVPPPAAVPGRDALLSDIRKGAKLKKAHTVDKSAPAIGGSSSMSHSVSVSSSAVPPVAPSIPTPTQLPGVPQLGDILAGGIPKLKHVSGSSKSPAIPSGAPPLPDSSSIPKIPSNRPQRKKTLRSEGDSSVAAPPAPPPMAAPAIPTSPPPVPMMNTPPVPKHPPARQRTEAPPVQAQPAPPVTLPPAPPAPPIAVPPAPAPPVPLAPPTISTPPAAPPAPPTPAPPTSAPPAPAPPAPPIISTPPAAPPAPPSISFPTSTPQPPPSAPSPAGGLPFLAEIQRKRDDRFVVEGTGHGASNNTASSAPKVPLPSSSAPPAPPSFSAPSVPPTPAPAAPPSIAAPPAPPAPAPPAPPAPPAPPAPPTPSFNAPTLPQSTPSSEAPSIPAGGLPFLASIQSRRDDSHIIESENSHTPVGAPTAPPSPPPQAASFPSAKAPPPPPAASEESLQQNQQPQVERTNSSSSKGFFKHRLFSSGNEASRPSQSTNPYTNAAEIDVGDFTIEGSQDTTGIKLNNSGITIDDSKFDWSNRNDLPKPRQFLGLRKLYPSGRGSSVPLDFTVFT

SEQ ID NO: 12124 - protein, 324 aa, Pseudomonas syringae
MSRIYADNAHSIGNTPLVQINRIAPRGVTILAKIEGRNPGYSVKCRIGANMIWDAESSGRLKPGMTIVEPTSGNTGIGLAFVAAARGYKLMLTMPASMSIERRKVLKALGAELVLTEAAKGMKGAIAKAEELLAGNPGKYFMPAQFENPANPAIHEKTTGPEIWADTDGAIDVLVAGVGTGGTITGISRYIKHTEGKPILSVAVEPDGSPIITQAMAGETITPSPHKIQGIGAGFIPKNLDLSIVDRVERVTDEESKAMARRLMQEEGILCGISCGAAMAAAVRLAEKPEMQGKTIVVVLPDSGERYLSSMLFSDLFTDQELSQ

SEQ ID NO: 12125 - protein, 504 aa, Arthrospira maxima
MLTELWSLKGRYKILHLTWFAFFLSFVVWFNFAPLATAIQDDMGLEISQIRTLAICNVALTVPARIIIGMLLDKYGPRITYSLLLIYAAIPCTAFALAQNFNQLVISRLALSIVGAGFVIGIRMVAEWFPPKEIGLAEGIYGGWGNFGSAAAAFSLPTLAAILTFGSGGVINWRVAVALTGIIAAAYGAFYFFNVQDTPPGKVYQKPKRARGLEVTTPKDFWFLMLMNIPLVGVLAILAWRLSKVGFLTLPQLYIVWVALFGLYLFQGYNCWEANKELILGHKHYPPADRYNFSQVAILELTYFVNFGSELAVVSMLPAFFENTFGLSKPAAGMIAASYAFMNLMSRPGGGLISDKLGSRKNTMAVLTAGMAFAYLIMGRVNGGWWLPLAVLLTMTCSFFVQAGEGSSFAIVPLIKRRVTGQIAGNVGAYGNVGAVVYLTLFSLFPEGDIGNRIFFEMLGVTSMIVAFLCWFFLKEPQGSFADHHQEELQANGRHYPCRQITPK

SEQ ID NO: 12126 - protein, 236 aa, Spinacia oleracea
MTRRYWNINLEEMMEAGVHFGHGTRKWNPRMSPYISAKCKGIHIINLTRTARFLSEACDLVFDASSRGKQFLIVGTKNKAADSVARAAIRARCHYVNKKWLGGMLTNWSTTETRLHKFRDLRMEQTAGRLARLPKRDAAVVKRQLSHLQTYLGGIKYMTGLPDIVIIVDQQEEYTALRECITLGIPTICLIDTNCNPDLADISIPANDDAIASIRLILTKLVFAICEGRSSYIRNP

SEQ ID NO: 12127 - protein, 412 aa, Staphylococcus aureus
MSYITKQDKVIAEAIEREFQRQNSNIELIASENFVSEAVMEAQGSVLTNKYAEGYPGRRYYGGCEFVDVTESIAIDRAKALFGAEHVNVQPHSGSQANMAVYLVALEMGDTVLGMNLSHGGHLTHGAPVNFSGKFYNFVEYGVDKDTERINYDEVRKLALEHKPKLIVAGASAYSRTIDFKKFKEIADEVNAKLMVDMAHIAGLVAAGLHPNPVEYADFVTTTTHKTLRGPRGGMILCKEEYKKDIDKTIFPGIQGGPLEHVIAAKAVAFGEALENNFKTYQQQVVKNAKVLAEALINEGFRIVSGGTDNHLVAVDVKGSIGLTGKEAEETLDSVGITCNKNTIPFDQEKPFVTSGIRLGTPAATTRGFDEKAFEEVAKIISLALKNSKDEEKLQQAKERVAKLTAEYPLYQ

SEQ ID NO: 12128 - protein, 185 aa, Sandersonia aurantiaca
MSLLSDLVNLNLTDTTEKIIAEYIWIGGTGMDLRSKARTLPGPVSDPSKLPKWNYDGSSTGQAPGQDSEVILYPQAIFKDPFRRGNNILVMCDCYTPAGSPSHQQRHIAAKLFSHPDVVVEEPWYGIEQEYTLLQKDVKWPIGWPIGGYPGPQGPYYCAAGADKAFGRDVVDAHYKACLYAGINI

SEQ ID NO: 12129 - protein, 642 aa, Oryza sativa
MASGGGSSNWLGFSLSPHMPAMEVPSSSEPSTAAHHHHHHHPPAAAAAAGAMSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQVYLGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFDVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 12130 - protein, 163 aa, Zea mays
  misc_feature (14)..(14): Xaa can be any naturally occurring amino acid
  misc_feature (16)..(16): Xaa can be any naturally occurring amino acid
  misc_feature (21)..(21): Xaa can be any naturally occurring amino acid
  misc_feature (25)..(26): Xaa can be any naturally occurring amino acid
  misc_feature (34)..(34): Xaa can be any naturally occurring amino acid
  misc_feature (45)..(46): Xaa can be any naturally occurring amino acid
  misc_feature (48)..(49): Xaa can be any naturally occurring amino acid
  misc_feature (52)..(52): Xaa can be any naturally occurring amino acid
  misc_feature (57)..(57): Xaa can be any naturally occurring amino acid
  misc_feature (65)..(65): Xaa can be any naturally occurring amino acid
  misc_feature (78)..(78): Xaa can be any naturally occurring amino acid
  misc_feature (82)..(82): Xaa can be any naturally occurring amino acid
  misc_feature (84)..(84): Xaa can be any naturally occurring amino acid
  misc_feature (99)..(99): Xaa can be any naturally occurring amino acid
  misc_feature (102)..(102): Xaa can be any naturally occurring amino acid
  misc_feature (107)..(107): Xaa can be any naturally occurring amino acid
  misc_feature (111)..(111): Xaa can be any naturally occurring amino acid
  misc_feature (113)..(113): Xaa can be any naturally occurring amino acid
  misc_feature (118)..(118): Xaa can be any naturally occurring amino acid
  misc_feature (123)..(123): Xaa can be any naturally occurring amino acid
  misc_feature (128)..(128): Xaa can be any naturally occurring amino acid
  misc_feature (137)..(137): Xaa can be any naturally occurring amino acid
  misc_feature (152)..(152): Xaa can be any naturally occurring amino acid
RKGVDESPYCVHLXSXEKENXSSEXXEAPRIACXKYMTKSAGKDXXHXXVRXHPSHXLRINKMLXCAGADRPQTGMRXAFGXPXGTCARVDIGQVLLSXVRXKDNNXAAHXSXALRRXKFKFXGRQKXIESRHSGAXTRAKSEGRIVPDGVXAKLPGRAPGQT

SEQ ID NO: 12131 - protein, 577 aa, Alteromonadales bacterium
MDVALLQRRLERERLARKEAEKLLEAKSLQLYEANKVLKGAAENLEQEVANRTHDLELAKQDAEAANEAKSDFLANMSHEIRTPMNAIIGMAYLALDTELSEKQRDYVEKIHYSAESLLGIINDILDFSKVEAGKIELEQKEFNFNTFLENLVNIISTLASQRKIEVVFDIDPLLPDFFIGDALRLNQVLLNLLNNALKFSTRGKVILAVKLVQKVDSYCSVAFSISDNGIGMTQAQVDSLFKPFTQADVSTTRKFGGTGLGLVISKTLVELMQGDITVNSKLNKGSCFSFTIPLNYSTKQNEFEISQIRAKRALVIESSDSQLTSLQTLLLGFEVKFDTVNNINQVLDRLGMLHDYDFIFIDWRTLNLNHDSAAQSLRNKLKLNAKKLIVIAPCENKALNESLLGFGNNTYKVLIKPIIKSTLHNVLLQIMHIKTLKKTESQESLNTQNTLQKLQGIHILLVEDNPLNQQVATQILRKNGLIVDIANDGLEALDALKHKTYDGVLMDCQMPRMDGYTAATEIKKQAKFKNLPIIAMTANTRETDLLKAQDCGMNGYISKPIKVESMFEVIAKWVCI

SEQ ID NO: 12132 - protein, 717 aa, Bacillus halodurans
MKQIEEQAVKCLFHSAEIVTLHTVMIHFTVTKEQVCPFVVEKEGTTVPFSIKSWQEWERGAIAFIQFDDPLELGVEYKLRQKNHEQTHLIKVGRVVRTEAFDQQYVYNGELGALYSHERTVFAVWTPVATEVSLLLYENWHTLEAIEYQMKRSPNGVWSVSLDGDLHQYCYLYRAKVNGKWKTTVDPYAKSVTVNGEKGVIFDLKRTDPASWPTVHPIPPEHTIIYELHIRDATVYPGSGHHKKGTYLSLAEQNTCGPWGESTGLSYIRELGVTHLELLPVADYGSVDEANREKEYNWGYDVVHYFAPEGSYASDPYDGVTRVKELKQLIAQCQRMDLRVILDVVFNHVYVMKESPFEKLVPGYYFRYDGEGNLADGTGVGNDIASERLMVRKFIVDCVTYWASEYRVDGFRFDLMGIIDQMTMKEVKRALAPINRQILLLGEGWDLETPLENDQKTTLAQARAVPFLHFFHDTFRDAVKGSTFDLNKGGFCAGNIELKETLIASMLGHEAQFDRPSQAIQYVEAHDNHTLWDKLQFVFPDEEEEVLRACHRLATAIVLTSQGIPFLHGGQEFFRTKHGEGNSYNSPDWINQLDWSRRAIYAADVEYVKGLIALRKAHRAFCFSTFSEVNTHMCPLKTPSEVIGFHYHHIAKWGPWDEMVVLHNGGGDKVDIRLPASGEWEVIVDGKKAGLVPLYTFNGHTVSVQSRSSMVLYRLNE

SEQ ID NO: 12133 - protein, 184 aa, Idiomarina loihiensis
MSRHFDEAKGLSEQHDPATHDFVFNQTMFRIKDPERTLKFYSEVLGMTLVKRFDFPEMEFTLYFMAAMSPEQRKGWSTDHDKRIEQTFGRPAMLELTHNWGDENDDSVSYHSGNEEPKGFGHIGFAVPDIDAACERFEKMGVEFQKRPNDGKMKGIAFIKDSDGYWIEIFTPDRQPELLKEHLK

SEQ ID NO: 12134 - protein, 829 aa, Arabidopsis halleri
MRGAVPNIHHSYIFFFLFFVIVLFPDFSISANTLSATESLTISSNKTIVSPGGVFELGFFRILGDSWYLGIWYKKISQRTYVWVANRDNPLSNPIGILKISNANLVILDNSDISVWTTNLTGAVRSPVVAELLDNGNFVLRDSKINESDEFLWQSFDFPTDTLLPQMKLGRDHKRGLNRFLTSWKSSFDPSSGSFMFKLETRGLPEFFGFTTFLEVYRSGPWDGLRFSGIPEMQQWDDIIYNFTENRDEVAYTFRVTEHNFYSRLTINTVGRLEGFMWEPTQQEWNMFWFMPKDTCDLYGICGPYAYCDMSTSPACNCIKGFQPLSQQEWASGDVTGRCRRKTQLTCGEDRFFKLMNMKLPATTAAVVDKRIGLKECEKKCKTHCNCTAYANSDVRNGGSGCIIWIGEFRDIRNYAADGQDLYVRLAPAEFGERSNISGKIIGLIIGISLMLVLSFIMYCFWKKKQRRARATAAPIGYRDRIQESIITNGVVMSSGRRLLGEKEDLELPLTEFETVVMATDNFSDSNILGRGGFGIVYKGRLLDGQEIAVKRLSEMSSQGTNEFKNEVRLIARLQHINLVRLLSCCIYADEKILIYEYLENGSLDSHLFETTQSSNKLNWQTRFNIINGIARGLLYLHQDSRFKIIHRDMKASNVLLDKNMTPKISDFGMARIFERDETEANTRKVVGTYGYMSPEYAMEGIFSVKSDVFSFGVLVLEIVSGKRNRGFHNSGQDNNLLGYTWENWKEGKGLEIVDSIIVDSSSSMSLFRPHEVLRCIQIGLLCVQERAEDRPKMSSVVLMLGSEKGEIPQPKRPGYCVGRSSLDTDSSS

SEQ ID NO: 12135 - protein, 361 aa, Azospirillum brasilense
MTAGKRIGILTSGGDCAGLNAVIRAVVHRAVLTYGWQVLGIKEGTQGLLQRPVQYQVLDLPQVDGNMMRMGGTILGTTNRGDPFAYPMADGTQKDRSDEIIGGYRELGLDALIGIGGDGSFAILKKLADKGGFQMVGIPKTIDNDLGLTEVSVGYDTAVGVAVEALDRLQPTAASHARVMVLEVMGRDAGHIALAAGIAGGADVVLIPEIAYSIEKIAQKIKQVRSTGRNFALVVVSEAVKTVDGTGVQKLFQGGQKRYGGIGDYIGEKIAEATGAETRVTVLGHVQRGSMPSPRDRLVASAFGVHAVDLIAEGKFDRMVAWSDRGVIDVPITEAIAKYACVELDGAMVKTARGLGISLGD

SEQ ID NO: 12136 - protein, 252 aa, Arabidopsis thaliana
  misc_feature (206)..(206): Xaa can be any naturally occurring amino acid
  misc_feature (233)..(233): Xaa can be any naturally occurring amino acid
  misc_feature (242)..(242): Xaa can be any naturally occurring amino acid
MEDGIGGLRHMLETVFLSAFAGFMVVPVITDVTVAAVCSGPDDSCSLAVYLTGFQQVAIGMGTMIMMPVIGNLSDRYGIKTILTLPMCLSIVPPVILGYRRDIKFFYVFYISKILTSMVCEGTVDCLAYAYVAVNIHGSTRISAFGILAGIKTITGLFGTLVARFLPIALTFQVSAISFFVGLVYMRIFLKEKIKDDEDDDIHHGXTYNQEDHDSINTTMLAETIMNVRAIKXKVFKNKYSXLRDMISLMKN

SEQ ID NO: 12137 - protein, 294 aa, Saccharomyces cerevisiae
TTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 12138 - protein, 707 aa, Neisseria meningitidis
MMFDKHVKTFQYGNQTVTLETGEIARQAAAAVKVSMGDTVVLVAVTTNKEVKEGQDFFPLTVDYLERTYAAGKIPGGFFKREGKQSEKEILTSRLIDRPIRPLFPEGFYHDIQIVAMVVSVDPEIDSDIPAMLGASAALVLSGVPFAGPIGAARVGYVNGVYVLNPTKAELAKSQLDLVVAGTSKAVLMVESEAKILPEDVMLGAVVYGHDQMQVAINAINEFADEVNPELWDWKAPETNEELVAKVRGIAGETIKEAFKIRQKQARSAKLDEAWSAVKEALITEETDTLAANEIKGIFKHLEADVVRSQILDGQPRIDGRDTRTVRPLNIQTSVLPRTHGSALFTRGETQALAVATLGTSRDEQIIDALSGEYTDRFMLHYNFPPYSTGEVGRMGAPKRREIGHGRLAKRALLAVLPKPEDFSYTMRVVSEITESNGSSSMASVCGGCLSLLSAGVPLKAHVAGIAMGLILEGNKFAVLTDILGDEDHLGDMDFKVAGTTEGVTALQMDIKIQGITKEIMQIALAQAKEARLHILDQMKAAVAGPQELSAHAPRLFTMKINQDKIREVIGKGGETIRSITAETGTEINIAEDGTITIAATTQEAGDAAKKRIEQITAEVEVGKVYEGTVVKILDNNVGAIVSVMPGKDGLVHISQIAHERVRNVGDYLQVGQVVNVKALEVDDRGRVRLSIKALLDAPAREENAAE

SEQ ID NO: 12139 - protein, 305 aa, Gloeobacter violaceus
MRIAVLGGGAWGTTLADLAAAQDHQVRVWSRSGALALGEVLAQAEAVFSCLPMAAVAGVIDQVIALGLPAGVIVVNATKGLDRRTARPASSLWQARFADHPLVVLSGPNLAAEIRAGLPAATVVASADGQAAGRIQQCLASERFRVYTSADWRGVELGGVLKNVIAIAAGVSDGLGLGANAKAALITRGLAEMIRVGTHWGGLAETFYGLSGLGDLLTTCNSPLSRNYQVGFGLGKGQSLEAVLERLEGTAEGVATAAILAEYAQRSALEVPITDQICAVLGGLRPPTEALAALMTRRLREEDGG

SEQ ID NO: 12140 - protein, 451 aa, Lactobacillus sakei
MIILSQATDYVQHVYQVIEHRDPNQTEFLEAINDVFKTITPVLEQHPEYIEANILERLTEPERIIQFRVPWLDDAGHARVNRGFRVQFNSAIGPYKGGLRLHPSVNLSIVKFLGFEQIFKNALTGLPIGGGKGGSDFDPKGKSDNEIMRFCQSFMTELSKYIGLDTDVPAGDIGVGGREIGFLYGQYKRLRGADRGVLTGKGLNYGGSLARTEATGYGLAYYTNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIATYQAASLLYGPAKAANAGGVAVSALEMSQNSMRLSWTFEEVDNRLKQIMQDIFAHSVAAADEYHVSGDYLSGANIAGFTKIADAMLAQGLV

SEQ ID NO: 12141 - protein, 309 aa, Xanthomonas axonopodis
MAPSHWRLILNGKSTDNLDLREAVGTLRKRGIQLDVRVTWEDGDAERYVGEAVADGVHTVVAAGGDGTLSEVAAALAHHEGDAATLPSLGLVPLGTANDFATAATLPIAPLEALTLIAERVAQPVDLLRIDADHGPHWCANVASGGFGTQVTVETDEGLKKMLGGLAYLITGMSRLGRIDPISARFSGPEFSWEGEFIALGLGNGRQAGGGQALCPEALIDDGLLDVTIVPDLDGEVAATLGTLVTGGKQAALERVAVRARVPWLDIVSQQPLTLNLDGEPETSRHFRIECVPARLRMHLPGECPLLGG

SEQ ID NO: 12142 - protein, 447 aa, Zea mays
MREQQRAMDPCPFVRVLVGNLALRMPVAPPASGAGAGVHPSTSACYCKIRLGKMPVQSVPAPLVVTDGGEQTPASGALAAAFHLSKADLEWFDGKPSLFSSRRGAGEASLKVSVYAGRKGSACGVSSGRLLGKATVPLDLKGAEAKPAVLHSGWISIGKRAGKGSPAAAAELCLTVRAEPDPRFVFEFDGEPECSPQVLQVRGSMRQPMFTCKFGCRSNSDLRRPGMRRERDAASAKERKGWSVTVHDLKGSPVAMASMVTPFVPSPGTDRVSRSNPGAWLILRPAADGAWEAWARLECWRDRRGAGASDSLGYRFDLLVPGVDHAAVALADSSIPSSKGGKFAIDLTAAQPLSRGGTPGCSPRGSGDLSKWPLGNYRGFVMSAAVQGEGRCSKPTVEVGVAHVGCAEDAAAFVALAAAVDLSMDACRLFSHRLRKELSHPQADLLR

SEQ ID NO: 12143 - protein, 142 aa, Pinus strobus
EEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 12144 - protein, 142 aa, Picea glauca
EEVEDGSGGETDFQEVDHHAVEDRELKDHLLRRYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 12145 - protein, 63 aa, Oryza sativa
  misc_feature (14)..(14): Xaa can be any naturally occurring amino acid
YKFPGQQKIIVSKXWGFTSLRREEYMELKNAGKLQPDGAYVQFLKPHGNLVNNLKALDKVAAA

SEQ ID NO: 12146 - protein, 418 aa, Chromobacterium violaceum
MNVQSNPFLFESAALSHLPGFGAVRSTQLAGYLSVGDSAGGWLYFCFSEAGDHPEQAPLLVWINGAPEWSALDALLDEHGPYLLDPSGRIYSNPFGWHHHVNLLIIEQPLGHGLSFTTHPRYLPESHDEASLQLYHALQEFLLRWPRYRERDCYLFGNAAATHTIARLAHRVLDGNSGGQPQISLKGLGLGNAQLAPDIQLPSHIDYAYQHRLINLDERNHAQAGLDEFNRAHASPIALQQQSAGRIAVGIERYIQQCCGRDLHDIRHPPQKPSKALSEYLKKPSVQQALHIDPRSNNELQPHSSLMTEAIWQESSSHLLPMLLDQLKVLFFHGECCMTGNYLGLDAWFNTQSWSQADAFRRQKRQAWRPYGLAAGLIRSHGNLSQIIIQNAGLRVARDQPAAAQAMLRDFLAGDAPQ

SEQ ID NO: 12147 - protein, 348 aa, Glycine max
MAKYHLSGKSSSITSIAFLFILLLITNTGKAGAQSGVCYGRIGNNLPSPQEVVALFKQYDFRRMRIYDPSQEVLEALRGSNIELLLDIPNDNLQNLAFSQDNANKWLQDNIKNYANNVRFRYISVGNEVKPEHSFAQFLVPAMQNIQRAISNAGLGNQIKVSTAIETGALADSYPPSMGSFRSDYRTAYLDGVIRHLVNNNTPLLVNVYPYFAYINDPRNISLDYALFRSPSVVVQDGSLGYRNLFDAMVDAVYAALEKAGGGSVSIVVSESGWPSSGGTATSLDNARTYNTNLVRNVKQGTPKRPAGRPLETYVFAMFNENHKQPEYEKFWGVFLPNKQPKYSINLN

SEQ ID NO: 12148 - protein, 377 aa, Streptococcus mutans
MNNQEYYDRLGVSKDASQDEIKKAYRRMSKKYHPDINKEPGAEEKYKEIQEAYDTLGDEQKRAAYDQYGPAGANGGFGDGSGFSGFDSSGFGGFEDIFSSFFGGGASRNPNAPRQGDDLQYRVNLQFEEAVFGTEKEVHYNREASCHTCNGSGAKPGTSPVTCSKCHGSGVINMDTQTPLGMMRRQVTCDVCHGTGQEIKEPCPTCHGTGHEKQSHKVSVKIPAGVETGQQIRLAGQGEAGFNGGPYGDLFVIINVLKSDKFERDGSTIYYSMDINFVQAALGDTVEVPTVHGNVELAIPAGTQTGKTFRLKGKGAPRLRGNGQGDQHVTVNVVTPTKLNDAQKEALQDFAKASGINPVHPKKKGFFNKVKDAFDEM

SEQ ID NO: 12149 - protein, 304 aa, Ostreococcus tauri
MSNATSAVNSANLMPKASINTFADMAKFKISPARTALLDYIEGVGDSLARASVCSTTANRCNWAIDRVISFLCCIEDRLKLFPRTTPSTRFGDPNFRIWSQHLQICSKGLVGDITPPERQDLKLELEEYLQNSFGNPLRLDYGTGHELNFVAFLCCLEKTGIATTEQRSLVALNIFARYTSLIRIIQRHFRLEPAGSHGVWGLDDYCFIPFLWGAAQLQHETSTPRNILDANFPCGGLFFESCTHVKQTKSGPLTVVSPVLASLSTVRTWSKVFEGLLKMYCGECLDKFQIMQHFHFGVILQLE

SEQ ID NO: 12150 - protein, 145 aa, Oryza sativa
  misc_feature (18)..(18): Xaa can be any naturally occurring amino acid
  misc_feature (104)..(104): Xaa can be any naturally occurring amino acid
  misc_feature (141)..(141): Xaa can be any naturally occurring amino acid
PTRPRLAHHKDAGALTVXYQDAVGGLDVPPMRRRWVRVRPIPQSFIINIGDIIQVWSHDRYESVEHRVVVNVEKERFSIPFFFYPASYTMVEPLEEVVSEESPXRYNPYSWGEFFSARKNGNFKKLDVDYVQIMHFRKNTXVHVQ

SEQ ID NO: 12151 - protein, 589 aa, Glycine max
  misc_feature (234)..(234): Xaa can be any naturally occurring amino acid
MIMAALNSSTCAKPQFPHPLSSSFSSSSSLTRDLGFPTRFQKKPIRKVVDCALHSPPVIHFPNQPYNKPEITKEPTTSTAERPQWNPFQKAAAKALDMFESALLSRELNQPFPKTTDPRVQIAGNFAPVPEHPVEHSLPVIGTIPDAINGVYLRNGANPLFKPKAGHHLFDGDGMVHAVKFNDGTASYACRFTETQRLMQERKLGKPVFPKAIGELHGHSGIARLMLFYARGLXFGVDHRRGAGAANAGLVFFNGKLLAMSEDDFPYELRITASGDLETIGRYSFHGQLNSSMIAHPKVDPVSGELFTLSYDVTSKILKYFHFSPEDERKSPDIEIPLDAPTMTHDFAITENFVVIPDQQVVFKLGEMIKGGSPVIYDGEKKSRFGILPKYASDASSIVWVDSPDTFFFHFWNAWEERDKDEVVVIGSCMTPPDSIFNDREERLKSVLTEVRLNMRSGKARRRVLVEEMNLEAGMVNRKRLGRKTRFAYLCIAEPWPKVSGVAKVDLESGEVKRHEYGERRFGGEPFFLPTRGGNGNEDEGYVMAFVHDEMTWQSELQILNALDLKLEATVMLPSRVPYGFHGTFVEAH

SEQ ID NO: 12152 - protein, 366 aa, Bacillus cereus
MPKHRKQSKIKIYRITSYKKDKRSELDSDKFELEQQDKHDIQDKQDKQDEQNKQDKQVQSENVTIVPTDSHSLDVWDEISLKEIQAGEHTSLFEEKSNYQNINLVQVNDVRLYLDKQLQFSSVDEQIYHEALVHPIMAKVIDPKRVLILGGGDGLALREVLKYETVLHVDLVDLDEAMINMARNVPEIVSLNKNAFFDNRVNVHVCDAKEFLNSPSSLYDVIIIDFPDPATELLSTLYTSELFARIATFLTEDGAFVCQSNSPADAPLVYWSIGNTIEHAGLTVKSYHTIVPSFGTDWGFHLATNSAHVLDQIEQLYVVPTPRTLPALLFPLFQFKEEHLEQRNLALLNSESNLILHQCYKQEMKF

SEQ ID NO: 12153 - protein, 1030 aa, Unknown
  Photobacterium sp. SKA34
MNNWENFQHLHESRMAPRAYFFSYDSVKQATTFQRELSSRFMLLSGQWKFEYFSNPLLVPEEFYNQPMTQWKQITVPNMWQMEGHGELQYTDEGFPFPIDVPFVPSDNPTGAYKRTFTLSADWNNKQTIIKFDGVETYFELYVNGQYVGFSKGSRLTAEFDISAFVRQGNNLLSVRVMQWADSTYIEDQDMWWTAGIFRDVYLVGKEQLNVRDFTVRTDFDSAYQNGILSCVVELENLTASAQTGLVEYQLMDGTTLVAEGAVADIHVVDRIKVQFVIDVTAPVQWNAENPYLYQLLLTLKDSQGNVLEVIPQRVGFRDIKVRDGLFYINNKYVMLHGVNRHDNDHLKGRAVGMDRVEKDLVLMKQHNINSVRTAHYPNDPRFYELCDIYGLFVMAETDVETHGFANVGDLSRITDDAEWETVFVDRAVRHVHAQKNHPSIIMWSMGNESGYGCNIRAMYAATKAIDNTRLVHYEEDRDADVVDVISTMYSRAQLMNHFGEFPHAKPRIICEYAHAMGNGPGGLTEYQNVFYKHDHIQGHYVWEWCDHGILACDENGTEFYKYGGDYNDYPNNYNFCMDGLIYPDQTPGPGLKEYKQVIAPVKIREVDAKQGQFMVENKLWFSNIDDYTITAEVRAEGETLSVEQIKLTDLAENSEQMITLAWPELDEREVFVNFIVRKDSRTRYSLANHDIAVYQFELKANTAQLESFINQNAIELAIEETRLDYVVKGYNFALNFSKVNGKLTSWLVDGKELIQSAPKLNFFKPMIDNHKQEYEGLWHPAHLQIMQEHFRSLNVEMIDGQCEIIVTSIISPPVFDFGMRCHYRYQVNAQGQLNVELSGERYGDYPHVIPVIGLDLGINGEFDQVQYYGRGPEENYQDSRQSNMIDVYSTTVADMFENYPFPQNNGNRQHVRWAALADKHGTGVLVKPQQEINFSAWFYTNQNLHQAQHTHELEKSGYITLNLDHQVMGLGSNSWGSEVLDSFRVYMDSFRYGLTILPITAGDCRPQALANHNFDSAFFTTKAPKTNKA

SEQ ID NO: 12154 - protein, 400 aa, Candida glabrata
MSNSAAGRLNQTSHILNESIKNDDISLRRSQPSTTSLQALEHPFKVTVIGSGNWGTTIAKVVAENTALNPHLFVSRVDMWVFEEKIDGKNLTEIINEQHENVKYLPDIKLPENLVANPNLIDSVKGADILIFNIPHQFLPRIVSNLKNHVGPHVRAISCLKGFEVGKKGVQLLSSYVTDELGIQCGALSGANLAPEVAKEHWSETTVAYHIPKDFRGEGKDVDHKLLKALFHRPYFHVNVIEDVAGISIAGALKNVVALGCGFVEGLGWGNNAAAAIQRVGLGEIIKFGQMFFPESRVQTYYQESAGVADLITTCSGGRNVRVAKHMAKTGKSALDAEKELLNGQSAQGIITCKEVHEWLETCEMTHEFPLFEAVYQIVYNNVPMKNLPDMIEELECIAD

SEQ ID NO: 12155 - protein, 484 aa, Schizosaccharomyces pombe
MSLHDAYHWPSRTPSRKGSNIKLNKTLQDHLDELEEQFTIPTELLHRVTDRFVSELYKGLTTNPGDVPMVPTWIIGTPDGNEHGSYLALDLGGTNLRVCAVEVQGNGKFDITQSKYRLPQELKVGTREALFDYIADCIKKFVEEVHPGKSQNLEIGFTFSYPCVQRSINDASLVAWTKGFDIDGVEGESVGPLLSAALKRVGCNNVRLNAILSDTTGTLVASNYASPGTEIGVIFGTGCNACYIEKFSEIPKLHKYDFPEDMNMIINCEWCDFDNQHVVLPRTKYDVAIDEESPRPGLQTYEKMIAGCYLGDILRRILLDLYEQGALFNGQDVTKIRDPLAMDTSVLSAIEVDPFENLDETQTLFEETYGLKTTEEERQFIRRACELIGTRSARLSACGVCALVRKMNKPSMIVGTDGSVYNLYPRFKDRLAQAFKDILGEEIGSKVVTIPAEDGSGVGAALVSALEAKGKALTSDILAEHLKN

SEQ ID NO: 12156 - protein, 449 aa, Haemophilus influenzae
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMTELYRHVGADTDVPAGDIGVGGREVGYLAGYMKKLSNQSACVFTGRGLSFGGSLIRPEATGYGLVYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 12157 - protein, 168 aa, Lachancea kluyveri
LEQALYASKIISYAQGFMLIREAGKTYGWKLNNPAIALMWRGGCIIRSVFLAEITKAYRENPELENLLFNNFFTEAITKAQQGWRRTIGLAATWGIPTPAFSTALGFYDGYRSERLPANLLQAQRDYFGAHTFKVLPECADDHLPAGQDIHINWTGKGGNVSASTYQA

SEQ ID NO: 12158 - protein, 447 aa, Flavobacteria bacterium
MEKNIESFIDLIKSKNPNEPEFIQAVSEVAEAVIPFIENNPQYASDKLLERMAEPERVTMFRVPWTDDNGEVQVNRGYRIQMNSAIGPYKGGLRFHPSVNLSILKFLAFEQVFKNSLTTLPMGGGKGGADFNPKGKSDREVMRFCQSFMVELQRVIGADTDVPAGDIGVGGREIGYLFGYYKKLRNEFTGILTGKGRSYGGSLIRPEATGYGNVYFAENMLKTRGESITGKTTVISGSGNVAQYAAEKILQLGGKVVTMSDSGGYIHDADGIDADKLAFVMDLKNNRRGRISEYVSQYPSATYHEGERPWSVKCDIALPCATQNELNGDEAKTLVSNGCMCVSEGANMPSTPDAIEHFIDNKILFAPGKASNAGGVATSGLEMSQNSMRYSWTAEEVDNKLHGIMNDIHEACVEYGKDSDGFVDYVKGANIAGFVKVADAMLAQGIV

SEQ ID NO: 12159 - protein, 221 aa, Candida glabrata
MNSSEDYGYDYDYLFKIVLIGDSGVGKSNLLSRFTTNEFNLESKSTIGVEFATRTIKVEDKKIKAQIWDTAGQERYRAITSAYYRGAVGALIVYDISKSGTYENCNHWLTELKENADDNVAIGLIGNKSDLEHLRAVPTEEARGFASENQLFFTETSALNSENVDLAFRELIEQIYKMVNKHQVDLGENAKGSSGAPKGPTISLAPVPGEKKKKSKSNSCC

SEQ ID NO: 12160 - protein, 533 aa, Pseudomonas aeruginosa
MTTCGEFLVKQLEAWGVETVFGIPGVHTVELYRGLPGSRIRHVTPRHEQGAGFMADGYARVTGKPGVCFIITGPGMTNILTAMAQAYADSIPMLVISSVNERARLAHGNGYLHELPNQRNLVGNVCAFSHTLMSAEELPAVLARAFAVFDSERPRPVHIELPLDVITAPAEHLALRPRTVTSRPAPALAPLREAAARLRNAKKPLLLLGGGCVEAAAEARALAAALDAPTALTINAKGLLPADHPLLLGSNQSCVPVRELATEADVVLAIGTELGETDYDVVFDGGFALDGELIRIDIDPQQLMRNYTPSLAIHSDARLAMRVLLAELPGGEASPDSPGARRAAAVRQRLAEDFAGWSHYRQLFAAILAEWPDARFVGDSTQTVYSGNHLVDLDEPRRWFNASTGYGTLGYGLPAAIGAKLGEPGRPVVSLMGDGGLQFTLPELASAVEAKVGIVVLLWNNHGYGEIKRYMERREITPLGVDIYTPDFLAIARGFGCAAERARDLEHLRELLRGAPADRPLIVEVLQAAPFHP

SEQ ID NO: 12161 - protein, 270 aa, Pseudomonas aeruginosa
MAKVTVACCQIAPRIGAQEHNLRLAERAIREAARRGANVVVLPELAASGYVFADRGEALALAETRDGPSLGLWKALAGELDLVIVGGFCERLDPQRVANSAALVDADGVRAIYRKAHLWNEESGIFEAGEQPPPVVATRFGRIAVMVCYDLEFPEWVRLPALSGAQLLCAPVNWPAAPRPEGERPAEVVRVQANASVNRLFIAACDRCGQERGVDWVGGSVIVDADGYPLDGPLQGEAGMLLARLDLAEADEKRISAHNHVHRDRRPELY

SEQ ID NO: 12162 - protein, 169 aa, Medicago truncatula
MAASISAASSSVILHSLNSSSTRVGPSSSSSSQLQFPVRLLPIGTRRLSSSSRSRFLPLVQAKKQTFSSFDDLLANSDKPVFVDFYATWCGPCQFMVPVLEEVSARLQDQIQIVKIDTEKYPSIANKYNIEALPTFIIFKDGKPFDRFEGALTADKLIERIETTLNVKQ

SEQ ID NO: 12163 - protein, 583 aa, Ustilago maydis
MSAIKEALTSAAEALHISGDKDKKAIGGGAPVYVDEKAGNDETADGSKSSPFATPLAALLAKGQDASVFVKKADATPGQDGVDADGYAPISASAAKKVSKLYATALKKKEKASEQAAKDQAQAANDEKRLQESKKVVLEQPSSSAKKIKISQGADFRDQRVKICGWVHRLRSQKDLTFIVLRDGTGYLQVVLSGKLTTTYDALTLTTESTVEIQGQLKAVPEGKTAPGGHELVADYWKCLGKAPGGDEAYTNVVAETADPNSLADRRHLVIRGETASAVLKVRSEVLKAFRAEFDHLGMTEVTPPCMVQTQVEGGSTLFSFDYYGQPAYLTQSSQLYLETCLPSLGDVFCVQESFRAEKSHTRRHLSEYTHLEGELAFISFDDLLEHLEQLICGTLSRVLQDPKTKALLDQLNPNFKMPTRPFRRMDYKEAIKWLNDHNIPNEDGEPHKIGDDIAEAAERKMTDELNVPIFLCRFPREIKSFYMKRTEGDEEFTDSVDVLMPGVGEIVGGSMRMADQHELLEAYKNEGIDAAPYFWYTDQRKYGTCEHGGYGLGVERFLAWLTNRWTVREASLYPRWTGRCTP

SEQ ID NO: 12164 - protein, 404 aa, Vibrio parahaemolyticus
MQDALAVILAGGMGSRLSPLTDDRAKPAVPFGGKYRIIDFTLTNCLNSGLRKILVLTQYKSHSLQKHLRDGWSIFNPELGEYITAVPPQMRKGGAWYEGTADAIYHNLWLLSRNDAKYVVVLSGDHIYRMDYAAMLEEHKEKGAKLTVACMDVPVKDASAFGVMGIAENGLVKSFVEKPENPPTLPDDNAKSLASMGIYIFDMDVLKEALTEDAKLETSSHDFGNDIIPKLIDTESVYAYKFCGSKGRVDKDCYWRDVGTIDSFYEANMDLLEPVPPMNLYQSNWAIRTYEPQFPPARTVSSATGNEGIFINSIIATGVINSGGSVQHSIISSNVRIQDSATVVDSIIFDDVEVGEGSQLVNCIVDKHVRIPPNTQIGINKVEDAKRFKISEKGIVVIPESYQF

SEQ ID NO: 12165 - protein, 138 aa, Klebsiella pneumoniae
MLKEVTMSETLQVLNNIRTLRAQARELPLEVLEEVLEKFTVVVTERSEEEKAAEAANRERLEKLSQYREMMIADGIDPNELMDAAVNIKVRKKREPRPAKYAYIDEAGEQKTWTGQGRTPAPIKAQLDSGKTLEDFLI

SEQ ID NO: 12166 - protein, 310 aa, Neisseria meningitidis
MKIANSITELIGNTPLVKLNRLTEGLKAEVAVKLEFFNPGSSVKDRIAEAMIEGAEKAGKINKNTVIVEATSGNTGVGLAMVCAARGYKLAITMPESMSKERKMLLRAFGAELILTPAAEGMAGAIAKAKSLVDAHPDTYFMPRQFDNEANPEVHRKTTAEEIWRDTDGKVDVFVAGVGTGGTITGVGEVLKKYKPEVKVVAVEPEASPVLSGGEKGPHPIQGIGAGFIPTVLNTKIYDSITKVSNEAAFETARAIAEKEGILVGISSGAAVWSALQLAKQPENEGKLIVVLLPSYGERYLSTPLFADLA

SEQ ID NO: 12167 - protein, 312 aa, Bacillus halodurans
MKIVNNIAELIGDTPLVRLNRLPNPKGAAVYLKMEMFNPSGSVKDRAAYQMIVQAEKDGYLKPGSTIIEPTSGNTGIGLAMNAAARGYRAILTMPDTMSEERINLLKAYGAEVVLTEGEKKMPGAIEKAHELVREIPNSFMPMQFENSANPDAHRFTTAVEIKKALDSIGKKLSAFVAASGTGGTITGTGEELKKFYPNVEIHVVEPFGSPVLSGGKPGPHKLVGTSPGFVPPILNQDVYDVIDKIKDEDAYEAARNLARLEGILVGPSSGAACYAAMKVAERLAPDEVVVCIACDTGERYLSTDLFDFESQ

SEQ ID NO: 12168 - protein, 468 aa, Pseudomonas aeruginosa
MNDPQGFEAISRREQGLQRRLSAAQMSMIAIGGAIGTGLFMGSAFAIGFAGPSVLLSYAIGALITLLLMGCLAEMTVAHATPGSFGAFAEHYVGPLAGFLVRYAYWAAIVLAVGTEVTAVAMYMKYWFAGIPEWVWIISFSTLLIGLNASSVKAFGNFEYCFSTLKIAAIVAFILLGAYLVFGSANPAYGVHNYSAHGGFFPHGLKGMWIAVVVSIFSYLSVEMIAVAAAEAEHPEQAVRSAFRSTIVRLVVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 12169 - protein, 331 aa, Streptomyces coelicolor
MTTNPDGGRHARNDSALLTTPFDSHARAQEVIDGVDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 12170 - protein, 139 aa, Pinus strobus
EDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 12171 - protein, 131 aa, Picea glauca
DFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 12172 - protein, 765 aa, Xanthobacter autotrophicus
MTEQRESAGADRPASRHVDFLLVGGGLASAVAAQTLRAEGATGSIVILSAEDVPPYHHPPLSKHLLTGTEGEARIFVHPESFYGEHRIELALGARVVGVDTAKQTVTTARGEEIGYGQLLIATGAAPKPLTVPGASLPGVFSLRRKTDADAIRAAITQAKHAVVLGGSFLGMEIAMSLLDAGLKVTIIEQGPVLLRHLEAPDLSSYFERYAEGRGATVILNDTAAVLRGRERVQEVETAAGRHVACDLVVVSIGVAPATEFLAGSAIALEGGYVVVDALLRTSAPNVFAAGDVTTFYDPVFARRRHIEHWDNAVKQGRLAARNMMGRRLRYDEVSYFFCEVGDIGFNVLGATEEADARVARGALDQGSFALFYLKGDVPRALFSVGRPADETRVAEGLIRYRVGLGDVKERLHEDAFVLDRIPTQTALILQGGGALGAFECGVVKALEEEGIFPDIVAGVSIGALNGAVIAGNPRHAAQALEAFWADLAVTTPNVPFPELRRAAAATRILTLGVPNFFTPRWGLPPYGPADWAANWTSCYDTTPMKALLAKYVDFAALKDSPVRLLVSAVNVMTATLDVFDSYVDDLTPDHVLASGSLPPGFPWTMVDGKAYWDGGIISNSPLDLVIDRCGPDGKRVFVVDLFSGERALPTNMLEVLARRDEIVYAERVHSDLRHRETVEAYRRLIDHILARLEPEESGRIKRIPAYIQLMGDGAATTITRFVRAGQAGEHSSRDYDFSDLAIKANQAEGYAVARKTLGRASPQG

SEQ ID NO: 12173 - protein, 134 aa, Pinus strobus
EVEFHEVDPHAEDRELKDQLLRKYSGYLSSLKQEFLKKKKKGKLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 12174 - protein, 596 aa, Cryptococcus neoformans
MIPPLDDSSLVKAADKAWWKSATVYQVYPASFCDHADAGHGTLLGILTKVDYLQSLGVDIVWLSPIYESPQADMGYDISNYRQIDKRYGSLEDWDRLLAALHQRGMKLVMDLVVNHTSDQHPWFKESRSSRDNPKRDWYIWRPPRYNEKNERIPPNNWKGTFGQGSAWEFDETTNEYYLHLFLKEQPDLNWENPQVRAEVYDLMHWWLKRGADGFRMDVINFIAKAPGLPDAPVIDPGRTYQSFGMMSINRPEVHGWLKEMNRAVLSHYDCFAVGECPGDEAVVSYAPYSVPHNKELQMVFHFHHQSFDRAAGGLGRVHNPDWKLSELKRVFNTWQIEMAREGVLRITTSLGSSPGWHLTILRTGHGQELGMINVPRGWGLVEYKDVETIQNSEAEVQHRQVMCGHANPDISDLLESNRITARDNGRTPMQWDSSLNAGFSKGEPWMRIHDDYREGWNAAAQVNDPDSAWSFWKQMLRLRKKYDAMIYGKHKPSPFDSEGTINHPATQGDFIALDESNEETYAYIREHPPSGQKLLVVLNLSRGNDGRGAPSTFVLPSGLDTSGSKLLISNGEVQEGQRIEGNILLGPWEGRIYLL

SEQ ID NO: 12175 - protein, 955 aa, Arabidopsis thaliana
MAILAIRVVASQLLLFSFRFLTHINPISRNLMLRQSVSLLESLQSCWKEDVLVFSAAGKFLRLTLQLRSSDIQAKEDAAPVDRQSSSSVVVPDEPSPLRKMISVASIAAGIQFGWALQLSLLTPYVQLLGVPHKWSSFIWLCGPISGLLVQPTVGYFSDRCKSRFGRRRPFIATGALLVALAVILIGFAADFGHTMGDKLDEAVKIRAVGFFVVGFWILDVANNTLQGPCRAFLGDLAAGDAKKTRTANAIFSFFMAVGNVLGYAAGSYTNLHKIFPFTVTKACDIYCANLKSCFIISITLLIVLTIIALWYVEDKQWSPNADSDNEKTPFFGEIFGAFKVMKRPMWMLLAVTALNWIAWFPFLLYDTDWMGREVYGGDSAGDDKMKKLYNHGIQVGSLGLMLNSIVLGVMSLVIGVISKKIGAKRLWGAVNIILAVCLAMTVLVTKKAEEHRKIAGRMALPTNAIRDGALSLFAILGIPLAITFSIPFALASIISSSSGAGQGLSLGVLNMAIVIPQMIVSFGVGPIDALFGGGNLPGFVVGAIAALISSVVALTPRELAVTGLSENLQGCVFRTVKRAVLIGNGCAGAENQCIGLLRSLGLFDRHLYYRVAKPRGGILQWLPISLYKRIHRFISTICAGLSINATGITNVFEVDDAKQIAAMARKTFEKNGPLLVVASGSDTISVASSIRRLAMENVFVVQVQHPRSHLERFDLVITPQHDYFSLTPEGKRQIPFFLRPWVTPREHPGRNVFLTTGALHYADASTLRNATSEWKNEFASLPKPLVVVNIGGPTRNCLYGVDLAKQLCGMLQSILWSCGSLRISFSRRTPKKVVEVITGELSSNSKVYIWDGKDPNPHLGHLALANTFIITADSISMLSEACSTGKPVYVVGAERCTWKFSDFQKTLHGRGAVRPLTGKEDMCEKWSYSPLNDNVEAARRVIQDLAKRGWEIEA

SEQ ID NO: 12176 - protein, 485 aa, Flavobacteria bacterium
MSSTSVYSLKFGLMSKRRKRANKTFENVPVVDAGAKGKSVAKTEDGAVIFLKNAVPGDVVDIQTFKKRKSYFEGEATVFHTLSDRRTEPVCKHFGTCGGCKWQHMSYESQLFFKQKEVVENLTRIGHLELPEVTPIAGSEEQYYYRNKMEFSFSASRWLTLEEIQSEVQIEDKKALGFHIPGMWDKILHLDECHLHPAIGEQIRLSVHAFAEAEQIEYFNPREKTGVLRTLMLRMSSTGEIMVVIQFFKEDEKARISLLEHLKNSFPQIKSLQYIINEKANDTIYDQEVICYDGRDHIFEEMEGLQFKINAKSFYQTNSKQAFELYKITRDFAGLTGEELVYDLYTGTGTIAQFVAKKANHVVGIESVPVAIEDAKANAAHNGIDNTTFFAGDMRDVFTADFIAEHGAPDVVITDPPRDGMHKDVVAQLLALAAPRIVYVSCNSATQARDLALLNEQYKVVKYQPVDMFPQTHHVESVVLLEIIK

SEQ ID NO: 12177 - protein, 926 aa, Spinacia oleracea
MAASVDRQYHPAPMSGVVRTPFSNHHRSDSPVRNGYTFSNPPSSNGVVKPGEKIKLVDNNSNSNNGSNNNNNRYDSDSEEDDDENEMNVWNEMIKKGNSELEPSSVDSRDEGTADQWIERNPSMIRLTGKHPFNSEPPLTRLMHHGFLTPVPLHYVRNHGPVPNAKWEDWTVEVTGLVKRPIRFTMDQLVNDFQSREFPVTLVCAGNRRKEQNMTKQSIGFNWGSAAVSTSVWRGVPLRDVLKRCGVMSSLKGALNVCFEGAEDLPGGGGSKYGTSVKREFAMDPARDIILAYMQNGEKLSPAHGYPVRMIIPGFIGGRMVKWLKRIIVTTTESDNYYHYKDNRVLPSHVDAELANSEAWWYKQEYIINELNVNSVITSPCHEEILPINAWTTQRPYTMRGYAYSGGGRKVTRVEVTMDGGDTWDICELDHQERGSKYGKFWCWCFWSLEVEVLDLLGAKEIGVRAWDESLNTQPEKLIWNVMGMMNNCWFRVKTNVCKPHKGEIGIVFEHPTQPGNKSGGWMARERHLEISDSGPTLKRTASTPFMNTTSKMYSMSEVKKHNTADSAWIVVHGNVYNATRFLKDHPGGSDSILINAGTDCTEEFDAIHSDKAKRLLEDFRIGELISTGYTSDSSSPGNSVHGGSVYSGLAGLAPITEAVPLRNVALNPRVKIPCKLIEKVSLSHDVRRFRFGLPSEDQVLGLPVGKHIFLCANVDDKLCMRAYTPSSTIDVVGYFDLVVKVYFKDVHPRFPNGGVMSQHLDSLSLGSIVDVKGPLGHIEYLGKGNFTVHGKPKFAKKLAMISGGTGITPIYQVMQAILKDPEDKTEMHVVYANRTEEDILLREELDKWADEFRDRVKVWYVVEKAEEGWKYDTGFISEKILRDHVPAVGDDVLALTCGPPPMIQFAVQPNLDKMGFDIKEQLLIF

SEQ ID NO: 12178 - protein, 488 aa, Neisseria gonorrhoeae
MMKLGFKPIPLAIAAVLCALVLALPVPDGVKPQAWTLLAMFVGVIAAIIGKVMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLSEMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFLAAAVSLNAPAMPTALMMAAASNIMMTLTHYATGTSPVIFGSGYTTMGEWWKAGFIMSVVNFLIFSVIGSIWWKVLGYW

SEQ ID NO: 12179 - protein, 826 aa, Bacteroides fragilis
MKIIIIGGVAGGATTAARIRRSDETAEIILLEKGKYISYANCGLPYYIGDVIEEREKLFVQTPEAFGVRFRVDVRTENEVIFIDRKKKTVTVRLKSEDTYEESYDKLLISTGASPVRPPLPGIDSTGIFTLRNVADTDRIKAYVNNRPPRRAVVIGAGFIGLEMAENLHALGAQVSIVEMGNQVMAPIDFSMAALVHQHLMEKGVNLYLEQAVASFEQAGKEVKVVFKNGQSILADIVILSIGVRPETTLARAAELTIGEAGGIAVNDYLQTSDESIYAIGDAIEFRHPITGKPWLNYLAGPANRQGRIVADNLLGAQIPYEGAIGTSIAKVFDMTVASTGLPGKRLKQAGIVYASSTTHPASHAGYYPDAMPMSIKITFDPQTGKLYGGQIVGYDGVDKRIDELSLVIKHEGTIYDLMKVEQAYAPPFSSAKDPVAIAGYVAENIILGRVKPVYWRDLRDIELKDVFLLDVRTPDEFALGSLPGAVNIPLDEIRDRIAELPSNKPIYTFCAVGLRGYLAYRILIQHGFKEVYNLSGGLKTYRAATAPIILHENEETDDTPSAQDSPAKPSVGAEAPQTTTAANPKTIRVDACGLQCPGPVLKMKKTMDTLVPGERVEIVATDPGFSRDAAAWCNSTGNKFISKDSTGGKSVVVIEKGEPQACNLTTTCDSKGKTLIMFSDDLDKALATFVLANGAAATGQKVTIFFTFWGLNVIKKLHKPKVEKDIFGKMFGTMLPSSSLKLKLSKMSMGGMGGKMMRYIMHRKGIDSLESLRQQALENGVEFIACQMSMDVMGVKREELLDEVTVGGVATYMERADNANINLFI

SEQ ID NO: 12180 - protein, 349 aa, Oryza sativa
MDMASIECVSYSDSMDDDDDDGVGVGGVSHLPRPILVKPSSAAAAVNVVVVSAGSGGGAGGGGGGVGVVAGAPAVPPATSVHELLECPVCTNSMYPPIHQCQNGHTLCSTCKTRVHNRCPTCRQELGDIRCLALEKVAESLELPCKYYSLGCPEIFPYYSKLKHESQCNFRPYNCPYAGSECSVVGDIPFLVAHLRDDHKVDMHSGCTFNHRYVKSNPREVENATWMLTVFHCFGQYFCLHFEAFQLGVAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 12181 - protein, 605 aa, Agrobacterium tumefaciens
MEEMNMLDVSPATKIDTVLSKLGNALEAGDIDAAVNLFQADCYWRDLVTFTWNLKTLEGREQIHDMLASQLAAIKPSGFVQDAKEQASEGGGVTEGWFEFETGAARGYGHIRLKDGLIWTLLTTMSELKGHEEPKGIRRPMGAEHGHDRSRRTWKEKREAEAAELGYAEQPYVVIIGGGQGGIALGARLRQLGVPTIIIEKNERPGDSWRKRYKSLCLHDPVWYDHLPYIPFPENWPVFTPKDKVGDWLEMYTRVMELNYWGSTTCKSAQYDETTGEWTVVVDRAGKEVVLRPKQLVLATGMSGKANVPKFPGQDVFKGEQQHSSQHPGPDAYAGKKVVVIGSNNSAHDICAALWEAGADVTMLQRSSTHIVKSDSLMEIGLGDLYSERAVANGMTTRKADLIFASLPYRIMHEFQVPIYDRIREQDAEFYAALEKAGFMLDFGDDESGLFMKYLRRGSGYYIDVGACDLVIDGSIKLKSGVDVSHLTENAVVLKDGTELPADLVVYATGYGSMNGWAADLISRDVADKVGKCWGLGSDTTKDPGPWEGEQRNMWKPTRQDALWFHGGNLHQSRHYSQYLSLQLKARQAGLKTPVYGLQKPHHLS

SEQ ID NO: 12182 - protein, 90 aa, Streptococcus pneumoniae
MLSLCLEASNRNLWRCFCVAKDDVIEVEGKVVDTMPNAMFTVELENGHQILATVSGKIRKNYIRILAGDRVTVEMSPYDLTRGRITYRFK

SEQ ID NO: 12183 - protein, 1329 aa, Yarrowia lipolytica
MASTPFTVKALFEYTSDHPDDLVFQPGQVITVTAVEDEEWYSGKYSDNGVEKVGLFPQNFVEAYTPPAPARPAGRPKRESVILEPKRESVIDPDEFHDSKEDVEPVKPAEHSIGVSNTPAAASAAAEPASESVRQATNAIPPRNANNDDDDDDDDDDWDTPRGMPARAATMDSHEPKPLSKTSTFDHHQPSKETPKESQPNADIEQKELPKGKSKTAFLDEANKAAAEPVASGAPTPKPKSNAFRDRIAAFNNQAAEAPKPAAPAPKPRKFEIGQTSSYVPPLPSNQVHPSVEAARYNARSEERKTADAAADQPQAHSPPQQQKETYGDSSSDEEAKEEEPEAVAEAEAPGVSLRDRIRLLQEQQAAEAARAEAAAAAKKERKARKEQQTKESPSVQPQTTGGTLERVATGESMRSLEKPLSRRQSMDRRDSLDRRDSVGGEVGRPLSMLSHEADVDEGVEEDDDEDAATERTRAHPGGVPAGAAPAMMGAPAPAMMGAPAPGGHAAGEEDDDDDDDDSDSDDEEARRIALRERMAKLSGGGHLGMGMMGGPPGGAFAFPGQAFPQKKEKKEKKKKEVHPDEGDEAAPVASAPTVPAETAEPAHVPTSAPLAPPHATSRAAPPAPPTEQQHTSAPVPPVATLVPSPGAPPAPIEVNSDSDEKDSDDEDDETEVESRSTLPTSAPVGGSPAVPSVPQQGGPVPVTAVPPASHGGEPPVPVSSVPCSPPPQDHVKEREPKDAFRMSSLGKSLPHTGDETGMGDDEHTESDASSIYPQHPRRQDSTKRGPSALGGAPVLPLPALQKPISLDGVVSGQYSSDEVGGYDADEDTDLNANLSEEEEARGVHHGTIPPPIPPAERAPPPIPQSPVTSAPPPIPTSPPASRAPPPIPQSPERGAPPPPPPATERSAPPPPPERAAAPPPPPPVPGSPQVPPPSMPHQHAPAVPGAPAPPVPHAVPPPPPPHAPDAHHAPQPPSRAPPPPVPNASPPMPRHAPPPQAAPVPPALQHVPPPPQHAPAPPAPSGAPAPPVPTGVPVPPPHGTPPGAPAGAPPGLSRTSTSRRSRTSVDLHSGYLARDLDLGENSQWWLEPNGIPPALLQRVRAGEAIYEMEDNETHKRGGRTQLSRDIYVVYADYSQTTISAQWTTEGGATFEQSSTPPPSPWPQPKLEEAHKLNGRKMVDLAHRQFGQLVADGSLAPQCVASIKDAMPSIGGRAFGALVYANMGNATTQQYDEIRAGDVVVFRNASFSSKGGLGKKSSVVEVGVAVPHSGVVYEWDGTKRKLRVFEQHEKDLGTGSAKVKQESYRLADLKSGEVKVYRVVGREYVGWDN

SEQ ID NO: 12184 - protein, 474 aa, Lachancea kluyveri
AGPVGALIAYMFIGTLAYMVSQSLGEMATFIPVTSSFMVFTQRFLSPALGAANGYMYFLSWSITFALELSVVGQVIQFWTDAVPLTAWIIILWVVLVSANLAPVKFYGEVEFWIACIKVLAIVGFIIYAFIMVCGAGKTGPVGFRYWRNPGPWGPGIISKDVNEGRFLGWVSSLISAAFTYQGTELVGITAGEAANPRKTVPRAINKVFFRILFFYILSLLFIGLLVPFNDPKLKSEDSYISSSPFVIAIENSGTKVLPHIFNAVILSTIISAGNSDVYISSRVLYSMGLNGLAPKYLTWTTKSGIPYAAVLTTSLVGFLAYLESSHGASVVFDWLLNITAVAGFFAWMLISVAHIRFMQALKHQGISRDDLPFKAKFMPWGAYYAAFFIGVIIIIQGFTAFAPKFNVSDFFTAYVSVILFFAVWIGFQIWFRGPLFKKTEDIDLDTDRREIDNDVWEEDEPKNLWEKFWSAVA

SEQ ID NO: 12185 - protein, 1037 aa, Flaveria pringlei
MERARRLANKAILGRLVSQTKHNPSISSPALCSPSRYVSSLSPYVCSGTNVRSDRNLNGFGSQVRTISVEALKPSDTFPRRHNSATPEEQTKMAEFVGFPNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMVTDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMFGVYHGPEGLKTIAKRVHGLAGTFAAGLKKLGTVQVQDLPFFDTVKVTCVDSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVATGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDLNNNVIKGAPHPPQLLMADKWTKPYSREYAAYPAPWLRAAKFWPTTCRVDNVYGDRNLICTLQPPQEYEEKAEATA

SEQ ID NO: 12186 - protein, 717 aa, Trichodesmium erythraeum
MEEIDKSISFDGRDIRLKVGLFAPQAGGAVMIESGDTAVLVTATTAKGREGIDFLPLLVDYEERLYAGGKIPGGFLRREGRPPEKVTLTSRLIDRPLRPLFPSWLRDDIQIVATTLSMDEEVPPDVLAVTGSSVAVLLAKLPFYGPMAAVRVGLVGDDFIINPTYREVKNGDLDLVVAGSPQGVIMVEAGANQLPEQDIIEAIDFGYEAVCDLIQAQREIIAEMGIELVELEPPEVDPTLENYIKEKATEQIKEILSQYDLDKNQRDEKLDEIKDSLAESITELPEEEAVRAMVESESMLLGNAFKSVTKKLMRQQIVAEGIRVDGRKLDEVRPVSCRVGVLPSRVHGSSLFNRGLTQVMSAVTLGTPGDAQELADDLHPQDEKRYLHHYNFPPFSVGETKPLRQPGRREIGHGALAERALIPVIPKSDIFPYVIRVVSEVLSSNGSTSMGSVCASTLGLMDAGVPIVKPVSGAAMGLIKEDEEVRILTDIQGIEDFLGDMDFKVAGTDSGITALQMDMKITGLPIEVIADAIHQAKPARIHILDKMLSVLDLPRPDMSPYAPRLLSFKIDPEMIGLVIGPGGKTIKGITEETGVKIDIDDDGTVTIAAADGEKAKQACNIIQGMTKKLNPGDVYVGRVTRIIPIGAFVEVFAGKEGMVHISQIADYRVGKVEDELAIGDEVIVKVREIDSKGRVNLTRLNIHPDEAAAARANAMNY

SEQ ID NO: 12187 - protein, 1034 aa, Flaveria pringlei
MERARRLAILGRLVSQTKHNPSISSPALCSPSRYVSSLSPYVCSGTNVRSDRNLNGFGSQVRTISVEALKPSDTFPRRHNSATPEEQTKMAEFVGFPNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMFGVYHGPEGLKTIAKRVHGLAGTFASGLKKLGTVQVQDLPFFDTVKVTCADSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDFNNNVIKGAPHPPQLLMADKWTKPYSREYAAYPAPWLRAAKFWPTTCRVDNVYGDRNLICTLQPPQEYEEKAEATA

SEQ ID NO: 12188 - protein, 444 aa, Unknown
  marine gamma proteobacterium HTCC2080
MPVGVSDQEGWLRPAPESFLSEELISEISHRGVDKGRRDLLRGSFAAALAGASGLAFADDPNIVNVPEWSRSLGKPVATNPYGQPSPFEANTVRRQSPGLTQTDQASVAFTPLQNLFGCITPSGLHFERHHQGWVDIDPRRHRLMINGLVKEPLVFTVADLLRMPSVSRMHFLECGANTALEWGNSAVPTVQYTHGMLSGSEWTGVPLSLLLERAGYDRDASYLLAEGADGSGMTRTINLAGALEDAIVAYGQNGEMLRPEQGYPLRLVVPGVQGVSWVKWLRRLEVGNKPYATKDEASHYVDLMPNGQLRQYTAIQEAKSVITAPSGGQKLLSQGYYCITGLAWSGRGSVRKVEVSVDGGRNWQGARLEGQVPSKMLTRFNFDWVWRGEPALLQSRVSDDTGYIQPQRAALVAERGTRSIYHNNAIQTWRVSPSGEVDNVQVG

SEQ ID NO: 12189 - protein, 610 aa, Pseudomonas aeruginosa
MCGITGWTDWSRDLGEQRSILERMTRTLAPRGPDAEGLWLSRHALLGHRRLAIIDLENGAQPMLAEAGGRVALTYSGEVYNFRELRAELETLGQVFRTRSDTEVVLRAYLQWGEASFVRLRGIYGFALWDEREQSLWLVRDRFGVKPLYYYPTAGGVLFASEPKAIFANPEANPVLDASGIAELFALTTAPTPGHGLYKGLRQVRPGQALRFDRNGVRELVYWALRAERHEEGAEDSAERAGQLLREAVAEQLVADVPLGSLLSGGLDSSAISAFAVAALDGDARRLPTFSVDFPGEGRGFVPTPWQSSWDEPYAQLAANFLGTPHRTVLVAPEEVLEQDEAVLQARDLPGWGELDASLYLLFRQVREHTTVALSGESADEVFGGYPFFHDPSALAHDGFPWLAGKSGPWQLLRREVAERVAAPEYIRARYREALAEVPRLDGEDAAQRRQREVAYLALSRWLPAMLERKDRMSMAVGLEVRVPFCDHRLVEYVWNLPWALKSVAGESKSLLRRALRGHLPQAILERRKSGFPANPDPRYLALLRERVGRLLDDGRSPLFELVDAGRVRQALEQGTPLPSPRASASPTAGLAYLLNLDRWLTRHGVDISL

SEQ ID NO: 12190 - protein, 534 aa, Oryza sativa
MGNSCQNGTYGNNYQNSNRFQNDRFASRYVDGNDTEDCYSGSSRASLAGALRQGLNLKSPVLGYKTPNVRELYTLGRELGQGQFGKTYLCTEISTGCQYACKTILKSNLRCVSDIEDVRREIQIMHHLSGQKNIVTIKDTYEDEQAVHIVMELCAGGELFSKIQKRGHYSERKAAELIKIIVGIIETCHSHGVMHRDLKPENFLLLDADDEFSVKAIDFGLSVFFRPGQVFREVVGSPYYIAPEVLEKRYGPEADIWTAGVILYVLLTGVPPFWADTQSGIYEKVLDGRIDFKSNRWPRISDSAKDLIKKMLCPYPLERLKAHEVLKHPWICDNGVATNRALDPSVLPRLKQFSAMNRLKKLSLQIIAERLSEEEIVGLREMFKAMDTKNRSVVTFGELKGLKRYSSVFKDTEINDLMEAADDTTSTINWEEFIAAAVSLNKIEREKHLMAAFTYFDKDGSGFITVDKLQKACMERNMEDTFLEEMILEVDQNNDGQIDYAEFVTMMQSNNFGLGWQTVESSLNVALREAPQVY

SEQ ID NO: 12191 - protein, 264 aa, Gossypium hirsutum
MASTTMALSSPSFAGKAVKFSPSTPEIQGTGRVSMRKTTKPVPSGSPWYGPDRVLYLGPLSGEPPSYLTGEFPGDYGWDTAGLSADPETFARNRELEVIHCRWAMLGALGCVFPELLARNGVKFGEAVWFKAGSQIFSEGGLDYLGNPSLIHAQSILAIWACQVILMGAVEGYRIAGGPLGEVTDPLYPGGSFDPLGFADDPEAFAELKVKEIKNGRLAMFSMFGFFVQAIVTGKGPLENLADHLADPVNNNAWAYATNFVPGK

SEQ ID NO: 12192 - protein, 403 aa, Blastopirellula marina
MASKAKRIGILTSGGDCPGLNAVIRGAVKTANRLGFDTIGFLKGYEGLVDPVQYVPLNDENTRGILGRGGTILGSTNKGRFAATVGINDRVELCPQLMKKVKGTFDQLSLSGLICIGGDGSLAVAQQFHEYGLPVVGVPKTIDNDLSATAFTFGFDSAVECGTEALDRLQTTAASHERIMVMEVMGRHAGWIALHSGIGGGADVILIPEIQWNFDIVCEKILERYKAGKKFTLIVVAEGAHLPDKGMVTQESEKSDRQTRLGGIGQIIAAEIERRLHFEARTVVLGHLQRGGAPTTFDRVLATQFGAHAVRTIVERRFGHMVCYSPPNIESVPILEAVHQLRTVHPDSSAVQAAQAMGISFGNCALHETPFQRYVTQHEHELATDDTTALLESALQSLVGAEA

SEQ ID NO: 12193 - protein, 642 aa, Mycobacterium avium
MPVTTESARAAGPDPYDVGELRANLRQADPGVLVAVLAQLTGDPAVADRFAPKITHVPDPPEQAGVTDPETAAQLVDEIVTALRTPRRADAVPADDLDLFARVAPVALGGEVGPEYLGLLLEQGGFQPSQPVLPRTAKLPAGFRVVIIGAGIAGITAALACADAGIEYQIIERNDEVGGTWYTTRYPGIGVDTPSAYYSLSRDINGDWSSYYPQGAEYQAYLVSVADKNDLRKHTRFGTEVEALWWQERRRQWQIHSVGPDGTRDVSYANVVIPAAGYLNRPRWPELAGRETFSGISIHSAHWDLELDLTGKRVAIIGAGCTAVQIVDACVDQVAHLTVFQRQPHWVAPRRRASDDVPAYQRWLGTRLPYYANWIRLKSYWGTADTNYPVILHDPQWAAEHLSVSPANDVLLRMCLDYIDRVFGAGSELARKVTPDFAPYGKRIIRDPGGYYAALAREHVDVEASEPARVNQAGIVTADGRQIDLDVIIYATGYYLDFLSTVDIRGRDGKKLTDEWGDAPRAYRGGMVPGFPNMFISSAPNYSPGHGAGHNFGVEVMVHYVMECLQLMALRRATTVEVTQRAYEEYVADIDALMAGTVWCHTPSAHTYYRSGGGRIVTAFPYRLVDFWRDHRAPSEEDLELR

SEQ ID NO: 12194 - protein, 152 aa, Coccidioides immitis
MDHSRDPCPWVALSDFGGAFCMGAIGGAVWHGVKGFRNSPYGERRIGAITAIKARAPVLGGNFGVWGGLFSTFDCAVKGIRKKEDPYNAIIAGFFTGGALAIRGGYKAARNSAIMCGVFLAVIEGVGIGFQRMMADNTRLDLPPPPTDKAVA

SEQ ID NO: 12195 - protein, 482 aa, Gloeobacter violaceus
MTAAQDSRSPYASADWAGGYRTLEAEQAYVIDAIEGTIPAELTGTLFRNGPGRFERGGVSYKHPFDGDGMISAVRFAGGRAHFQNRFVRTEGFIQESAAGRILSKNVFGTLRPGGFWANAFDFGFKNVANTGVVYHGGRLLALWEAAPPHRLDPASLETFGLDDLAGALCGGKPFAAHPRLDPATGDLISFGVRTGLQTVLYIYRLSPDGGVRVESEHTVPGFAFVHDFALTENYWVFFQNPMALDPLPFVLGFKAAGECLRLAPGEPTRILLIPRNGGPVQTIATEPFFVFHHVNAFEREGRIVVDSIRYEEYITTQEDRDFRQTDFSRLPEGWIWRTQIDPVKGRVEARPLLRRSAEFPQVHPDRVGRPYRFAFAAAVHAEGGNAPLQAIAKLDVETGRAEFHSFAPSGFVSEPIFVPRPDGTAEDDGWLLAMVYDARRDRSDLWILDGRDLTCLTRLGLKHHVPYSLHGTFVPEVFVHF

SEQ ID NO: 12196 - protein, 296 aa, Chromobacterium violaceum
MYKHLEDFVGGTPLVRLKRLPGDNGNVVLLKLEGNNPAGSVKDRPALSMIRRAEARGDIRPGDTLIEPTSGNTGIALAMAAAMMGYRMVLIMPENSSAERVQAMRAYGAEVILTPAAGSMPAAIDLARSMEAAGEGRILDQFSNPDNPQAHYEGTGPEIWAETEGRITHFVSSMGTTGTIMGTGRFLKEKNPAIRIVGVHPEPGSQIAGIRKWEDPYVPKICDFSRIDEILHVGQKEAEDTARLLARREGILAGPSSGGALAVALRLDAQLRDAVIVSVVCDRGDRYLSTGLFDPA

SEQ ID NO: 12197 - protein, 190 aa, Magnaporthe grisea
MGKSQSKLSQEQLAELQKSTHFDKKELQQWYKGFLKDCPSGTLTKEEFQKIYRQFFPFGDPSSFADYVFNVFDSDKSGTIDFKEFIVALSVTSRGKMEDKLDWAFQLYDIDGDGKISYDEMLQIVEAIYKMVGSMVKLPEDEDTPEKRVRKIFRMMDKDENGSLDMQEFKEGSKRGETIVSALSLYDGLV

SEQ ID NO: 12198 - protein, 227 aa, Zea mays
  misc_feature (95)..(95): Xaa can be any naturally occurring amino acid
  misc_feature (190)..(190): Xaa can be any naturally occurring amino acid
MASDEVKVIGAWASPFVMRPRIALNLKSVPYEFLQETFGAKSELLLKSNPVHKKIPVLIHADKPVCESNIIVEYVDETWSASGPSMLPSTPYDRXIARFWAAYIDEKWFPSLKSILKAEGEEEKKAVLAQVEEGNALLEKAFNDCSKGKAFFNGEHIGYLDIAFGCFLAWLRVTELAGGHKLIDEVKTPXLSNGLTGLCNDPAVKPVMPETATLAEFAKKIFAKPPA

SEQ ID NO: 12199 - protein, 190 aa, Thermoplasma acidophilum
MVSCGGDGTLNEVVNGIVNTDLAIAVLPMGTGSDFGKTIGIRNISDFLKAIKSGRTREVDLVAAQFANQSRRYFINILEIGFGAEVMNYVNSHKYLGRGSFKFGAFYMLSKMHPFNLRLIMDGKEYEFPTIEAIFANGRYFGGGMLASPYSEIDDGLLDVHVLKPFSRIRSAMNFRTIYDGSYLNRRICA

SEQ ID NO: 12200 - protein, 311 aa, Ostreococcus tauri
MYSERFPDIDQVVMVQVQNPAQVKSIAEMGAYVQLLEYDNIEGMILLSELTRRRIRSVSKLIKVGRIEPVMVLRVDDEKGYIDLSKRRVSPEDIEACEIKYNKSKVVHSIIRHVSETTGTLPEQLYKSFGWPFYSKYGHAFDAFKMFVTDPSLLHKEFAERRISATTEQDEEALSEAVAFALTKDIQRRMTPQPLKIRADVELTCFEYNGVLSIKSAMRYAENISTEDCKVKMSLVASPLYVLSTQSSERESGISLVDNAIEVLREHITSKGGKLVVKEGARVVSERDDKLLSEQMTNSHKTESESGSDDD

SEQ ID NO: 12201 - protein, 316 aa, Alteromonadales bacterium
MTEAKHSKLLILGSGPAGYTAAVYAARANLNPVLITGMQQGGQLTTTTEVENWPGDAHGLTGPALMDRMKEHAERFETEIVFDHINKVDVSKRPFTLTGDQGTYTCDALIIATGASAKYLGLESETNFQGRGVSACATCDGFFYKGQKVAVVGGGNTAVEEALYLSNIADEVHVIHRRDSFRSEKILADRLTEKAANGNVVMHYNRTLDEVLGDQMGVTGIRIKDVASDATEDLDLAGVFIAIGHKPNTDMFEGQLEMKDGYLVVESGLNGNATQTSVPGVFAAGDVSDHIYRQAITSAGTGCMAALDAERYLDNL

SEQ ID NO: 12202 - protein, 380 aa, Vibrio vulnificus
MKKLSKLLISAAIALPLMFTLLAKVGVADTMDKTAPNLASLPVATLAGGCFWCTESDLEKLNGVYDVVSGYSGGEMANPTYRQVSSGKTGHIEVIQFRYDPNVVSYEAVLDYFLRHIDPTDDKGSFVDRGPQYRPAIFYHTAEQKQIAERFLKEVDEAKIYPKPIKTELIEYTAFYPAEQYHQDYYKKSSLKYKYYRHASGRDQYLDKVFGDDRIEQPKTLRQLIDEKALTKNAKTYSRPSDKEIKAQLTDLQYYVTQKEGTERPFNNEYWDNKEAGIYVDIVSGEPLFSSTDKYKSGTGWPSFTKPISSAYIVTKTDYKLLYPRTEVRSKFADSHLGHVFDDGPAPTGLRYCMNSAAMKFIPVAQMEKMGYGEYLTLFQ

SEQ ID NO: 12203 - protein, 153 aa, Methanococcoides burtonii
MERATFAAGCFWGVEAAFSKVEGVISTKVGYTGGTLKDPTYKDVSTGSTGHAESIDIIFDESVITYGELLEVLWNTHDPTTKDSQGPDHGSQYRSAIFYHDDAQREAALRSREQLERSGKYDSTIKTEIVKASEFSPAEDYHQKYFQKLQFKR

SEQ ID NO: 12204 - protein, 97 aa, Solanum lycopersicum
ASYKVKLITPEGPIEFECPDDVYILDQAEEEGHDLPYSCRAGSCSSCAGKVTAGSVDQSDGNFLDEDQEAAGFVLTCVAYPKGDVTIETHKEEELTA

SEQ ID NO: 12205 - protein, 450 aa, Cryptococcus neoformans
MAPKADWEKYDKKVTDEKEEKIVALDESDIQILKTYGQGPYSLHLKKIENQIKDIQKRVNEKIGVRESDTGLAPANLWDIPADKQRSGRPLQVARCQTIIKAANPPSGDQPLNPQDGAGAGNPEGDRYVISIKQVAKFVVGLGDEVSPTDVEEGMRVGVDQVTYKIMLPLPPKIDPSVTMMQVEERPSITYADVGGCKEQIEKLREVVELPLLEPERFVNLGIEPPKGVLLYGPPGTGKTLCARAVANRTDSTFIRVIGSELVQKYIGEGARMVRELFEMARSKKACIIFFDEVDAIGGARFDDGAGGDNEVQRTMLELINQLDGFDPRGNIKVIMATNRPDTLDPALLRPGRLDRKVEFSLPDNEGRTHILKIHGKSMSVERDIRYDLIARLCPNATGAELKAVATEAGMFAIRARRKVATERDFLDAVEKVIRQGSKFSSTALYAQYN

SEQ ID NO: 12206 - protein, 104 aa, Streptococcus pneumoniae
MAKAITDATFEQETKDGLVLVDFWATWCGPCRMQGPILDKLSEELSEDVLKIVKMDVDENPNTARAFGIMSIPTLLFKKDGQVVKQVAGVHTAEQIKAIIAELS

SEQ ID NO: 12207 - protein, 97 aa, Solanum lycopersicum
ATYKVKLITPEGPFEFDCPDDVSILDRAEETGLDLPYSCRAGACSSCAGKVTAGSVDQSDNSFLDDDQIDEGFVLTCVAYPKSNVTIETHKEEDLVG

SEQ ID NO: 12208 - protein, 358 aa, Arabidopsis thaliana
MAGAVSLWRREAVFLTAMLAGETSIVGLSTLFKVATSKGLNIYPFLSYSYLLASLLLLPSLFFTNRSRSLPPLSASILSKIGLLGFLGSMYVITGGIGIEYSNPTLASAIGNIVPALTFILAVIFRMEKVSFKERSSVAKVMGTILSLIGAFVVIFYHGPRVFVASSPPYLNFRQLSPPLSSSKSDWLIGGAILTIQGIFVSVSFILQTHIMREYPEAFTVSILYILCISIVTSMIGLVVEKNNPSIWIIHFDITLFTIVTTGIITSVYYVIHSWAIRHKRPLYLAIFKPLSILIAVVMGTIFLNDSLYLGCLIGGILITLGFYVVMWGKANEEKNKLLSFSGKEKTPLLLSGKNDQI

SEQ ID NO: 12209 - protein, 399 aa, Saccharum officinarum
MAVLQVAAAAPPPVSAIGFEGYEKRLEISFSEAPVFTDPNGRGLRALSRAQIDSVLDLARCTIVSKLSNEDFDSYVLSESSLFVYPYKMVIKTCGTTKLLLAIPRILELAEELSLPLAAVKYSRGTFIFPDAQPSPHKNFADEVAFLNRYFGGLRSGGNAYVIGDSAKPGQKWHVYYATEHPEEPVVTLEMCMTGLDKKKASVFFKTSADGYTSCAKEMTKLSGISDIIPEMEICDFDFEPCGYSMNAVHGPAFSTIHVTPEDGFSYASYEVMGFNPGSLSYGDLVKRVLRCFGPAEFSVAVTIFGERDNAKTWGKKLDAEAYACSNTVEQVLPSGGLLIYQSFTATGETTPGSPRSVLHDFAGDIVKNGSESGEPDAPCWEADAVDKIEEREVKKMKY

SEQ ID NO: 12210 - protein, 319 aa, Colwellia psychrerythraea
MHKPLSKIQKLEHPLFDKYNLDVRVKRDDLLHNIISGNKWRKLKHNLEQLKTNDYQGALTFGGSYSNHIHAFAYACKQHNIPCIGVIRGEANYANNFTLSWARHWGMQCHFVDRKTYRRRFETNFIDELKTLYPNYFVIPEGGSNSLAIPGVAEVLTELNSQVDFDTLITPVGSGGTLAGLISGDSVANQKQHKILGIAVLKQAEYLVDDIKRLLTEEAKNHENWKLLTNFHRGGYGKFSEDDVKRIITFNQQTGVCFEPVYSGKMVLALLDLITQGYFQPQERIVLLHTGGLQGLGGMIEQGRLDANDWPPLSSVDNE

SEQ ID NO: 12211 - protein, 415 aa, Listeria monocytogenes
MTELIKKGSGAKEAAQFLAQATTKHKNAALLNLSNDLLIHTATLLQENEKDILRAKQKGTPETMIDRLRLTEERIKEISEAVKQVVALKDPIGEVTNMWKNEAELTIGKTRVPLGVIGIIYESRPNVTVDASVLCFKTGNAVILRGGSDAIDSNKALMSVIQDSLEASGFPRSSVQLIEDTSRETARDMMRLNRFLDVLIPRGGARLIQTVLENATVPVIETGTGNCHIYVDKAAEKQMAIDILVNAKCSRPSVCNAAETLLIHRDVAEDYLPAMETALKEYDVELRADERAKEILQEAKAATESDWEDEFLDFILAIKVVDSAEEAIDHINKYGTKHSEAIISNDYATGQAFHQKVDAAAVYINASTRFTDGFAMGFGAEIGISTQKLHARGPMGLTELTSTKYIIFGDGQIRN

SEQ ID NO: 12212 - protein, 335 aa, Thermotoga maritima
  misc_feature (13)..(13): Xaa can be any naturally occurring amino acid
  misc_feature (15)..(15): Xaa can be any naturally occurring amino acid
  misc_feature (32)..(32): Xaa can be any naturally occurring amino acid
  misc_feature (106)..(106): Xaa can be any naturally occurring amino acid
  misc_feature (227)..(227): Xaa can be any naturally occurring amino acid
  misc_feature (237)..(237): Xaa can be any naturally occurring amino acid
  misc_feature (246)..(246): Xaa can be any naturally occurring amino acid
  misc_feature (290)..(290): Xaa can be any naturally occurring amino acid
  misc_feature (300)..(300): Xaa can be any naturally occurring amino acid
  misc_feature (320)..(320): Xaa can be any naturally occurring amino acid
  misc_feature (324)..(324): Xaa can be any naturally occurring amino acid
MGSDKIHHHHHHXEXRFFVLGAGSWGTVFAQXLHENGEEVILWARRKEIVDLINVSHTSPYVEESKITVRATNDLEEIKKEDILVIAIPVQYIREHLLRLPVKPSXVLNLSKGIEIKTGKRVSEIVEEILGCPYAVLSGPSHAEEVAKKLPTAVTLAGENSKELQKRISTEYFRVYTCEDVVGVEIAGALKNVIAIAAGILDGFGGWDNAKAALETRGIYEIARFGXFFGADQKTFXGLAGIGDLXVTCNSRYSRNRRFGELIARGFNPLKLLESSNQVVEGAFTVKAVXKIAKENKIDXPISEEVYRVVYEGKPPLQSXRDLXRRSLKDEFWAS

SEQ ID NO: 12213 - protein, 426 aa, Porphyromonas gingivalis
MKKDSVIFDLIEKEHQRQLKGIELIASENFVSEQVMQAMGSCMTNKYAEGYPGKRYYGGCEVVDQSEQIAIDRIKQLYGAEWANVQPHSGAQANMAVLLACLEAGDTFMGLNLEHGGHLSHGSLVNSSGILYRPIGYNLSEETGMVDYDHMEKMAIEHKPKLIIGGGSAYSREWDYKRMREIADKVGALLMIDMAHPAGLIAAGLLENPVKYAHIVTSTTHKTLRGPRGGIILMGKDFDNPWGKKTPKGEIKKMSALLDSAVFPGVQGGPLEHVIAAKAVAFGEALDPSFKEYQTQVKKNAAVLAQAFMDKGYKVISGGTDNHSMLIDLRPKFPELTGKVAEKALVAADITVNKNMVPFDSRSAFQTSGFRVGTPAITTRGVKEDKMGYIVELIDRVLSAPEDEAVIASVRTEVNRMMADYPLFAW

SEQ ID NO: 12214 - protein, 150 aa, Apium graveolens
REFDFIAEYIWIGGTGVDVRSKSRTISKPVEHPSELPKWNYDGSSTGQAPGDDSEVILYPQAIFKDPFRGGNNILVICDTYTPQGEPIPTNKRHKAAQIFSDAKVLGEVPWFGIEQEYTLMQQNVNWPLGWPVGGYPGPQGPYYCAITSE

SEQ ID NO: 12215 - protein, 188 aa, Rickettsiella grylli
MLIPRSIQEVEKKATRLFTKEDIEQGLDNMARAISDKLSESNPVVLCVMIGGLIPAGNLLPRLDFPLELDYVHATRYSHETVGHAEILWVAKPRLSLKNRNVLIIEDILDGGLTLAAIVDYCHEQGAQAVYTAVLLNKKNAKRLPGGSVSADFTAMTMNQGFVFGYGMDYNGYLRNAPGIYVVSPEHE

SEQ ID NO: 12216 - protein, 325 aa, Unknown
  Synechococcus sp. WH 5701
MERPLALIDPLIRSAVRSEPPAWGEGVRLGLWQGAGSAGTPEAVIENLERLEAVTALAASNQVQLLAFPELYLSGYALSHEAAWRLAEPHDGPSLRRVAAAARRHGVAIACPYPERAVVAGCECLYDAIALFDQDGTLLRNYRKTHLWGPDEALLWTAGYREPEEGPAYTVQRVNGLPLGLLNCYEGEFPELTRLLVLAGARLVLIPTAADTWMLLSDGRRTDRPYPDVSRTLLPAHAFSSQCFVAYANRCGEESVGEQVRGAYLGNSVVAAPDGSLLLAASDEPTLLIADCRPGDYGPSHPEGTTYLSDRRTDLYGPLAQPQAL

SEQ ID NO: 12217 - protein, 728 aa, Arabidopsis halleri
FFFFLFFVLVLFPDFSISANTLSATESMTISSNKTIVSPGGVFELGFFKLLGDSWYLGIWYKNVSEKTYLWVANRDNPLSDSIGILKITNSNLVLINHSDTPIWSTNLTGAVRSPVVAELLDNGNFVLRDSKTNDSDGFLWQSFDFPTNTLLPQMKLGLDHKRGLNRFLTSWKNSFDPSSGDYTFKLETRGLTELFGLFTILELYRSGPWDGRRFSGIPEMEQWDDFIYNFTENREEVCYTFRLTDPNLYSRLTINSAGNLERFTWDPTREEWNRFWFMPKDDCDMHGICGPYAYCDTSTSPACNCIRGFQPLSPQEWASGDASGRCRRNRQLNCGGDKFLQLMNMKLPDTTTATVDKRLGLEECEQKCKNDCNCTAFANMDIRNGGPGCVIWIGEFQDIRKYASAGQDLYVRLAAADIRERRNISRKIIGLTVGISLMVVVTFIIYCFWKRKHKRARATAAAIGYRERIQGFLTSGVVVSSNRHLFGDSKTEDLELPLTEFEAVIMATDNFSDSNILGRGGFGVVYKGRLLDGQEIAVKRLSEVSSQGTIEFMNEVRLIARLQHINLVRLLSCCIHAGEKILIYEYLENGSLDSHLFNINQSSKLNWQKRFNIINGIARGLLYLHQDSRFKIIHRDLKASNVLLDKNMTPKISDFGMARIFESDETEANTRKVVGTYGYMSPEYAMDGRFSVKSDVFSFGVLILEIVSGKRNRGFYNSSQDKNLLGY

SEQ ID NO: 12218 - protein, 383 aa, Ashbya gossypii
MSQLLPQAYLTNFHNRIRNEDVPLFITAAPTRNHKRAKVVNYSEYDNDLLLDDFIEQDQNDDDEKVHSDNGKGEGEEVGHEDAVASNNNLPDLEQQDDPTGILRYPRIRETFLQSKIAVRYEQVLEAGVGGSGEAVGIAEDEGAGAYSSSSQPVVIPIRLNLEHNGHKIIDFFTWNLNDHSLTLEQFAQIYCQDLDFAHNLSLQNQIVAAINDQLQEYETLASVVVPDLHVIINLTCNLDSKLYEDNFEWNLNDQTLSPEQFAELVVQDLGLTREFMPAIAHALYESILKIKKDWLEGHLNPEHVANGAAFGCLSGIRLDIDTLGSNWCPKVEVLSQWEIEKREIEKERNMRRLKRESAKVDDRLARRRGKRRMDDLETTMRI

SEQ ID NO: 12219 - protein, 178 aa, Bacillus thuringiensis
MSEKTYELATFAGGCFWCMVKPFDELPGIHKVLSGYAGGHVENPTYEQVKAGTSGHLEVVQITFDPSIFPYEKLLNLYWPQIDPTDDGGQFFDRGPSYRTAIFYHNEMQKELAEKSKQTLAESGMFKDPIVTEIRPAAPFYEAEEYHQHFYKKNPEKYATEQKESGREDFIKENWQKK

SEQ ID NO: 12220 - protein, 297 aa, Arabidopsis thaliana
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEVIISLNLCHILLLYITLKDSFIINEYYYIINMIM

SEQ ID NO: 12221 - protein, 491 aa, Pseudomonas aeruginosa
MHNESRPEAPLRVLVVGAGFAGLGLAIRLRQAGIDDYLVLEKAADVGGCWRENRYPGAACDVPSHLYSFSFEPKADWSRKFAPQAEILDYLRHCADKYRLREKIRFHCEVEEARFDAGSGEWQVRCADGQTLRARALVCATGQLSRPLLPRLPGLERFQGPAFHSANWDAEVELAGKRVAVIGTGASAIQFVPRIAPQVQRLSLFQRSAPYVIAKPDRTYADWERRLKARWPWLQRLDRGLKYLHHESRMLAFATFPALMKVMRLSFHRHLHRQIADPQLRARLVPDYPLGCKRILISNDYYPALARSNVELVDTGIREVTEDAVVGRDGRRHEVDAIIFGTGFAATEFLAPMRILGLDGRDLRQAWADGAEAYKGISVSGFPNLFILYGPNTNLGHNSIVYMLESQFPYVLGCLRQLQEQGLRYLDVKPEVQRRFNLEVQQGLRHTVWERGCDSWYKTAAGKNTNNWPGYTFVYRWRTRRPELADYDLAR

SEQ ID NO: 12222 - protein, 361 aa, Medicago truncatula
MAAAVTAAVSFPYSNSTSLPIRTSVISPDRLVFKKVSLNNVSISGRLTVRAEVATEAPAPVKVEKISKKQEEGIVVNKFKPKTPYIGRCLLNTKITGDDAPGETWHMVFSTEGEVPYREGQSIGIVPDGIDKNGKPHKLRLYSIASSALGDFGDSKTVSLCVKRLVYTNDAGEVVKGVCSNFLCDLRPGSEVQITGPVGKEMLMPKDPNATVIMLGTGTGIAPFRSFLWKMFFEKHEDYKFNGLAWLFLGVPTSSSLLYKEEFEKMKEKAPENFRLDFAVSREQVNDKGEKMYIQTRMAQYAEELWELLKKDNTFVYMCGLKGMEKGIDDIMVSLAAKDGIDWIEYKRSLKKAEQWNVEVY

SEQ ID NO: 12223 - protein, 517 aa, Staphylococcus aureus
MSEEKHVVEHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAILAGSDLLGTNHALSLAFSGFATSAVALVAAALFLAAAMQETNLHKRLALLVLSIVGNKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSVALYFIMIKVMPPEINTIEGGKDLIKEELHKLGPVSPREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKAGIPLTIVGYILVIVFSMTYWKWLGLL

SEQ ID NO: 12224 - protein, 338 aa, Bifidobacterium longum
MSERNEHNDGNTQTAYFAGGCFWGLERYFQNVDGVTDTTVGYAQSTVESPAYEQVCAGGTDAAETVKVEFNPAQVSLRTLTLLFLEVIDPFSVDQQGEDRGRQYRTGMFYTDETQRAVYVAALEQLVDRQPQRPAVLVEPLRNFYPAEAHHQDYLVNNPGGYCHVPIAAIANVKRRQKYVERIWDLTLEQFAVTQNAATERPFVNEYDEEFEPGIYVDIVSGEPLFSSRDKFDSGCGWPAFSRPIAGDLLTEHEDHRIPGRDRIEVRTSDTQIHLGHVFTDGPADRGGLRYCMNSAALRFVPRSRMAEEGYGDWIAVVDGMIRHEHGEYRGRSQARQA

SEQ ID NO: 12225 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVTAGDIMSYHLEEYDILHQRSLFNEARIAVTLIRGNHYFKASKTMNQQGEPYNVFTSFYKKWRPYLRHRDVYHYDLKSFEDFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKPKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQMVDHQEKRTQVLATFKALD

SEQ ID NO: 12226 - protein, 915 aa, Magnaporthe grisea
MAMLASKSPFPAPLATSGSGMMAGTAQASYPPSRRAPAVPPASQSFSPTESEFSDSDDHDSPKHWDEDKVCEYLRSVRCGEYEKLFRKNHINGENLLEMDKDVLKEMGIEKVGDRVRLFLSIKKLRTKAIAGQKKRNRDSFAGHESMYTPVSESPSKPFHSSSRVMPNPSVNKRYSRQIDLSGMAYDPSRPTTSSRPTSPLPSADFRTARTRNPYVGQQPTPTGSLRGLGSPPDSQANSRPVLTHTRTDSGMDGSLMAALPQNQDVIRVISTGGVTKVVKIADCNTCEEVMRVTLRKFALREDHERNYCFWVLSGLDPDPKQCRRLGDTELWRVIKDQKRPERNRLILRRVPAGEPGQSELERAAAIAMEEAQQSHSRAMDNVGARSQIKVQKVLGENWDNLQPPLSPVLYQDRERNVYNAARDLERPEPLDSGRLQPRRKVLRSFGGLRPPSELIASDLTTYFPDHPREDIDRTARLSMRRSARLSKVNSRLSVASSFSMASSIQDAPPIPTIADSWLQSTPLPKARPRDLQSRLQHGYRDSVASSMLDTLQEEGSPIEPNRKSYVSFADSGSDSAAVSVTDPDGNIVRHSYFDEGSTIGSGSGSGSFGDVSKALNEDGEDADEDLQSFLSGESWDDSKWMKGALIGQGSFGCVYLALHAITGELLAVKQVEAPSPGANSQNDARKKSMIEALKREISLLRDLRHPNIVQYLGCGSSAEYLNIFLEYVPGGSVQTMLNSYGALPEPLVRSFVRQILNGLSYLHEREIIHRDIKGANILVDNKGTIKISDFGISKKIEATNLLNGANNNKHRPSLQGSVFWMAPEVVKQTSYTRKADIWSLGCLVVEMMTGTHPFPDCTQLQAIFKIGGGKATPTIPEDASTEAKAFLAQTFEMDHNKRPSADDLMLSPFLTPIT

SEQ ID NO: 12227 - protein, 563 aa, Ashbya gossypii
MAPKDTAVSETSTRSRYIKKGKTLENDIELQSVTPATGEFPEDHTEEGDYQETEVKRALKARHISMIALGGTIGTGLFIVIASPLRTAGPVGSLLAYIFIGTVVYSITQSLGEMATFIPVTSSVTVFSKRFLSPAFGVANGYMYWFNWAITFAVELSVVGQIIQYWTDRVPIAAWIVIFWVLVTLVNFFPVRFYGEIEFWIASVKVLTIVGYLIYAFIIVCGGSKQGPIGLPATGGIPARGARASSRTTRKRHGFLGWVSSLIKAAFTYQGTELVGITAGESTNPRKNVPKAINKVFFRILFFYIGSLLFVGLLVPYDDPRLNSESSTDVNASPFVISIKNAGTKILPDIFNAVVLITVISAANSNVYIGSRVAYSLALAGNAPKQLAFVTKQGVPYFGVLITSLMGLMSFLVLNHNASTAFDWLVNISTLAGLCAWLFISLAHIRFMQCLKHRGISRDDLPFKAKFMPWAAYYATFFVTVIIFIQGYTAFTPKFDVTTFFTSYISLFLMLLVFIGCQIYYKCRFLWAVEDIDIDSDRREIDAIVWEEDEPKNIWDKFWSAVA

SEQ ID NO: 12228 - protein, 556 aa, Ashbya gossypii
MTNIIYEPKGDGSSSSTITAKPGAIKAEVLNHNTSEVESLCEKPNQSDVKRELKPRHVTMISLGGTIGTGLFIGIASPIRNAGPVGSLLAYIFVATMAYCVTQSLGEMATFIPVTSSFTVFASRFVSPALGAANGYLYWLSWCITFALEISVIGRLILYWSDAVPITAWMAIFWVLLTAINLIPVKFYGEFEFWIASLKVIAILCFLFYGLVVVCGGSKLGRIGFRYWKDPGPWGVGIVSQEIHTAQFLGWVSSLIKAAFTFQGTELVGVTAGETKNPRRTVPKAINTVFFRILLFYIGSLLVIGLLVRYDDPQLIQDGSTTNANASPFVVAINAAGTKVLPDIMNGVIMVTIISAGNSNIYVGSRVLYGLGRSGLAPAFISRTTSRGVPYVAVLATSMFGALGYLNVSSKSGSVFDWLLSITAVSGFFTWLLISVSHIRFMQCLKKRGISRDDLPFKAKFMPYGAYYAAFFVIVIILVQGFTAFTPFSAVDFVAYYISAFIFVVIWLLFQFLFKGRWFHTVDEIDIDTDRRDIDAIIWDDDKPTTLWGKIWYHLS

SEQ ID NO: 12229 - protein, 142 aa, Rhodobacter sphaeroides
MQVKYLHTMVRVLDLEKSIAFFRLLGLEETRRTESETGRFTLVFMAPPGQPECPVELTYNWDGDEGLPSDSRHFGHLAYAVEDIYDMCARLQAAGVTINRPPRDGHMAFVRSPDNISIELLQMGDSLPPAEPWSSMQNTGHW

SEQ ID NO: 12230 - protein, 221 aa, Zea mays
MGRRPARCYRQIKNKPYPKSRYCRGVPDPKIRIYDVGMKRKGVDEFPYCVHLVSWEKENVSSEALEAARIACNKYMTKSAGKDAFHLRGPGFTPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGKAFLEAVA

SEQ ID NO: 12231 - protein, 328 aa, Flavobacteria bacterium
MNQTIKKIGVMTSGGDSPGMNAALRSVVRTCAFHGVECLGIYRGYQGLIEGDFKEMTARSVNNIINKGGTILKSARSQEFRTVEGRKKAFEKVKASGMDALVVIGGDGSFTGGMVFNEEFNFPVMGIPGTIDNDIYGTSSTLGFDTALNTVVECIDKIRDTASSHNRLFFVEVMGRDVGHIALNAGVGAGAEEILIPEEDMGKDRLVESLKRSRESGKSSSIVVVAEGDKTGDNVFELKDYVEKNMPEYEVRVSVLGHMQRGGSPSCWDRVLASRMGVKAVESLLEGKTNYMVGINNNKIELCPLDKAVKGKTEIDQELLRVSDIMTV

SEQ ID NO: 12232 - protein, 130 aa, Vibrio angustum
MIDILLNLRSLRAQAREMSVADLQEGLQKFTQVVEERREEEEAANAINKEQEAKLQKYRDMLEAEGITAEELVALLGDAPKAKKKRAARPAKYKFADENGEEKTWTGQGRTPKALQQLLDNGAQLSEFEI

SEQ ID NO: 12233 - protein, 475 aa, Rhodobacter sphaeroides
MQAAEPSFRESVDLMFNRAVALMDLSPGLEEKIRVCNSTYTVRFGVRLRGKIFTFTGYRSVHSEHMEPVKGGIRYALSVSQDEVEALAALMTYKCALVETPFGGSKGGLCIDPREWDEHELEQITRRFAYELAKRDLIHPAQNVPAPDMGTGEREMAWIADQYARMNTADINARACVTGKPINAGGIHGRVEATGRGVQFALREFFRHAEDKARAGLSGDLDGKRIIVQGLGNVGYHAAKFLTEEDGAKVTGVIERDGALVNPAGIPVEELRHWMMKTGSIRGFSQADFVEDGRKLLEEECDILIPAAMEGVITRENAARIKAPLIIEAANGPITFGADEILRQKGTVIVPDLYANAGGVTVSYFEWVKNLSHIRFGRMQRRAEEARSRALVEELERLSADQGLGWQLAPDFKQKFMQGSDELALVRSGLDDTMRIAYQSMREVWHGAEGAQDLRVAAYIVAIRRVAATYRSKGL

SEQ ID NO: 12234 - protein, 471 aa, Roseovarius nubinhibens
METGMAKAQIGVYGLGTMGSALALNMAEAGIRVAVTNREADWIARFVTEAGALAENIVPQDGLEAFVASLVTPRVILFMIPSGAPMDAMIEAIAPLLSPGDTIIDGGNANFHDTRRRSAALATQDLHFVGMGVSGGEEGARHGPSMMVGGSDHSWAQLKPLLEAIAARYGEDPCVAHLGPDGAGHFVKTVHNGIEYADMQAIAEIYTLEHHGAAKIPEEIGAMFTRWDAGPLKSYLLEITGKLLTYTDPETGHPMVDVIWDAAGQKGTGRWTVIEALRMGQSASMIEAAVGARGWSSEKYTRVEAEKILGGARGAMECSEEVLADAFMAARILSYAQGFRILKAASEEYDWQLDMARIAEIWRAGCIIRSAILDDISEAFQGDIPHGELILAPRFAQTLAQCIPSLRQVVSQAVHSGHAVPALAAGLSWYDTMRQGWGSANIIQAQRDFFGYHGFEKFGVEGQFHGPWWDD

SEQ ID NO: 12235 - protein, 457 aa, Salmonella typhimurium
MMDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 12236 - protein, 347 aa, Flavobacteria bacterium
MLDYVVIGGAQAGLSMAYHLQNQNKKFVVVDGEKEIGASWLNRWDSLKLFTPTEYNHLPELKFQAPKNHYPSKFEVANYFKSYVEKFKIPVQLNTLITSVRKDKKNFIVEHKDGIIEAKNVVVATGPFHIPYTPPCHTKVSSDILQIHSNYYKNTDQLQDGDTLVVGAGDSGYQILNEISSDSSRTVYFSGDTTVKSLPQQFLGKTLWWWFTVTGFLKYNKYSWVGKKINSSTQPVIGTDVKGILSRVNVIPVGRTKDAFKEKIIFENKKISSIKNIVWATGYRPNFSWIEGLELDADNYPKNYRGVSNIKGLYFIGLPWMYTRGSATLGGVSNDARYLAQRISSQK

SEQ ID NO: 12237 - protein, 369 aa, Helicobacter pylori
MELSYYEILEVEKHSNQETIKKSYRKLALKYHPDRNAGDKEAEEKFKLINEAYGVLSDEKKRALYDRYGKKGLNQAGASQGDFSDFFEDLGSFFEDAFGFGARGSKRQKSSIAPDYLQTLELSFKEAVFGCKKTIKVQYQSVCESCDGTGAKDKALETCKQCNGQGQVFMRQGFMSFAQTCGACQGKGKIVKTPCQACKGKTYILKDEEIDAIIPEGIDDQNRMVLKNKGNEYEKGKRGDLYLEAQVKEDEHFKREGCDLFIKAPVFFTTIALGHTIKVPSLKGDELELKIPRNARDKQTFAFRNEGVKHPESSYRGSLIVELQVIYPKSLNKEQQELLEKLHASFGYEGEPHKSVLETCISKIKDWFK

SEQ ID NO: 12238 - protein, 416 aa, Oryza sativa
MDLLWTLLAEYKCSTLRSPGSGWWKTNKQAQAQGPPAAVAAEEAPTARKECYGVFCTTYDLRADEKTKSWKSLVNVAVSGAAGMISNHLLFKLASGEVFGPDQPIALKLLGSERSIQALEGVAMELEDSLYPLLREVSIGIDPYVVFEDAEWALLIGAKPRGPGMERSALLDINGQIFAEQGKALNSVASRNVKVIVVGNPCNTNALICLKNAPNIPAKNFHALTRLDENRAKCQLALKAGVFYDKVSNMTIWGNHSTTQVPDFLNAKINGRPVKEVIKDTKWLEDEFTKTVQKRGGVLIQKWGRSSAASTAVSIVDAIRSLVNPTPEGDWFSTGVYTTGNPYGIAEDIVFSMPCRSKGDGDYELVKDVAMDDFLWERIKKSEAELLAEKRCVAHLTGEGNAFCDLPGDTMLPGEM

SEQ ID NO: 12239 - protein, 368 aa, Unknown
  Synechococcus sp. WH 7805
MTVTSTDPVQDPAVETAETLTNVPEAAAEMAADQADFGTDEDLSIPEDIPTADDPSSRAANRDMDNAGFTLDEFAALLSKYDYNFKPGDIVNGTVFALESKGAMIDIGAKTAAFMPLQEVSINRVEGLSDVLQPGEIREFFIMSEENEDGQLSLSIRRIEYQRAWERVRQLQKEDATIYSEVFATNRGGALVRVEGLRGFIPGSHISTRKPKEELVADFLPLKFLEVDEERNRLVLSHRRALVERKMNRLEVGEVVVGTVRGIKPYGAFIDIGGVSGLLHISEISHEHIETPHSVLNVNDQMKVMIIDLDAERGRISLSTKALEPEPGDMLTDPQKVFEKAEEMAARYKQMLLEQAEEGEEPLGSMMV

SEQ ID NO: 12240 - protein, 462 aa, Arabidopsis thaliana
MASNGVDEQIKLVEGPAGYVLEDVPHLSDYILDLPTYPNPLQSNAAYSVVRQYFVDEDDTVQEKIVVHKDSPRGTHFRRAGPRQKVYFKPSDVRACIVTCGGLCPGLNTVIREIVCGLHFMYGVTEVIGVDCGFRGFYSKNTVALTPKTVSDIHKRGGTILGTSRGGHDTSKIVDNIQDREINQVYIIGGDGTQKGANAIYKEIRRRGLKVAVAGIPKTIDNDIPVIDKSFGFDTAVEEAQRAINAAHVEATSVENGIGIVKLMGRYSGFIAMYATLASRDADCCLIPESPFYLEGKGGLYEFIAKRLRENGHMVIVIAEGAGQDLVAESIEQQDASGNKLLKDVGLWMSLKIKEYFAKHNVMDITLKYIDPTYMIRAIPANASDNVYSTLLAQSAVHGAMAGYTGFVSGLVNGRHTYIPFNRITERQNKVVITDRMWARMLSSTNQPSFMNPPKGTTEFTD

SEQ ID NO: 12241 - protein, 360 aa, Shigella flexneri
MTKKGAFTSAFFIYAFSACIIRKSQQHTSEAVMPLHNLTRFPRLEFIGAPTPLEYLPRFSDYLGREIFIKRDEVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 12242 - protein, 160 aa, Unknown
  Synechococcus sp. WH 7805
MTLDLEAKKTLLRKIPHGLFICGVAEGDAVNGFTASWVTQGSFEPPLVVMAVKADSTSNGMIQRTGRFSLNVLASDQKDLAAVFFKPQSAVGGRFEAAPYELGPLGLPILKDGLGGVECQVVGQLAHGDHTVFIGEVKSSLLHRDAPALELSATGWQYGG

SEQ ID NO: 12243 - protein, 372 aa, Candida glabrata
MSSEGQGQTEEISASDFVNQQKQLEDEARELMPWEPKQCTYELGSIRQPVFACRSHNQIGICYSCSILCHTSCDIVELFTKRHFTCDCGTERDTKPADEDGIHCQLRKNRSKDISSDSNEYRQNFKGLFCGCSTEYDPENPAVMLQCVLGTECGEDWFHDYCILGKTKEEADELRARKQPDAENDDELEDPLAGMPDLETFDAFVCWKCTSKYEQYFKRLLSHPLSETVIAKQLYRQCSEVKETDDGKRKHDEGSEDYSLFLKKDHESAFKKILKSSEADSKIRIFLTDLAPHLIKDEPVYEPPEEKEETLSIEALTRQIIQNAMDRHTAVEGLTAFHSLKDKLNSFLAPFAEAGQTVKEEDIVTFFSKSKH

SEQ ID NO: 12244 - protein, 396 aa, Arabidopsis thaliana
MMNGIKSSPCNMPYLPDDLLLNILGRVSRLYYPILSLVSKRFRSLVGSLELYKIRTLLGRRTENCLYLSLRFSYGSNPRWFTLCRRPTRTPSPEPNLKSRWFTSCFRPILTNLTRATSKEEKKLSENLMVSIPTSNDCPLSGLTCNTIGSYIYMIGGYINGVLSSRVFFLDCRSHTWHEAPSMQVARKSPLVNVLDGKIYVVEGWRGSDYSNLIEIFDPKTQKWEHVPSPSAEMRGRYISKGLVYEEKLYLFGDKNVVYKPKESRWDALGFDMNLWLVSYGSSCVIDNVCYMVFYKRLIWYDSEVRYWRVLKGLEKLPKLRHRRSCIRMVDYGGKIAILWEKKVRVVGSDKKMIWCTEIALERRSAHKIYGKIEWCDVVLTVPKSCSLLEFIAVTI

SEQ ID NO: 12245 - protein, 238 aa, Unknown
  Synechococcus sp. WH 7805
MLSGRTPAQDLSIDKLLDRFANGSARQRRATAAALEKAADALADVATDALKPYEPSGDDWAAGWILQVLRRHQPDALARIPGVESGGWFQAPSARGIDYGPMQRALLDEDFEEADRLTSCVLRELAGDQAVKRGYVYFSEVPPMEGLDLTTLDRLWIAYSQGRFGFTVQARLLKALDGRYDRLWPRIGWKLDGTWTRYPGAFQWSMDAPEGHMPLINQLRGVRLMDALLSHPGLQPRV

SEQ ID NO: 12246 - protein, 421 aa, Saccharomyces cerevisiae
KIKDPKILGIDPNVTQYTGYLDVEDEDKHFFFWTFESRNDPAKDPVILWLNGGPGCSSLTGLFFELGPSSIGPDLKPIGNPYSWNSNATVIFLDQPVNVGFSYSGSSGVSNTVAAGKDVYNFLELFFDQFPEYVNKGQDFHIAGESYAGHYIPVFASEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDYLNQDYVKEAVGAEVDHYESCNFDINRNFLFAGDWMKPYHTAVTDLLNQDLPILVYAGDKDFICNWLGNKAWTDVLPWKYDEEFASQKVRNWTASITDEVAGEVKSYKHFTYLRVFNGGHMVPFDVPENALSMVNEWIHGGFSL

SEQ ID NO: 12247 - protein, 557 aa, Unknown
  marine gamma proteobacterium HTCC2080
MSESFAELFEESLKTVDMEPGSIVTGVVIDIDNEWVTVHAGLKSEGVIPLDQFTNANGECTLNIGDEVQVALETVEDGFGETKLSREKAKRAEAWKRLEAAHVADEVVTGIINGKVKGGFTVDIESIRAFLPGSLIDVRPVRETTHLEGKELEFKVIKLDQKRNNVVVSRRAVMEAANSQEREELLENLQEGMSVKGVVKNLTDYGAFVDLGGVDGLLHITDMAWKRIKHPSEIVEVGQEMDVKILKFDRERNRVSLGLKQLGEDPWVEITNRYPEGARVNAKVTNLTDYGCFAEIEEGVEGLVHVSEMDWTNKNVHPSKIVQLGDEVEVMVLDIDEDRRRISLGIKQCTQNPWDAFASDHAKGDRISGTIKSITDFGIFIGLDGAIDGLVHLSDISWNETGEEAVRNYKKGDEIETVILSIDPERERISLGVKQMEEDAFTLYVSDNDRGTIVTGKALEVDAKGALIKLSDEVSGYLKVGDISVERIEDARSVINVGDSVEAKITNVDRKNRTLGLSIKAKDMADEKEAVETLKQQDEAASPGTIGDLIKAKMDSQ

SEQ ID NO: 12248 - protein, 499 aa, Taxus cuspidata
MDALYKSTVAKFNEVTQLDCSTESFSIALSAIAGILLLLLLFRSKRHSSLKLPPGKLGIPFIGESFIFLRALRSNSLEQFFDERVKKFGLVFKTSLIGHPTVVLCGPAGNRLILSNEEKLVQMSWPAQFMKLMGENSVATRRGEDHIVMRSALAGFFGPGALQSYIGKMNTEIQSHINEKWKGKDEVNVLPLVRELVFNISAILFFNIYDKQEQDRLHKLLETILVGSFALPIDLPGFGFHRALQGRAKLNKIMLSLIKKRKEDLQSGSATATQDLLSVLLTFRDDKGTPLTNDEILDNFSSLLHASYDTTTSPMALIFKLLSSNPECYQKVVQEQLEILSNKEEGEEITWKDLKAMKYTWQVAQETLRMFPPVFGTFRKAITDIQYDGYTIPKGWKLLWTTYSTHPKDLYFNEPEKFMPSRFDQEGKHVAPYTFLPFGGGQRSCVGWEFSKMEILLFVHHFVKTFSSYTPVDPDEKISGDPLPPLPSKGFSIKLFPRP

SEQ ID NO: 12249 - protein, 602 aa, Campylobacter coli
MEKKKIPMLILCVLIALAFWIIPTPIGLEENSWHFLGLFIAVIMAVILQVMPLGAVCMIAIAIVALSGITTTQSSVRATHIKTLEAIVLKDNSNIYKVTMEQKSQASILENLIKANVAKNLEPKVNEILKSNSNIEYQIDSLNKLYAKATSKVAAQKLIDESKIAALNSLALEFMSQKDIDEKVNTAISSLKSKTGIKDALSGFSNSLIWLIVVSIIVARGVIKTGLGERLAYYFISIFGKKTLGIAYSIAFCETILAPVTPSNTARAGAIINPIVQAISRSFKSTPEDGTQNKIGTYLSLVNFQANPISSAMFITATAPNPLVVDLVAQATNLEVHLTWGQWALGMFLPGIAAMLLMPLVIYFLSPPEIKSTPNAKIFAKGKLEELGAMKGSEKIMLGVFVLLLLLWAGALGFLFGISLDATSVALLGLSLVLVSGVLTFGEVLAEKAAWNTLVWFSALVMMATLLGKLGVTQFLAEALGEFASAMGLGEISIMIFLSLAFLYTHYFFASTTAHISAMFFVFYSAGLALGAPPLLYAFIMIASGNVMMALTHYATGTAPVIFGTGYVSLKKWWSVGFVISVIDITVMILVGLVWWKFLGFY

SEQ ID NO: 12250 - protein, 605 aa, Caulobacter crescentus
MAPSKGEDSRLVRIALTEAYVPIARGYLLAAAIYNSLIAIAHPFYEKGLAFVMLTSLTGATAIYAFSAWFLLRRRRIVGGHLEWLVLGMNALFLGHVTAFHLFHLEPQKLIYFVLLALVFATSAPSRRVANVSVGAALVSLVFIARGAPGDMVNQYLFVGLAGAFAAVGMSTLMRGVVGREVRARLASQALNDELERELTENRRLRTEAQALALAAEKANRAKSEFLATMSHEIRTPLNGVLGMAQIMASGKLQVDQRRRLETITASGQSLLGLINTILDVSRIEDGKMEIVEGPFDLTAQMHTLSLLYGGLARDKHLDFSLEVSPTVAGCRQGDGERLRQVLSNLISNAIKFTDSGAVRVTLDGDDQGLVARVLDTGVGIPEAQRERLFTKFAQLDSSSTRRVGGSGLGLAICKSLAELMGGEIRFLAPAEGGACFELTLPMARIDPPPAVAAPPAPALAPASADEDAAPRILVVDDNQTNRAVLLTLLGHLGADAHFAVDGRDAVAMWEQDRWDVILMDIHMPEMDGLQACQVIREGERQGGRLRTPVVAVTASVLPHERSLYVEAGMDAVVPKPVEVPKLLEVLANVLADADEAAVETRGAA

SEQ ID NO: 12251 - protein, 765 aa, Ashbya gossypii
MRASSICDIVLAVWLLPLSQTVAQVVQRENDWQSIEASRAGMFGNSVQGGCDGVCEPQEGPVTAIMNMWENVDASPIPERPEMTDIDLVPPGKQTGNAFSFTSRGSAEAGVGAPTVWSPQLTGCGDHSRSYSQAVASEPVSAESSQLASQAPEVLEEFSLREADEEGDLHNETEFLPFDEWKRIKLDEEKRASVHSETHTRTRIPVDYNRADALGDEMEIDVGMFTSMEDDEPEGKLYHEKFNYASLDCAASIVKTNSEAQGASSILYENKDKYLLNPCSAVNKFVVIELCQDILVEEIEMANYEFFSSTFQNVRFSVSDRFPVPKNGWKVLGEFTAVNSRDIQKFGIPNPKIWARYLRVEILSHYGNEFYCPISVVRTHGKTMMEEFKLAQSVGNSQESEVLQPAPDRILNSTLHNASFLCTGSHHNNNGGPLSFSSNNVSVELFADDMASQCRAALPPLRFEEFIDGFDDISCGQKHSKSMNFTGTISNSATEESIFKNIMKRLTTLETNATLSILYIEEQSRLLSKSFYSLEKNHAKKFDSLVSIFNETMMHNLETLNVFAKQLKDSSMHLLEEQKLSTDQFTSMTIQRLDMMERDARFQKRMVYLILVAVAALLVYVLLTREAYIDDYMEDDGWYLDSPPLQKAKDKLMRKAARAVSTPTIFKNFQDDIAPMKIRRNPSFSSSSSISDVSQYLIDNDDDSVFLGRPRTYSKLLAADENEIDIDEIMTHSSDNSDVSHGMDRLLDADGTEVSSRESSDGEPK

SEQ ID NO: 12252 - protein, 411 aa, Solanum lycopersicum
MNALAATNRNFKLAARLLGLDSKLELSLLIPFREIKVECTIPKDDGTLASFVGFRVQHDNARGPMKGGIRYHREVDPDEVNALAQLMTWKTAVANIPYGGAKGGIGCSPSDLSISELERLTRVFTQKIHDLIGIHTDVPAPDMGTNPQTMAWILDEYSKFHGYSPAVVTGKPVDLGGSLGRDAATGRGALFATEALLNEHGKSVAGQRFVIQGFGNVGSWAAKLIHEQGGKVVAVSDITGAIKNEKGIDIESLFKHVKETRGVKGFHDAQPIDANSILVEDCDVLMPAALGGVINKDNANEIKAKYIIEAANHPTDPEADEILSKKGVTILPDIYANSGGVTVSYFEWVQNIQGFMWDEKKVNDELKTYMTRGFKDVKDMCKTHNCDLRMGAFTLGVNRVARATVLRGWEA

SEQ ID NO: 12253 - protein, 375 aa, Rubrobacter xylanophilus
MPAGKRDYYEVLGLSRDASEQDIKRAYRRLARKYHPDANPNDPEAEERFKELNEAYEVLSNPEARRAYDTYGHQVPSGASGRPGGDPFGGFQDIFEAFFGDRFGDPFFDLGRRRQPSRGGDTEAEVEISLEEAAFGTEREVQVQTIRNCPACDGAGGTETRLCGACGGSGVVRTVRETLLGQVMHQQTCSACGGSGRVVVDRCRECRGSGRVSEVVGRRIRIPAGIEDGMRLRVPGWGHAGEPGASSGDLYVKIRVKEHPELMRDGEDLIHRASVTFVQAALGTEVEVPTLEGTETVRIEPGTQPGTTLVLRGEGMPRMRGVGRGDLKVVVDVMVPTRLTGEQRKLLERFEAASGEETYNGRSGSFFDRLRGVFR

SEQ ID NO: 12254 - protein, 251 aa, Carboxydothermus hydrogenoformans
MKVYLVGAGPGDPELITVKGKKLLEEADLIVYAGSLVNPGLLEYAKPEAVKVDSAPRTLEEIVEIMVEYARAGKVVVRLQTGDPSLYGAVEEQKRALKAYGVELEWVPGVSSFLGAAARLGYELTVPDGTQTVILSRVAGRTPVPEKENLEELAKIGSTLVLFLSVDKIDEVVAQISRVRALDTPVAVVYKATFPEEKIITGTLADIAQKVKEEKINKTALIFVGEFLNPPPTRSKLYAPDFTHGGRRKGD

SEQ ID NO: 12255 - protein, 127 aa, Glycine max
  misc_feature (74)..(74): Xaa can be any naturally occurring amino acid
  misc_feature (122)..(122): Xaa can be any naturally occurring amino acid
GDSGVKGSFATRVAGSSDLYSVNNRRPYHGINFVIAHDGFTLRDLVSYNFKHNEANGEGGNDGSNDNFSWNCGXEGETDDASVRALRSRQMKNFHLALMISQGTPMMLMGDEYGHTRNGNNXSYGHD

SEQ ID NO: 12256 - protein, 420 aa, Flavobacteria bacterium
MNDKVLSIILGGGQGSRLYPLTESRSKPAVPIAGKYRLVDIPISNCINSGLKRMFVLTQFNSASLNRHIKNTYHFSFFSSAFVDVLAAEQTPDNKGWFQGTADAVRQSMHHALRHDFEYVLILSGDQLYQMDFNEMIQAHIDANAKISIATIPVTEKDATSFGILKTDDKNIITSFIEKPDASLLPDWTSPVSDEMKNQNKNHLASMGIYIFNRDLLVELMGDESTIDFGKEIIPQSIDKHKTLSYQFEGYWTDIGNIDSFFEANLGLTDDIPEFNLYDYKQRVYTNARLLPTSKISGTHLDKAVIAEGCIIHAAKIERSVIGIRSRIGKETTVINTYMMGNDDYESLNQIADSKIEILTGIGDRCFIKNTILDKNVRIGDDVRINGGPHLENQETDQYVVKDGIVVIKKHAVIPKGFSL

SEQ ID NO: 12257 - protein, 266 aa, Magnetospirillum magnetotacticum
MALPTFTMRQLVEAGVHFGHNTRRWNPKMASYLFGIRNGIHIIDLQQSVPMLHRAMQAVRDVTAGGGRVLFVGTKHQASEVVAESAKRCGQYFVNHRWLGGMLTNWKTISNSIRRLRELDEQLASGALAGLTKKEQLVLSREKEKLDRALGGIKDMGGLPDILFIIDTNKEALAVQEANKLGIPVVAIIDSNCDPAGITYPIPGNDDAIRAIQTYCDLMSGAVLDGIQAEITRGGGDVGASAEAPVEQIPEVVAEAAAEEAAAPQA

SEQ ID NO: 12258 - protein, 638 aa, Bifidobacterium longum
MTQTNNLYDVVVIGGGPAGLTAGLYLARARYRVLILEKDDFGGQITITNEVVNYPGVGRTTGRALTQTMRQQAQDFGAEFLSAEATGLDVDGDIKTVHTSRGDLKTFGILIATGASPRKLGFEGEAEYAGRGVAYCATCDGEFFTGKEVLVVGGGFAAAEESVFLTKYASKVTVLVREPDFTCDAAVAAEAKNNPKIDVRYQVELKGVTAGQGGLREASILNLATGQTETWKPADAGTFGVFVFAGYVPATDLVRGVVELDDHGYVVTHDYLRTSVPGVYAAGDLRVKNLRQVVTATADGAIAAVELERYAKQMSEKTGLVPPRPTASAYEESEAKAASAASAAGTTPAPAPAKRSADAAAAASAAKKPGELFSAAVKQQLGVVFGRMTRPVTLALELDGTPLSAELQGFIGEMVALSGGKLNSVAVDAAGLITAVDGASVPTSLVVGEPLSVTLPDGTELPTYGSLDDSGRATFDVAGVLPLARPTVRICVPAEGDGKAGKDGNGSLVFTGLAFHGVPSGHEFNSFVLGLYNVAGPGQPLGDDLIERAKSITDPLNIMILVSLTCTMCPETVLASQRIASLSPAVRAEAYDVSHFPELKDQYGAMSVPCIVITHADGTQQVEFGKKSIPQMLELVGA

SEQ ID NO: 12259 - protein, 206 aa, Neisseria meningitidis
MAVRSKSSKAWLHEHVNDHYVHMAQKDGYRARAAYKLLEINEKDKLIKPGTVLADLGSAPGSWSQVAAKLTGTSGAVFALDILPMEAIGGVSFIQGDFRENDVLAQFETLLDNRPLDLVICDMAPNMSGNAVSDQARSFYLCELALDFASQHLKTGGSFLVKVFQGAGYQEYMAAMREIFGTVQTRKPEASRNRSSEIYLLGKNKR

SEQ ID NO: 12260 - protein, 477 aa, Erwinia carotovora
MVRISMSISYLWGMVASLFLMMPAYSADVPASPSPAPIEARNSVFINQHPDQFNSWKATSEQSERHDALAEDPYMVILWAGYPFSRDYNKPRGHAYAITDVRETLRTGAPKTAEDGPLPMACWSCKSPDVARLIQQEGEEGYFKGKWARGGPEITNDLGCADCHDTASPDFAQGKPALTLSRPYAERAMEAIGKPFDSASRFGQQSMVCGQCHVEYYFSGKDKAVKFPWDNGTKVEDMEKYYDAISFSDWTNTLSRAPMLKAQHPEYETWSVGIHGKNNVTCIDCHMPKVKNADGKLYTDHKIGNPFDNYGETCTNCHTQDKAAMQAVVAERKTAIQELKLKAEEQLVHAHFEAKAAWDAGATEADMQPILIDIRHAQWRWDLAVASHGIHMHAPDEGLRMLGTSLSKSAEARTKLVRLLAQKGVTGEVKLPDISTKEKAQQAIGLNMQQINAEKQDFLNTVVPQWDEQARKAGRLN

SEQ ID NO: 12261 - protein, 962 aa, Hordeum vulgare
MPMPMRTMLLRHLSPPSAVPNPRRSSVSSPQRIPVRARPPPLHSARATALRARRRTPMAVGETGASVSAAEAEAEATQAFMPDARAYWVTSDLIAWNVGELEAQSVCLYASRAAAMSLSPSNGGIQGYDSKVELQPESAGLPETVTQKFPFISSYRAFRVPSSVDVASLVKCQLVVASFGADGKHVDVTGLQLPGVLDDMFAYTGPLGAVFSEDSVSLHLWAPTAQGVSVCFFDGPAGPALETVQLKESNGVWSVTGPREWENRYYLYEVDVYHPTKAQVLKCLAGDPYARGLSANGARTWLVDINNETLKPASWDELADEKPKLDSFSDITIYELHIRDFSAHDGTVDSDSRGAFRAFAYQASAGMEHLRKLSDAGLTHVHLLPSFHFAGVDDIKSNWKFVDECELATFPPGSDMQQAAVVAIQEEDPYNWGYNPVLWGVPKGSYASDPDGPSRIIEYRQMVQALNRIGLRVVMDVVYNHLDSSGPCGISSVLDKIVPGYYVRRDTNGQIENSAAMNNTASEHFMVDRLIVDDLLNWAVNYKVDGFRFDLMGHIMKRTMMRAKSALQSLTTDAHGVDGSKIYLYGEGWDFAEVARNQRGINGSQLNMSGTGIGSFNDRIRDAINGGNPFGNPLQQGFNTGLFLEPNGFYQGNEADTRRSLATYADQIQIGLAGNLRDYVLISHTGEAKKGSEIHTFDGLPVGYTASPIETINYVSAHDNETLFDVISVKTPMILSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTANDIKQRVRFHNTGPSLVPGVIVMGIEDARGESPEMAQLDTNFSYVVTVFNVCPHEVSMDIPALASMGFELHPVQVNSSDTLVRKSAYESATCRFTVPGRTVSVFVEPRC

SEQ ID NO: 12262 - protein, 370 aa, Crocosphaera watsonii
MNPSQTIVVKVGTSSLAQPETGKLALSTIAALVETLTELRQFGYHVVLVSSGAVGVGCSRLKLTEKPKKIVIKQAIAAVGQGRLIRVYDDLFTALNQPIAQVLLTRRELMERSCYVNAKNTFDALFELGVIPIVNENDTVAIEELKFGDNDTLSALVASLINADWLFILTDVDRLYSADPRTFPDAKPIKVVNSLELDKLEIKAGGKGSQWGTGGMSTKLTAARLATSAGITTVITHGKKPGNLLKIIKGEDIGTKFEAQLNNDNARKRWIYYGLLPRGKLYLDRGAVKAISQKGKSLLPAGIIKVEGEFDSLEAVQLYNESGQEIGRGIVNYNQEEIDKIKGNHSDKIPELLGCHGAETIVHRDNLVIN

SEQ ID NO: 12263 - protein, 203 aa, Metarhizium anisopliae
MVNNRNYDFLIKLLLIGDSGVGKSCCLLRFSEDSFTPSFITTIGIDFKIRTIELDGKRVKLQIWDTAGQERFRTITTAYYRGAMGILLVYDVTDERSFNNIRTWFQNVEQHATEGVNRILIGNKCDWEDKRVVSTEQGQALADELGIPFLEVSAKSNINIDKAFYSLAADIKKRLIDSSKNDQATGTGVNVGDKTDAGGSKCC

SEQ ID NO: 12264 - protein, 466 aa, Erwinia carotovora
MSVVPVVDVLQGRVAVDSEVTVRGWVRTRRDSKAGISFIAVYDGSCFNPLQAVVNNNLSNYQDDVLRLTTGCSVEITGNVVASPGEGQSFELQATNVNVVGWVDDPDTYPMAAKRHSIEYLREVAHLRPRTNLIGAVARVRHTLAQAIHRFFHENGYFWVSTPLITASDTEGAGEMFRVSTLDMENLPRTEQGKVDFSKDFFGKEAFLTVSGQLNGETYACALSNVYTFGPTFRAENSNTARHLAEFWMIEPEVAFASLDDVAALAENLLKYVFQAVLNERADDMAFFAERVDKEAVTRLEKFVSSDFAQVDYTDAVEILLNCGQQFENPVYWGVDLSSEHERYLAEQHFKAPVVVKNYPKDIKAFYMRMNDDGKTVAAMDVLAPGIGEIIGGSQREERLAALDSRLEEMGLNKEDYWWYRDLRRYGTIPHSGFGLGFERLIAYVTGVQNVRDVIPFPRTPRNASF

SEQ ID NO: 12265 - protein, 415 aa, Ralstonia eutropha
MMPSSTVVIVGAGQAGLQAATSLRQAGFDGRIRLVGDEPCIPYERPPLSKSYLAGETGLDGLWLRPEMFYGKERIELELGQTATAIDRQTRQVELASGRKVAYDRLVLATGARFRPLSVPGAELDGVLPLRTLADADALRPRLAEAREVVVIGAGFIGLEFAAVARKAGVAVHIIEMTQRLMGRVVSEQTSRFYTRAHRDWGSAFLFGTGVARILGNRRVSGVETSDGRTLPADLVLIGIGVVPNTEIAAAAGLAIDNGIIVDQNLASTDPTIFAIGDCANYPSRFGRCRLESVQNAVDQGQAVAAAIVGESIPYDKVPWFWTDQADLKLQIAGITAGHDRSVLRGDPESRSFSVFFFRDGTLIGVESINRPADHVVARRLLLADPRLSPEQAVDPDFDLRAHAIRFSRRERAQT

SEQ ID NO: 12266 - protein, 315 aa, Oryza sativa
MGTLVGHVAPGAGFLLVGLWHLYNHIRLFLLRPTAYVAPVWFPVRRARYLELALVIAGAVASILMELVVGPARHQPFDADGTVPSDHLHNFEHASISLALLVYAAAAAALDVARVPHGRAVSQLVAAVAFAQQLMLFHLHSADHAGVEGQYHLLLQGVVAVTLAATVLGVAAPRSFAVSLVRSASLVLQGVWFLAMGVMLWTPALLPKGCFLSREDGHDVARCRADDGGDALARAKALVNLEFSWYLSGTVVLVVALYLRLCRLYPEEPSYMPLVRGDCRDDDDDGGGDGDDNDVEAGKGGAGHVLREPLEIARP

SEQ ID NO: 12267 - protein, 414 aa, Bacillus anthracis
MVDHLKRQDEKVFAAIEAELGRQRSKIELIASENFVSEAVMEAQGSVLTNKYAEGYPGKRYYGGCEHVDVVEDIARDRVKEIFGAEHVNVQPHSGAQANMAVYFTILEQGDTVLGMNLSHGGHLTHGSPVNFSGVQYNFVEYGVDAESHCINYDDVLAKAKEHKPKLIVAGASAYPRVIDFKRFREIADEVGAYLMVDMAHIAGLVAAGLHPNPVPHAHFVTTTTHKTLRGPRGGMILCEEQFAKQIDKSIFPGIQGGPLMHVIAAKAVAFGEALQDDFKTYAQNIINNANRLAEGLQKEGLTLVSGGTDNHLILIDVRNLEITGKVAEHVLDEVGITVNKNTIPFETASPFVTSGVRIGTAAVTSRGFGLEDMDEIASLIAYTLKNHENEAALEEARKRVEALTSKFPMYTDL

SEQ ID NO: 12268 - protein, 150 aa, Brassica napus
MEGDGVKGLACQKTMDGNASNGNGVEKTVPSCCLKAMSCLPEEDAKCHSTVVSGWFSEPPHPRSSGKRGKAVYFNNPMWPGEAHSLKVEKVLFKDKSDYQEVLVFESATYGKVLVLDGILQLTEKDEFAYQEMIAHLPLCSTPSPKNVLV

SEQ ID NO: 12269 - protein, 73 aa, Sinningia striata
  misc_feature (40)..(40): Xaa can be any naturally occurring amino acid
ISGTNGEVMPGQWEFQVGPSVGIEAGDHIWCARYLLERIXEQAGVVLSLDPKPIEGDWNGAGCHTNYSTKSMR

SEQ ID NO: 12270 - protein, 73 aa, Sinningia douglasii
  misc_feature (41)..(42): Xaa can be any naturally occurring amino acid
ISGTNGEVMPGQWEFQVGPSVGIEAGDHIWCARYLLERITXXTGVVLSLDPKPIEGDWNGAGCHTNYSTKSMR

SEQ ID NO: 12271 - protein, 363 aa, Solanum lycopersicum
MESPRVEESYDKMSELKAFDDTKAGVKGLVDSGITKVPQIFVLPPKDRAKKCETHFVFPVIDLQGIDEDPIKHKEIVDKVRDASEKWGFFQVVNHGIPTSVLDRTLQGTRQFFEQDNEVKKQYYTRDTAKKVVYTSNLDLYKSSVPAASWRDTIFCYMAPNPPSLQEFPTPCGESLIDFSKDVKKLGFTLLELLSEGLGLDRSYLKDYMDCFHLFCSCNYYPPCPQPELTMGTIQHTDIGFVTILLQDDMGGLQVLHQNHWVDVPPTPGSLVVNIGDFLQLLSNDKYLSVEHRAISNNVGSRMSITCFFGESPYQSSKLYGPITELLSEDNPPKYRATTVKDHTSYLHNRGLDGTSALSRYKI

SEQ ID NO: 12272 - protein, 396 aa, Burkholderia vietnamiensis
VSKGNDVLSWCPEAAMLHAISFERGRATGYRNRWLRTQRWARVHAPEQAPHLPDANPNVSVLRHAGELLALAEGGAPLAITAALDTLGEPARHAGLGGAMTAHPKLDPVTGELILFRADWREPWLRYGVADAYGVQRVDMVVDVRAPSMMHDLAITETRSLLLDLNVGYDFAMLKQGHRMPLRWHDERDARIGVLPRHGGDVRWFGIEPCFIQHVVNAYDCDPSCIVLDVVRYPWFLRLDARTGRFADNPVGELWRYVIDTANGLIDEGPLADGGIELPRIDESRTGRSYRYLYAAEQPDSAEMRGVVRYDHVRGTSTRYALPVGDQNGEPVFVPRPGRSAEDDGWLLVVVYRAATDTSDVVILDASAIDAAPVATVHLPRRVPAGFHGAWLPRER

SEQ ID NO: 12273 - protein, 521 aa, Unknown
  Acidovorax sp. JS42
MSTPGGAPGITTPAVPLPGPRPIDIALLASVFVVAACGLLYELAAGALASYVLGDSVLQFSTVIGTYLFAMGVGSWLSRYFDRQLPAHFLRIELLVALIGGALPAVLFLANAYVPSAFRVLLYGMVLLVGTLVGLEIPLVMRILKRNVQLKDLVSQVLTFDYLGALAVSMAFPLLLVPQLGLVRTGLLFGFMNAAVAVWALWLFRHELRRFGAHALACALVLAALLAGLLGAEHITRFAEDKFYQDRIVLSSASPYQRIVVTHGRAGHRLYLNGNLQFAERDEYRYHEALVHPVMAAHGHPKRVAVLGGGDGMAVREVLKYPSVESVTLVELDPAMTQLFGSHPTLRQLNGDALASRKLTIVNTDAFQWLQQGDDTYDVIVVDFPDPTNFAIGKLYTNSFYALLDQRLAASGYAVVQTTSPLVARRSFWTVVTTIESVGLQARPYHAHVPSFGEWGFVIASRRPWRVPAELPAGLRFLDAAALPLLFDFPRDMARVPAEVNRLSNQVLVHTYEQEWGQVAH

SEQ ID NO: 12274 - protein, 225 aa, Arabidopsis thaliana
MEAALSIFKLSFLLTLLSGGSDLIDSLPPNCNRAECPSYEVVHAGNGYEIHRYNTTVWISTEPIQDISLNEASGNGWNQLSDYMNGNNDYHQRIEIALPYITQVSQNLSTFIVSFFVPKAFQPDPPPGNNLHVQRWDSRYVAVKQISGYVADHRIGKQVAELKASLQGTVWAKAIEKSRETGGVRSAWAYTVAQFSWPFQWSQRVNEIWFPFEMEDEETVSIVTQ

SEQ ID NO: 12275 - protein, 325 aa, Unknown
  Azoarcus sp. EbN1
MSNWYSDNALSIGKTPLVKLNRVTDGATATVLAKIEGRNPAYSVKCRIGAAMIWDAEQRGLLGPGKEIVEPTSGNTGIALAFVAAARGIPITLTMPETMSVERRKLLVAYGAKLVLTEGAKGMNGAIAKAEEIAASDPGRYVLLQQFNNPANPAIHASTTGPEIWNDTDGNVDIFISGVGTGGTITGVSRYFKETRGKPIVSVAVEPEASPVLTQTRAGEPLKPGPHKIQGLGAGFVPKVLDLSLIDAVETVSNEDAILYAHRLAREEGILSGISCGAAVAVAARIAQRPENAGKTIVVVLPDSGERYLSSILFEGLFDASGVAI

SEQ ID NO: 12276 - protein, 374 aa, Hevea brasiliensis
MAISSSTSGTSSSFPSRTTVMLLLFFFAASVGITDAQVGVCYGMQGNNLPPVSEVIALYKKSNITRMRIYDPNRAVLEALRGSNIELILGVPNSDLQSLTNPSNAKSWVQKNVRGFWSSVLFRYIAVGNEISPVNRGTAWLAQFVLPAMRNIHDAIRSAGLQDQIKVSTAIDLTLVGNSYPPSAGAFRDDVRSYLDPIIGFLSSIRSPLLANIYPYFTYAYNPRDISLPYALFTSPSVVVWDGQRGYKNLFDATLDALYSALERASGGSLEVVVSESGWPSAGAFAATFDNGRTYLSNLIQHVKGGTPKRPNRAIETYLFAMFDENKKQPEVEKHFGLFFPNKWQKYNLNFSAEKNWDISTEHNATILFLKSDM

SEQ ID NO: 12277 - protein, 73 aa, Sinningia kautskyi
  misc_feature (46)..(46): Xaa can be any naturally occurring amino acid
  misc_feature (55)..(55): Xaa can be any naturally occurring amino acid
ISGTNGEVMPGQWEFQVGPSVGIEAGDHIWCARYLLERITEQAGVXLSLDPKPIXGDWNGAGCHTNYSTKSMR

SEQ ID NO: 12278 - protein, 973 aa, Agrobacterium tumefaciens
MPPSHVLKRRSKTMALVTEFDYGTPKSNATDMVTLTIDGRQVTVPTGTSIMRASREAGIDVPKLCATDMVDAFGSCRLCLIEVEGRNGTPASCTTPVAAGLVVHTQTERLKQIRKGVMELYISDHPLDCLTCAANGDCELQDMAGAVGLRDVRYGYEGDNHVKSRTGGGDINARWMPKDESNPYFTYDPSKCIVCSRCVRACEEVQGTFALTIEGRGFESRVSPGAHEAFLDSDCVSCGACVQACPTATLTEKSVIEIGQPEHSMVTTCAYCGVGCSFKAEMRGEELVRMVPWKDGQANRGHSCVKGRFAYGYATHRDRILNPMIRENIGDPWREVSWDAAFAYVASEFRRIQGKYGRESIGGITSSRCTNEETFLVQKLVRAGFGNNNVDTCARVCHSPTGYGLGQAFGTSAGTQNFDSVEQSDVVLVIGANPTDGHPVFGSRLKKRLRQGAKLIVIDPRRIDLVRTPHVEAAFHLPLLPGTNVAVLTALAHVIVTEGLFNEAFIRERCDWSEFEDWAAFVAEPQHSPEETERFTGVPAEDLRGAARLYATGGNGAIYYGLGVTEHSQGSTTVMAIANLAMVTGNIGRPGVGVNPLRGQNNVQGSCDMGSFPHELPGYRHISDDATRDVFEKLWGVKLNNEPGLRIPNMLDAAVDGSFKGIYIQGEDILQSDPDTKHVSAGLAAMECVVVHDLFLNETANYAHVFLPGSTFLEKDGTFTNAERRINRVRKVMSPKNGYADWEVTQKLAQAMGLTWNYTHPSEIMDEIAATTPSFASVSYAYLEEKGSVQWPCNEKFPEGSPIMHVDGFVRGKGKFIRTEYVATDERTGPRFPLLLTTGRILSQYNVGAQTRRTENVVWHEEDRLEIHPHDAEQRGVKDGDWIKLVSRSGDTTLRALITDRVAPGVVYTTFHHPGTQANVITTDFSDWATNCPEYKVTAVQVSPSNGPTEWQEEYDALARQSRRIAGKLEAAE

SEQ ID NO: 12279 - protein, 557 aa, Cryptococcus neoformans
MSETPDQLATRVQNLSTAPTTTQRTGSGSAVLENGTNIGSAAGRKASIPAQVDPERIISTSGSGRTSRRGSGLVMTPGGVQTVYHTRTNEDIEFPHAGKKTMADLLRKYESLFTLTPQRMRMIVHAIEETLDNGLQKNGQVVPMIPTYVFGWPTGNEVGDFLALDLGGTNLRVCLVTLLGSGKFEVTQTKYRLTEEQKQGEGQALLDFCAECLNSFIRDTLGRTEKDGILPLGFTFSYPCSQDRIDHGVLIRWTKGFGAPNIEGYDVAAMFKDSLKRMDVPAELTALINDTTGTLIASNYVDPHTKIAVIFGTGCNAAYMETAGSIPKIDYVGLPEEQGMAINCEWGAFDSFDHQHLPRTKYDIIIDESSNKPGEQSFEKMIAGLYLGEIFRLVLCELIDSGDLFLGQNTYKLEKAYAFDTAFLSLMEADVTEELLTIIGVFAHFFGLETTLEERQFFKKLAVLVGTRSARLSACGIAAIVSKKGYLEEGCAVGADGSLYNKYPNFADRVHEALTDIFGESGKKIVTHHAEDGSGVGSAIIAAMTKARKDSGFFVEY

SEQ ID NO: 12280 - protein, 286 aa, Salmonella typhimurium
MAENTMWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVETITMVEIDAGVVSFCRQYLPNHNAGSYDDPRFTLVIDDGVNFVNQTHQTFDVIISDCTDPIGPGESLFTSAFYEGCKRCLNPGGIFVAQNGVCFLQQDEALDSHRKLSHYFSDVGFYQAAIPTYYGGIMTFAWATDNDALRHLSSEIIQARFHAAGLKCRYYNPAIHAAAFALPQYLHDALSAQ

SEQ ID NO: 12281 - protein, 221 aa, Triticum aestivum
MGRRPARCYRVCRGKPYPKSRYNRGVPDPKIRIYDIGRKKAPAADFPFVVHIVSNEVEQISSEALEASRIACNKYLTKHVGKDNFHMRCRVHPWHVLRINKMLSCAGADRLQSGMRGAFGKSYGKAARVKIGSILYSVRIREADVKKALEAFRRAKNKFPGNQRIVVSNKWGFTKLTRLEYQKRAAEGTIINNGSDVKLVRAKGPLAASPLFAEAKAPSKK

SEQ ID NO: 12282 - protein, 574 aa, Trichodesmium erythraeum
MLETTKKKDVQVVIIGQDTKVLRSRTWDRLKFEVEYSLQKGTTANSYLIQGEKTAVIDPPGESFTQNYLESLQLRLDLHRLDYVILGHFNANRGGTLKELLAIAPSVTFVCSNPSVLNLKDYFKDEELKIKVVKGEDTLDLGSGHKLQLLTTPSPKWPDGLMTYDPQTQILFTDKFFGAHVCGDQVADEGWTIYSEDRRFYYDCLHAAQAKQVLSTLEKISELTVKLYAPGHGPLVRYGMMELTNLYRKWSQEQSSRDLNVVLLYASAYGNTAIVAQAIARGLTKAGVAVESINCEVATSNEIREVVEKCDGFIIGSPTLGGHAPTQIQTALGIVLNTASKDKLAGVFGSFGWSGEAIDFLESKLKDTGYKFGFEPIRVKFKPDDVMIQTCQEAGIDFAQALIKSQQRRSPKASVRGSGSDRTAQAVGRVVGSLCVMSAKRGDVTSAMLASWVSQASFNPPGVTVAVAKDRALESLTHTGDQFVLNILAEEKKNLQRHFIKTFTPGEDRFIGIQTKEANNGCPILEDALAYLECKVVKRMECGDHWLVYALVENGQLLNDGVTAVHFRKTGIHY

SEQ ID NO: 12283 - protein, 193 aa, Arabidopsis thaliana
  misc_feature (47)..(47): Xaa can be any naturally occurring amino acid
STASRALSQNGNIENPRPSKVQELSVYEINELDRHSPKILKNAFSLXFGLGDLVPFTNKLYTGDLKKRVGITAGLCVVIEHVPEKKGERFEATYSFYFGDYGHLSVQGPYLTYEDSFLAITGGAGIFEGAYGQVKLQQLVYPTKLFYTFYLKGLANDLPLELTGTPVPPSKDIEPAPEAKALEPSGVISNYTN

SEQ ID NO: 12284 - protein, 799 aa, Oryza sativa
MDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKVDCQLLRFTLPASNDIVEILKDRPSWFRDCRSLEVFTMFPAGNGGTIELVYMQMYAPTTLVPARDFWTLRYTTTMDDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVFAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 12285 - protein, 377 aa, Arabidopsis thaliana
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSKSERKSLAFFLCPKKDRVVTPPRELLDSITSRRYPDFTWSMFLEFTQKHYRADMNTLQAFSDWLTKPI

SEQ ID NO: 12286 - protein, 179 aa, Haemophilus influenzae
MKKHHVDVLISENDVHARIAELGAQITKFYQEKQIDSLVVVGLLRGSFMFMADIVRQINLPVEIEFMTTSSYGTGMTTNHDVRITKDLDGDIKGKHVLIVEDIIDTGYTLEKVRDILNLREPASLTICTLLDKPSRREVEVPVEWVGFEIPDEFVVGYGIDYAQRHRNLGYIGKVVLEE

SEQ ID NO: 12287 - protein, 530 aa, Euphorbia esula
METQLATKNPSSQPPPPPPELAAPPSSNLKKIVVVASIAAGVQFGWALQLSLLTPYVQLLGIPHTWAAFIWLCGPISGMLVQPIVGYHSDRCTSRFGRRRPFIAAGAASVAVAVFLIGYAADLGHMSGDSIGKSPKIRAIAIFVVGFWILDVANNMLQGPCRALLADLSGTSQKKTRLANALFSFFMAVGNILGYAAGAYTHLYKIAPFTLTKACDVYCANLKTCFFISIALLLVLTVIALTYVKEKQWSPEIAKTVAGVDGDDEDGPVEAAPLPFFGEIFAALKNLQRPMRILLLVTCLNWIAWFPFLLFDTDWMGREVYGGSSDSSATAGESKLYDRGVRAGALGLMLNSVVLGFTSLGVELMARKLGKVKRLWGIVNFLLAICLALTILITKLAESGRHYPTVNGVVSTTPSPPSSGIKAGALTLFAVMGIPQAITYSVPFALASIFSNDSGAGQGLSLGVLNLSIVIPQMLVSVASGPFDALFGGGNLPAFVVGAVAAAASGVLALTYLPSPPPDLPAKALTVGFH

SEQ ID NO: 12288 - protein, 162 aa, Triticum aestivum
LIVKGGRVGGVVTNWALVSMNHDTQSCMDPNVMEAKVVVSSCGHDGPFGATGVKRLQDIGMISDVPGMKALDMNTAEDEIVRLTREVVPGMIVTGMEVAEIDGAPRMGPTFGAMMISGQKAAHLALKALGRPNAVDGTIKVVSPALRQEFVIASKDDEVVDA

SEQ ID NO: 12289 - protein, 318 aa, Zea mays
  misc_feature (104)..(104): Xaa can be any naturally occurring amino acid
MACYNNTASLAATLLAFALMFQACVAGRRRLTALVQEPAITMKYHKAALLSGPIAVNFIWYGDFTAPQRAVITDFVSSLSAAPRAAAQSQPEPSVATWFKTARXYYASSKVPFPALRLGSHAVDRNCSLGRRLTERDLLRLAARGAPSRAINLVLTAADVAVDGFCESRCGTHGASPRSRSGRFAYAWVGNPASQCPGQCAWPFHQPVYGPQAAPLTPPNGDVGVDGMVISLASMLVGTVTNPFGNGFYYQEGSADAPLEAATACAGVYGKGAYPGYAGALLVDPASGASFNANGAHGRKYLVPALVDPDTSSCATLG

SEQ ID NO: 12290 - protein, 449 aa, Haemophilus influenzae
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMAELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALLEIKNVKRGRVKDYAELFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 12291 - protein, 180 aa, Ralstonia eutropha
MEHGLDTATLGGGCFWCLEAVYQQVNGVRAVESGYTGGHVSHPSYQQVSEGDTGHAEVIRVTFDPAVINYREIIEIFFAIHDPTTLNRQGNDVGPQYRSIIFTHSEAQRAVAEYVMRELVANKVFDAPIVTQIEPEQPYWRAEASHQNYFQEHPSQGYCAFVISPKVAKFRERFASKLRR

SEQ ID NO: 12292 - protein, 346 aa, Streptomyces cinnamonensis
MTTRPDTKTALSQKTALSQLLTEIEHRNPAQPEFHQAAREVLETLAPVIAARPEYAEAGLIERLCEPERQIVFRVPWQDDHGRVRVNRGFRVEFNSALGPYKGGLRFHPSVNLGVIKFLGFEQIFKNALTGLGIGGGKGGSDFDPRGRSDAEVMRFCQSFMTELYRHIGEHTDVPAGDIGVGGREIGYLFGQYRRITNRWEAGVLTGKGRNWGGSLIRPEATGYGNVLFAAAMLRERGETLEGRTAVVSGSGNVAIYTIQKLAALGANAVTCSDSSGYVVDEKGIDLDLLKQVKEVERARVDTYAQRRGASARFVPGRRVWEVPADIALPSATQNELDADDATALI

SEQ ID NO: 12293 - protein, 479 aa, Dechloromonas aromatica
MSTADIGVIGLGVMGVNLALNLSDQGFRLSVYNRTLAVTTEFVATHGLDRVIAAAGSPEELVSHLAPPRIILLMVTAGRAVDAVIGQLLPRLEPGDILIDGGNSNYRDSQRRCRELATQGIHFVGMGISGGEEGARHGPSLMPGGAAAAWPTIRDMFQSIAARVDDIPCCQWLGDGGAGHYVKMVHNGIEYGDMQLIAEVCHLMQHALGMSHDEMADTFAEWNAGRLESYLIDITSRILRQRDKDGSPLVDNILDRAGQKGTGVWTAQDALDHAVPLTLIGEAVHARMLSARKAERVAAAALLGSKPVAVAKTARADCLSALHDALYAAKLVSYAQGFMLMQAAAEAEGWVLPYGEIALLWRAGCIIRSRFLADIKASFSRTPVPPSLLQDPFFIAEIKAAEAGWRQAVMLAVGSGVAAPALSSALAFYDGYRCANGSANIIQAQRDFFGAHSYQRTDRDGSENFHTRWLGDGVEEQLP

SEQ ID NO: 12294 - protein, 151 aa, Arabidopsis thaliana
MAPKAGKKPAEKKPAEKAPAEEEKVAEKAPAEKKPKAGKKLPKEAVTGGVEKKKKRVKKSTETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 12295 - protein, 334 aa, Flavobacteria bacterium
MIVKLILYCKFHCIKQTIMSKNQFGKNGWTPDIIGSLKGKTYVITGTTSGTGLEAAKILLAKDAKVVMLNRNNTKAQDTIAKFKSELGNHIEVSNIQMDLAQLASVRKAAKQVLSTIPHIDALICNAAIAQVPKQVLTVDGFESQLGVNHYGNFLLQGLLFPLIDKSNGRIVTVGSEGYKMGIKTIKFDDMNWDNDYNPNTVYSQSKLAQIMSVYELQDRLKNAGKSNVKVYACHPGASRTSLIKTSGSLMTRFIWQMMKLSPFVQSAEKGSYPALMCATEPELDQKRYYGPTSGNYWKGPVGECNLEPHAKDKATMVKLWEVSEDATGFQWNL

SEQ ID NO: 12296 - protein, 107 aa, Oryza sativa
MTEKKNRREKKNPREAKITFEGLVMEALPNGMFRVRLENDTIILGYISGKIRSSSIRILMGDRVKIEVSRYDSSKGRIIYRLPHKDSKRTEDSKDTEDLKDTKDSKG

SEQ ID NO: 12297 - protein, 191 aa, Unknown
  Fragaria x ananassa
MASSTTNNPALDLDSDTPENPGHELAQFASGCFWGSELRFQRVVGVIKTEVGYSQGHVHDPNYRLVCSGTTNHSEVVRVQFDPQVCPYSDLLSVFWSRHDPTTLNRQGGDVGTQYRSGIYYYNEEQDCLAKKSKEAKQKEFKDKRVVTEILPAKRFYRAEEYHQQYLEKGGGNGNKQSAQKGCNDPIKCYG

SEQ ID NO: 12298 - protein, 73 aa, Sinningia cardinalis
ISGTNGEVMPGQWEFQVGPSVGIEAGDHIWCARYLLERITEQTGVVLSLDPKPIEGDWNGAGCHTNYSTKSMR

SEQ ID NO: 12299 - protein, 772 aa, Novosphingobium aromaticivorans
MFDVKTVSLEWGGKTLTLETGRIARQADGAVLATYGETVVLCAVTAAKSVKEGQDFFPLTVHYQEKYSAAGRIPGGFFKRERGATEKETLVSRLIDRPVRPLFPEGFYNEINVIAQVLSYDGETEPDIVAMIAASAALTISGVPFMGPIAAARVGFIEGEYVLNPKQDVALADGRLDLVVAATDTAVMMVESEAKELSEDEMLGAVLFAHDEIKKVIGAIIQLAEKAAKDPWDIDLSDNTADIKKKLKDLVGKDVAAAYKLTDKSARSNALNEARAKAKAAFAEEGAQTQMVAMKTMKKVEADIVRGAILKDGQRIDGRTTTQVRPIEAIVGFLPRTHGSSLFTRGETQAICTTTLGTKDAEQMIDGLEGLRYENFMLHYNFPPYSVGEVGRFGAPGRREVGHGKLAWRALHPVLPTKEEFPYTIRILSDITESNGSSSMATVCGGCLSMMDAGVPVKRPVSGIAMGLILEGDKFAVLSDILGDEDHLGDMDFKVAGTSEGITTMQMDIKVAGITREIFEVALRQASEGRAHILGEMTKALGEARTELSAHAPRIETLQIDKSKIRDVIGTGGKVIREIVATTGAKVDIDDEGLIKISSSDLTQIEAAKNWILGIVEEAEVGKIYKGKVVNIVDFGAFVNFMGGKDGLVHVSEMKNERVEKPTDVVKEGQDVYVKVLEIDQRGKVRLSMRVVDQETGAELEDTRPPREPREPRGDRGDRGDRGDRRGPRGDRGPRREGGDRGPRREGGDRPRRDRDDGPAPDHMPAFLKSDD

SEQ ID NO: 12300 - protein, 178 aa, Salmonella typhimurium
MKHTVEVMIPEAEIKARIAELGRQITERYKDSGSEMVLVGLLRGSFMFMADLCREVQVPHEVDFMTASSYGSGMSTTRDVKILKDLDEDIRGKDVLIVEDIIDSGNTLSKVREILGLREPKSLAICTLLDKPSRREVDVPVEFVGFSIPDEFVVGYGIDYAQRYRHLPYVGKVVLLDE

SEQ ID NO: 12301 - protein, 1256 aa, Streptococcus pneumoniae
MRKTPSHTEKKMVYSIRSLKNGTGSVLIGASLVLLAMATPTISSDESTPTTNEPNNRNTTTLAQPLTDTAADSGKNESDISSPRNANASLEKTEEKPATEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWHLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSHESTAEEKPDSTPSKPEHQDPAPEARPDSTKPDAKVADAENKPSQATADSQAEQPAQEAQASSVKEAVQNESVENSSKKNIPATPDRQAELPNTGIKNENKLLFAGISLLALLGLGFLLKNKKEN

SEQ ID NO: 12302 - protein, 584 aa, Clostridium thermocellum
MNTTMIVDTLWVVFAALLVFFMNLGFAAVESGFARSKNTVNILSKNFIVFAVSSLGFMLLGWGLMFGGDNPIIGTKELFILGGSDLGFYKDTLTSTVPFWGKFFFQLVFCGTAATIVSGAVAERIKYISFIVFSFILTLFIYPVVGHWIWGGGWLANLGFMDFAGDTVVHSVGGWAALTGAIILGPRHGKYDKDGKPKAIPGHSLALAVIGLFVLWLGWFGFNPGSTMSFQNPEDVVHIIVTTNTAAIAAILTATATSWIFIGKPDLGMTINGCLAGLVGITGSCAYVSVGSSLIIGAIAGIIVVFSVIFFDRIKVDDPVGATSVHLVCGVFGTLCVGLFAQEGVTSLSTVNGLFFGGGFSLLGAEIIGIIAVGAFVVASSALVWFILKKTIGIRVSLEEEIQGLDIGEHGNSAYPDFAIVAPITASGNGNGDSIVAISQVETIKPSSVKVTPEAAIPVVNRSHPGAKMTKVTVITNQDKYTQLQNALDKIGITGLTVTNVLGYGMQKGHTEYFRGLPVKTRLLPKVQVDIVVCKIPVETVVDTVKKALYTGNMGDGKIFIYDVENVIKIRTGEEGYDALQDEE

SEQ ID NO: 12303 - protein, 562 aa, Methanococcoides burtonii
MYCYQCEETINGQSCTKAGACGKTANVADLQDQLTYILKGIAYYNQKARENGIKDKNVDSFLMKALFSTVTNTNFSSSDFNKFINEGISLRESIKKNLTTRKINLGKTKDMSFGEKVKTTLGVSHPETRFTIPEAAIINTEALKTASVGVLNTQNEDIRSLRELLVYGLKGLAAYAHHAEVLGYTDETLSEFAEKALASTLDDSLSVDDLVGLVLECGKYGVNVMALLDKANTSTYGNPEPTEVFLGTRDNPGILISGHDLKDMEQLLKRTEGTGVDVYTHGEMLPANYYPAFKKYDHFVGNYGGSWWNQKNEFETFNGPILMTTNCLVPPKNSYINRVYTTSVVGFDGVKHIDAKEDGTKDFSAIVEQAIACQPPKQLEDGTIVGGFAHAAVLSVADKVIEAVKAGKITRFIVMAGCDGRHKERDYYTKFAEALPESAVILTAGCAKYRYNKLNLGDIDGIPRVLDAGQCNDSYSLVVIAQKLAEAFGLEDINDLPVSYNIAWYEQKAVLVLLALLHLGVKNITLGPTLPAFVSPNVLNVLVENFNIAPNTTVEEDLTRLL

SEQ ID NO: 12304 - protein, 293 aa, Rickettsiella grylli
MKKLTPLEAHVILSKGTEPPYSGKYVRFNKQGDYACKQCGSLLYHSSAKFDSGSGWPSFDDEITGAIKRVPDPDGHRTEIVCQRCGAHLGHVFQGERLTPKNIRHCVNSISLEFIPKEFNKKTLEKKEKEKAYKKETAIFAGGCFWGVEHLMKQLPGIISITSGYIGGHTSNPSYEEVCTRNTGHAEAVEIIFDPQKVSYETLAKHFFEIHDPEQLNQQGPDSGEQYRSEIFYTNPEQKEIALKLIKQLKNKGFQVVTTLTPATKFWKAEDYHQNYYEKTKKQPYCHFYTKKF

SEQ ID NO: 12305 - protein, 463 aa, Bacillus cereus
MENTLVKSLYRDTEKYADQTVQVSGWIRNLRDSKAFGFIELNDGSFFKSVQIVFDTELENFKEIAKLPLSSSVKVEGKVIATPGAKQPFEIKAEKIDIEGLSDSDYPLQKKRHTFEYLRTIAHLRPRTNAFSATFRVRSIAAFAIHQFFQERGFVHVHTPIITGSDTEGAGEMFRVTTQDLNNLPKGEDGKVDESKDFFGKETNLTVSGQLNAEAYALAFRDVYTFGPTFRAENSNTTRHAAEFWMVEPEIAFAELGDVMNLTEDMLKYAMKYVLEHAPEEMEFFNSFVDKTVLERMNNVINSDFGRITYTEAIKVLQESGADFKYPVEWGIDLQTEHERYLSEEIFKRPVFVTDYPKDIKAFYMRLNEDGKTVAATDLLVPGIGELIGGSQREERMDVLVDRIKELGMNEEDYWWYLELRKYGGTKHAGFGLGFERFLMYITGMANIRDVIPFPRTPGSSEF

SEQ ID NO: 12306 - protein, 119 aa, Zea mays
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVK

SEQ ID NO: 12307 - protein, 517 aa, Flaveria pringlei
MAMALALRRLSSSADKPLQRLFNGGHLYSMSSLPSEAVYEKERPGVTWPKQLNAPLEVVDPEIADIIELEKARQWKGLELIPSENFTSLSVMQAVGSVMTNKYSEGYPGARYYGGNEYIDMAETLCQKRALEAFRLDPAKWGVNVQPLSGSPANFHVYTALLKAHDRIMALDLPHGGHLSHGYQTDTKKISAVSIFFETMPYRLNESTGYIDYDQLEKSATLFRPKLIVAGASAYARLYDYARIRKVCDKQKAIMLADMAHISGLVAAGVIPSPFDYADVVTTTTHKSLRGPRGAMIFFRKGLKEVNKQGKEVFYDYEDKINQAVFPGLQGGPHNHTITGLAVALKQATTAEYKAYQEQVMSNSAKFAETLVKSGYELVSGGTENHLVLVNLKNKGIDGSKVEKVLEAVHIAANKNTVPGDVSAMVPGGIRMGTPALTSRGFVEEDFAKVAYFFDLAVKLAVKIKGEAKGTKLKDFVTAMESSAIQSEISKLRHDVEEYAKQFPTIGFEKETMKYKN

SEQ ID NO: 12308 - protein, 1120 aa, Pseudomonas syringae
MCAERRFRQPGNRRYYMKRMLINATQPEELRVALVDGQRLYDLDIESGAREQKKANIYKGRITRIEPSLEAAFVDFGSERHGFLPLKEISREYFKKAPEGRVNIKDVLSEGQEVIVQVEKEERGNKGAALTTFISLAGRYLVLMPNNPRAGGISRRIEGEERNELREALNGLIAPADMGLIVRTAGLGRSSEEMQWDLDYLLQLWTAIKEASLDRSAPFLIYQESNVIIRAIRDYLRQDIGEVLIDSIEAQEEALTFIRQVMPQYASKIKLYEDSVPLFNRFQIESQIETAFQRVVELPSGGSIVIDPTEALVSIDINSARATKGSDIEETALQTNLEAAEEIARQLRLRDIGGLIVIDFIDMTPAKNQRAVEEKVRESLEADRARVQIGRISRFGLLEMSRQRLRPSLGESSGIVCPRCNGTGIIRDVESLSLAILRLIEEEALKDRTAEVRAQVPIPVAAFLLNEKRNSITKIELRTRARIIILPNDQLETPHFEVQRLRDDSPEAHSSQTSYEIAAAAAEVEEIAPLAAATRTLVRQEAAVKTAPARANAPVPVEAAAPAPTPAPAPVAHEPSLFKGLVKSLVSLFATKEEPVAPVVVEKPVAEQRPARNEERRNGRQQSRGRNNRRDEERKPREERAPREERAERAPREERAPREERAPREERTVREPREAREESTPREERPARTTRERKPREAREDRPVRELREPLDAAPAVSLAREERPERAPREERQPRAPREERQPRAEQAAAAVSEEEEVLLNEEQTNNENQEGNDGSEGDRPRRRSRGQRRRSNRRERQRDANGNVIEGSEENGNEEEGSATDLSAGLGFTAAASAASSVISAPAEADAHQQAERANSNAATADAEPVHQETAAEAPVTETSVAETPATEAPVAEKAQTVAEPTVEAPAVEAPVADDAPVAQPAPEVEVQPAAVEAPAIAAQSELFEAPHAERVVPFKPTPEPAPQAPVEAAAHEEVPATESSELPTPAPAAVVEPVALQEEPAPYVAPQPVVEEQAPAPQEQAPAAEEAAPAPVVSSTGRAPNDPREVRRRKREEEARRQQEAAAASAPVVEAAPAAAEAESAQPSPAAEEKTEEAATEQPAVKPQHEAEKENEPKPLV

SEQ ID NO: 12309 - protein, 284 aa, Brassica napus
  misc_feature (185)..(185): Xaa can be any naturally occurring amino acid
  misc_feature (206)..(206): Xaa can be any naturally occurring amino acid
  misc_feature (222)..(222): Xaa can be any naturally occurring amino acid
  misc_feature (250)..(250): Xaa can be any naturally occurring amino acid
  misc_feature (279)..(279): Xaa can be any naturally occurring amino acid
QFRFLDKAAVIIEGDLTPEGVPANKWRLCSIQEVEEVKCLIRIVPVWSAGIISLAAMSQQGTFTVSQALKMDRHMGRNFEIPAGSLSVISLLTIGVFLPLYDRVLVPFLRRITGHKSGITLLQRIGTGIVFAILSMIVAGLVERKRRIRSINAGDPTGMTPMSVFWLSPQLVLMGLCEAFNIIGXQIEFFNSQFPEHMRSIANSLXFSLSFAGSNYLSSLLXVTTGPRFSPGGMTPGRDWLNKNLNAGKXLDYFYYLIAVWGVFNLVYFWYCARGYRYXVGLQM

SEQ ID NO: 12310 - protein, 517 aa, Flaveria pringlei
MAMASALRRLSSSSNKPLQRLFNGGHLYSMSSLPSEAVYEKERPGVTWPKQLNAPLEVGDPEIADIIELEKARQWKGLELILSENFTSLSVMQAVGSVMTNKYSEGYPGARYYGGNEYIDMAETLCQKRALEAFRLDAAKWGVNVQPLSGSPANFHVYTALLKAHDRIMALDLPHGGHLSHGYQTDTKKISAVSIFFETMPYRLNESTGYIDYDQLEKSATLFRPKLIVAGASAYARLYDYARIRKVCDKQKAILLADMAHISGLVAAGVIPSPFDYADVVTTTTHKSLRGPRGAMIFFRKGVKEVNKQGKEVLYDYEDKINQAVFPGLQGGPHNHTITGLAVALKQATTAEYKAYQEQVMSNCAKFAETLVKSGYELVSGGTENHLVLVNLKNKGIDGSRVEKVLEAVHIAANKNTVPGDVSAMVPGGIRMGTPALTSRGFVEEDFAKVAYLFDLAVKLAVKIKGEAQGTKLKDFVAAMQSSAFQSEISKLRHDVEEYAKQFPTIGFEKETMKYKN

SEQ ID NO: 12311 - protein, 951 aa, Photobacterium profundum
MKLTKRSDNVSKDENQLGISRRSFIRNTSLAAAGGVAGASMFAPGMMKKAEAKIVDPTSPIEIKRTICSHCSVGCGIYAEVQEGVWTGQEPAFDHPFNAGGHCAKGAALREHGHGAKRIKYPMKLVDGKWIKLSWEQALDEISKQVLKIREESGPDSVYWLGSAKHNNEQAYLFRKMVSMWGTNNVDHQARICHSTTVAGVANTWGYGAMTNSLNDMHNCKSILFIGSNPAEAHPVAMQHILIAKEKNSCKIIVADPRRTRTAAKSDHFVSLRPGSDVAFVWGVLYHIFKNGWEDKEFIRQRVYGMEDVRKEVAKWAPTEVERVSGVPEADVYETAKLLSENRPGCVVWCMGGTQHTTGNNNTRAYCILELALGNMGKSGGGANIFRGHDNVQGATDFGVLSDNLPGYYGLSEGAWKHWAGVWDVDYEWLKGRFDQADYRGKKPMNHAGIPVSRWIDGVLENKDNIEQNDNIRAMFYWGHAVNSQTRGPEMRTAMGKLDMMVIVDPYPGVAAVMNGRTDNVYLLPATTQFETTGSVTATNRSIQWRDQVIEPLFESKPDHEIMFRLSQKLGLSDQLFKNIKVENNIPVIEDITREYNKGMWTIGYTGQSPERLKAHQKNWHTFHKTTLEAEGGVADGETYGLPWPCWGTPEMKHPGTHILYDTSKTVAQGGGNFRARFGVEREGESLLAVDSYSLGCELEGGFPEFTDKLLKQLGWWDDLTDAEKVKADGKNWKTDLSGGIQRVAIKHGCIPFGNAKARAVVWTFPDAVPLHREPLYTPRRDLVADYPTWNDSEAMFRLPTFYKSIQDKDVSGEYPMILTSGRLVEYEGGGDETRSNPWLAELQQEMFVEVNPKDANDLGFRDGDMVWVEGAEKGRIHVKAMVTRRVKPGLAFLPFHFGGYFEGEDLRGNYPEGSAPYVSGESANIATTYGYDPVTQMQETKVTLCKISKA

SEQ ID NO: 12312 - protein, 463 aa, Methanocaldococcus jannaschii
MVNRKPNNPNKNGEEMRAIIIGSGAAGLTTASTIRKYNKDMEIVVITKEKEIAYSPCAIPYVIEGAIKSFDDIIMHTPEDYKRERNIDILTETTVIDVDSKNNKIKCVDKDGNEFEMNYDYLVLATGAEPFIPPIEGKDLDGVFKVRTIEDGRAILKYIEENGCKKVAVVGAGAIGLEMAYGLKCRGLDVLVVEMAPQVLPRFLDPDMAEIVQKYLEKEGIKVMLSKPLEKIVGKEKVEAVYVDGKLYDVDMVIMATGVRPNIELAKKAGCKIGKFAIEVNEKMQTSIPNIYAVGDCVEVIDFITGEKTLSPFGTAAVRQGKVAGKNIAGVEAKFYPVLNSAVSKIGDLEIGGTGLTAFSANLKRIPIVIGRAKALTRARYYPGGKEIEIKMIFNEDGKVVGCQIVGGERVAERIDAMSIAIFKKVSAEELANMEFCYAPPVSMVHEPLSLAAEDALKKLSNK

SEQ ID NO: 12313 - protein, 468 aa, Staphylococcus aureus
MTQQIGVIGLAVMGKNLAWNIESHGYSVSVFNRSSEKTDLMVEESKGKNIHPTYSLEEFVNSLEKPRKILLMVQAGKATDATIDSLLPLLDDGDILIDGGNTNYQDTIRRNKALAQSAINFIGMGVSGGEIGALTGPSLMPGGQEEAYNKVADILDAIAAKAKDGASCVTYIGPNGAGHYVKMVHNGIEYADMQLIAESYAMMKELLGMSHEDIAQTFKDWNAGELESYLIEITGDIFMKLDENKEALVEKILDTAGQKGTGKWTSINALELGIPLTIITESVFARFISSIKEERVNASKELNGPKASFDGDKKDFLEKIRKALYMSKICSYAQGFAQMRKASEDNEWNLKLGDLAMIWREGCIIRAQFLQKIKDAYDNNPGLQNLLLDPYFKNIVTEYQDALRDVVATGVQNGVPTPGFSSSINYYDSYRAADLPANLIQAQRDYFGAHTYERKDKEGVFHTQWIEE

SEQ ID NO: 12314 - protein, 389 aa, Cyanidioschyzon merolae
MLVSNAMYVLVPCSLKAAQATLRNRKKNSTFVRAKPEQTRILGYARRSPRARQRVQLALTAPPSVALARDVSDLVGNTPIVELKKIPEEEGVQAHILCKLESMEPCSSVKDRIGKYMIVEAEKRGDIQPGKTVLIEPTSGNTGIALAYLAAARGYRLILTMPDSMSIERRMVLRAFGAEVVLTPAAKGMKGAVAKAEQLFHTTPNAYMLQQFNNPDNPKAHYETTGPEIWAATGGKVDAFVAGVGTGGTVTGAGRYLREQNPHVYIMAVEPAESPVLSGGRPGPHKIQGIGAGFVPGILDTKIYNEVKQVTSMDSIEMARRLAVEEGLLCGISSGAAVVAALELGRRPEMKGKNIVVIIPSFGERYLTSALFDKQREEAYNMVAVEVET

SEQ ID NO: 12315 - protein, 450 aa, Listeria monocytogenes
MTHIKFDYSKALRFFEERELDYLEPAVKAAHDSLHNGTGAGNDALGWINLPTDYDKEEFARIKKATEKIHSDSDVLIVIGIGGSYLGARAAIETLNHSFYNVLEKGARKTPQVFFAGNSISSSYLHDLIEVVGDRDFSVNVISKSGTTTEPAIAFRVFKELLIKKYGEEGAKKRIYATTDKAKGALKTLADNEGYETFVVPDDVGGRFSVLTAVGLLPIAVSGVDIDALMNGAAAASKDFDKPELKNNIAYQYAAARNVLYRKGKVTELLISYEPGLQYFNEWWKQLFGESEGKDKKGIYPSSANFSTDLHSIGQYIQDGRRNLFETVIKVDKPRHNLTINKEDVDLDGLNYLAGETVDFVNTKAFEGTLLAHTDGEVPNFVVEVPELDAYTFGYLVYFFEKAVAISGYLNGVNPFDQPGVEAYKANMFALLGKPGFEDKKAELEKRLND

SEQ ID NO: 12316 - protein, 154 aa, Oryza sativa
RAAGSWLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRHLPFLALMKLAGKNSHHIIEATFKAFARALRQATEYDLRRRGT

SEQ ID NO: 12317 - protein, 427 aa, Unknown
  Synechocystis sp. PCC 6803
MNQTNLDFLATSDPALAAIIDRELQRQRTHIELIASENFTSAAVMAAQGSVLTNKYAEGLPGKRYYGGCEFVDQAETLAISRVKELFGAAHANVQPHSGAQANFAVFLTLLQPGDTIMGMDLSHGGHLTHGSPVNVSGKWFEVAHYGVEKETGRLDYDKIRQQALEVKPKLLICGYSAYPRQIEFDKFRAIADEVGAYLMADIAHIAGLVASGHHPSPLPYCDVVTTTTHKTLRGPRGGLIMTNNEELGKKFDKSVFPGTQGGPLEHVITAKAVAFGEALKPEFKVYSGQVIANAQAMADQLQKRGFDLVSGGTDNHLMLVDLRSIAMTGKVGDQLLGEINITANKNTVPFDPESPFVTSGLRLGSPAMTTRGMQEDEFRTIANIIADRLLSPEDEGVKADCLRRVSELCAGFPLYDHLRIPVAVIA

SEQ ID NO: 12318 - protein, 314 aa, Glycine max
MAEHLASIFGTEKDRVNCPFYFKIGACRHGDRCSRLHTKPTISPTLVLSNMYQRPDMNMNIITNPDQPQPQSLDPDKVQDHFDDFYEDLFEELSKYGPIQSLNICDNLADHMVGNVYVQFREEDHAANALMNLTGRFYSGRPIIVDFSPVTDFREATCRQYEENVCNRGGYCNFMHLKKISRDLRRKLFGRNRRWNGRSGSRSKSPPRNRNHGEHLHSGRGSGRRDFDRSHGHHGRRPRSRSPRYRGKRSRSPVGRDRSPPIRENSAERRAKIEQWNREKEQGETSNKNNTKSNDDYQEQSVAQNGSESGNHQI

SEQ ID NO: 12319 - protein, 242 aa, Porphyra yezoensis
MVSDLEKAVRADLQALIKEKNCHGIMVRVAWHDAGTYSKEDGTGGANGTQRFAPESGHGANAGLDIARNMCEDIKAKHPEISYADLYQLASVVAIEDAGGPVIPFRMGRKDADAPQCTPDGRLPDADKRMPHLRDIFYRMGFNDAEIVALSGAHTLGAAHKDRSGFDGPWTSNPNTFDNSYFKEIMKETPESGLLHLPSDKALLDEPECKALVETYASDQAKFFEDYAKAHQKLSELGAVWA

SEQ ID NO: 12320 - protein, 243 aa, Unknown
  marine gamma proteobacterium HTCC2080
MGGGSLNFHLKQSLLSGHMSLFDIRRKRALPTAETALGGRTAAMSVTNNHVVSGHPICPPFPDHLAVAMFGMGCFWGVEKKFWQAHGVFTTAVGYAAGVTPNPNYKEVCSGQTGHNEVVLVVFDPEQVSYHALLSLFWEGHNPTQGMRQGNDLGTQYRSGIYCFDQDQRVAAIGSRDRYQQGLTASGFGEITTEICDAPIFYYAEDYHQQYLHKNPAGYCGLGGTGVVCPVGTGVNESLPQSG

SEQ ID NO: 12321 - protein, 531 aa, Picea abies
MWDLNHIPEATKEPQVVVPMEAACSAEGNLSVGNANFRDENVSGSSSSSSVAIANTAMSVDCEEHSMSRACPSEQAEMNARSSQENGNGLGSEAQVQTGKLFGFSFSNIVKGNCTEASSGVSNGRSGCTNRVTRQFFPHGREFESQVMIPGRPQLPRAHWVGLTFRQAESFRSPTPKEATQPIKKSRRGPRSRSSQYRGVTFYRRTGRWESHIWDCGKQVYLGGFDTAHAAARAYDRAAIKFRGVDADINFNIDDYEDDVKQMSKLTKEEFVHVLRRQSTGFPRGSSKFRGVTLHKCGRWEARMGQFLGKKYVYLGLFDNEVEAARAYDKAAIRCNGKEAVTNFSPELYESELALTEDKGHDPDLDLSLGNSVPKDGSLVSKDNNDGPMRSESDLCTLSEPDWKTSCLIKPTVPNLLDGLNQSAQSLSCEVPSLQRYQQSPGWVWQLPTNRPAAPHPPPMIESAASSGFSPQIYSSTTSPSPEWLQKRGFHFLFQPALMQTKNILHSPTAPALINTYGKKPSDHSLNLSLG

SEQ ID NO: 12322 - protein, 633 aa, Picea abies
MMTVDTSSIEPVGKIAPRSSEETESVCVEAAAATVTHIQSNNETRRRAPFRSEMTESGTSISSVVNSIACNENINSLEHEASSKAVELDGDVLSSNSTQVPRSNEGNHKIFGFSLKIETQNLTSRGNLLNVKANDEQQKDPACVTRHFFPLHNGQPSEVLMPTECTGGNPFTESHWTTVTSRLPESTEPRKKQAENNKPIKKSRRGPRSRSSQYRGVTFYRRTGRWESHIWDCGKQVYLGGFDTAHAAARAYDRAAIKFRGVDADINFTLTDYQEDLDQTSKLSKEEFVHILRRQSTGFSRGSSKYRGVTLHKCGRWEARMGQFLGKKYIYLGLFDSEEDAARAYDKAAIRCNGKDAVTNFDPSSYENEILEEGRESQTSTGFDQNLDLSLGIGHVTTQLKISPSYKSRVEEDSQLNRIEAVTYSNLSQDSKILSCLTSKGAENAVPEFQSLPRGHAVYWNSQTLQVPDAMKHKQSHTREDNAYEQTAISGSQLYPDHLSNCKRLNMEGLKEQSLGVPSSTVSFWPMKQQSGWTWQLHASGPTTPVFTTNRSPASGFSPQIHTAFVPSTHGCHKMGVHWAAQSTDPCMVQTPSPHLATRLTSGPDSGDHPVGLTLDLPGKKIKRSSVQRDKVD

SEQ ID NO: 12323 - protein, 982 aa, Oryza sativa
MSMAVASLRLLARGGRRRARFPAPLSVPGGRAAFLSGAAEEVAQADAPPPPPPGRKVLESFREEFEIGGRVISFETGKMARFANGSVVISMDDTHVLSTVAAAKSSEPVRDFLPLTVDYQEKQYAQGVIPTTYMRREGAPKERELLCGRIIDRPIRPLFPPGFYHEVQVMNATIIMVNVISSDGKQDPDVMAANASSAALMLSDIPWNGPIGVIRVGRIDGNFVLNPTVDELGLSDLNLVYACSRDKTLMIDVQAREITERDLQAGMKLAHAEAVKCINPQLRLAKRAGKKKKEYKISLISDKSYEKIRTLSEAPIEEVFTDSTYGKFERGEALENITQSVKAKLEEECDEDSLKFLHKAVDTVRKQVIRKRIIEKGLRVDGRQLDEVRPLYCESSTYPILHGSALFSRGDTQVLCTVTLGAPGDAQRLDSIVGPPTKRFMLHYSFPPFSINEVAKRGGLNRREVGHGTLAEKALLAVLPPEGEFPYTVRVNSEVMASDGSTSMASVCGGSMALMDAGIPVREHVAGVSVGLVSEVDQTTGDISSYRILTDILGLEDHLGDMDFKIAGTRRGITAIQLDIKPAGIPLDIICESLEPARKARNQILDRMDQEISSARAFNDGSSPRLATLSFSSDSLRKLLFHRKKIEQETGARVSVSDGTVTIVAKTQPIMDKAIEKVEFLVGREIEVGRTYKGVVSSIKEYGAFVEFNGGQQGLLHISELSHDKVSKVSDVVSVGQVLSLTCIGQDLRGNIKLSLKATLPHAHEKKDLASNHTDPLPSQEVVGWTAVENMPSKDANAEPSISKDEDNMIEETPGCSTPAVIIRSAAECDAQDVTNDPKKKRPKVAKSSPKLSKPASERQEVKRTSAKKTSGASTTAKKNKKEKADSSNDVLDAIPEQNKSNIMNYSSPSNFRSGSMKLGDVVTAKVYQIRAYGLVLELSDGVRGMHKFAENGHKDFEVGEELLVKCSSFNAKGIPVFSLLD

SEQ ID NO: 12324 - protein, 93 aa, Bacillus halodurans
MEDTVAGMSWVMALNILAVAAGAPPLLSALLLGFFSNLFSCTIHYGSGPAPVFFGTGYVDQKKWWSIGFFISIIHIVVWLGIGGAWWKVLGLW

SEQ ID NO: 12325 - protein, 828 aa, Erwinia carotovora
MKLSRRHFMKANAVAAAAAVAGITIPIAVRAATEQSDAIHWDKAPCRFCGVGCGVLVGTQNGRIVASQGDPEAPVNRGLNCIKGYFLPKIMYGQDRLTQPLLRMRNGQFDKEGEFTPISWDKAFDIMAEKFKTALKEKGPNAIGMFGSGQSTIWEGYASAKLFKAGFRSNNIDPNARHCMASAVVGFMRTFGMDEPMGCYDDIEQTDAFVLWGSNMAEMHPILWSRITDRRLSNSNVTVAVLSTYQHRSFELADNGMVFTPQTDLAILNYIANYIIQNNAVNEAFFTRHVNLRRGVTDIGYGLRPTHPLEKAAKNPGSDASEPMSFEEYKAFVADYTLEKTVAISGVPADQLEALAKLYADPKKKVISYWTMGFNQHTRGVWANNLVYNIHLLTGKISQPGCGPFSLTGQPSACGTAREVGTFAHRLPADMVVTNEKHRAIAEKLWQLPTGTIPEKIGLHAVAQDRALKDGTLNAYWVMCNNNMQAGPNINQERMPGWRDPRNFIVVSDPYPTISALAADLILPTAMWVEKEGAYGNAERRTQFWRQQVKAPGESKSDLWQVVSFAKRFTVEDVWPEELLAQKPAYRGKTLYDVLFANDVTTRFPLSELAENQLNDESREFGFYLQKGLFEEYAAFGRGHGHDLAPFDAYHKVRGLRWPVVDGKETQWRYSEGHDPYVKAGEAYRFYGKPDGKAVIFALPYEPAAEAPDEEYDLWFSTGRVLEHWHTGSMTRRVPELHRAFPEAVLFIHPQDAKARDLRRGEKVRIISRRGEVISVVETRGRNKPPRGLVYMPFFDAAQMTNVLTLDATDPLSKETDFKKCAVKLAKV

SEQ ID NO: 12326 - protein, 516 aa, Arabidopsis thaliana
MGNCLKPLKEQPPSASPKPLTIPSSSVEPVKENLKEFRFAELNKATKRFRKYMVIKGNDNGFTRTFYEGCINETTFAPSRTGITVSVMECYQDNSQTLQDWKLLMHLMGTKTIELQEEVKSLGRISHPNLVKLLGYCCEENKSFLVFEYLHKGSLNRYIFGKEEEALPWETRVKIAIGAAQSIAFLHWVKNSALYRELRMYNILLDEHYNTKLFYLGSKKLCLLEESVTTAFIGRTVYIPPEYVISGHLGTKSDVYTFGVILLEILTGLKASDGKKNENMQSLHVWTKPFLSDQSKIREIIDPRLGNDYPVNAATQMGKLIKRCIKLDTRKRPSMQQVFDEEEEALPWEIRVKIAIGTAQGLAFLHSIKNSPLNRELRMHNIMLDEVKLISKFGFHQQYNAKTVLSRTNQTKLGILDMTTDVYIFGMILLELLMGSKDRKKIKEEQGLVDYWTSSFLPDNYKIEEIIDPRLGSDYSANAATQMGTLINRCTAHNTKKRPLMQQVLDGLNHIAEIKD

SEQ ID NO: 12327 - protein, 252 aa, Zea mays
MISPDTIRTAIGVIGNGTALVLFLSPVPTFIRIWKKGSVEQYSPIPYVATLLNCMMWVLYGLPAVHPHSMLVITINGTGMAIQLTYVALFLLYSAGAARREVVLLLAAEVGFVGAVAALVLSLAHTHERRSMVVGILCVLFGTGMYAAPLSVMKMVIQTKSVEYMPLFLSLASLVNGICWTAYALIRFDLYITIPNGLGVLFAVAQLVLYAIYYKSTQEIIEARKRKADQIAMTGVVVDGGKTNNQAGAGQY

SEQ ID NO: 12328 - protein, 359 aa, Unknown
  Azoarcus sp. EbN1
MTPRTPKFHPLKVTEVRRETPESVSLCFEVPAELADDYRFVQGQHLNLKVRVGDEEMRRSYSICAGVDDEELRVAIKKIAGGAFSTWVNDNGIKVGDVLDVMTPEGRFHTPLDPVHAKHYVAFAAGSGITPILSLIKTTLRAEPKSRFTLVYGNRRQGSVMFAEALEDLKNRYLSRFTLYNLFSREEQEVPLFNGRLDAARVAAFLDTLIPVDTIDEAFICGPGGMIDEVEAALHKGGVAHEHIHLERFGVPASAPEHHVEPGDAAQAKVTVIADGLRREMEFRAEDTSILDVALAAGMDLPYSCKGGVCCTCRAKVIEGKVRMDKNFTLEQPDIDAGYILTCQAHPLTERVVITFDER

SEQ ID NO: 12329 - protein, 58 aa, Allium cepa
RISGLIYEETRGVLKIFLENVIRDAVTYTEHARRKTVTAMDVVYALKRQGRTLYGFGG

SEQ ID NO: 12330 - protein, 379 aa, Anaplasma marginale
MSGNDYYEILEVSRNASAEEIKKSYRKMVFKYHPDKNPGDKKAEEKFKKISEAYEVLSNPEKRAAYDRYGHSTFTSGGASGFDFTSGFSTDFSDIFQDFFGGGFGKSQRASSREHLRGSDLRYDVEVSLEDAFKGIKVPISYVTNVKCSSCSGIGSEGAVNSVKCGNCNGAGSVRTRKGFLTIEEVCNVCNGEGEVIKNKCRRCGGSGRVRNEVSLLVTVPKGIETGNKVRVNGKGEAGFRGAQEGDLYVYIRVKEHKFFTRRSSDLHCSVPIKMTIAALGGEIEMPSIDGSWTKLKIPEGTQSGDQIRMRGKGMPEVNSKDRRGDMYVHVTVETPVKLTKQQVDLLKKFEEESSANCSPKYQGFFQKIKDIWRDISSG

SEQ ID NO: 12331 - protein, 139 aa, Allium cepa
  misc_feature (102)..(102): Xaa can be any naturally occurring amino acid
  misc_feature (105)..(105): Xaa can be any naturally occurring amino acid
  misc_feature (108)..(108): Xaa can be any naturally occurring amino acid
  misc_feature (111)..(111): Xaa can be any naturally occurring amino acid
  misc_feature (114)..(114): Xaa can be any naturally occurring amino acid
KKPAEKKPAAEKPEEEKKTAAEKTPAGKKPRAEKKLPAKDSSASADKKKKRKAKSIETYKIYIFKVLKQVHPDIGISGKAMGNYDSFINGIFEKLAQDFLRXGRXNRXPPXFGXFRIFVVLPGGFPNSFFVVLPGGFQS

SEQ ID NO: 12332 - protein, 73 aa, Sinningia barbata
  misc_feature (25)..(25): Xaa can be any naturally occurring amino acid
  misc_feature (38)..(38): Xaa can be any naturally occurring amino acid
  misc_feature (41)..(41): Xaa can be any naturally occurring amino acid
  misc_feature (50)..(50): Xaa can be any naturally occurring amino acid
  misc_feature (52)..(52): Xaa can be any naturally occurring amino acid
  misc_feature (54)..(54): Xaa can be any naturally occurring amino acid
  misc_feature (57)..(57): Xaa can be any naturally occurring amino acid
  misc_feature (64)..(64): Xaa can be any naturally occurring amino acid
  misc_feature (67)..(67): Xaa can be any naturally occurring amino acid
ISGTNGEVMPGQWEFQVGPSVGIEXGDHIWCARYLLEXITXQAGVVLSLXPXPXEGXWNGAECXTNXSTKSMR

SEQ ID NO: 12333 - protein, 297 aa, Saccharomyces cerevisiae
MKTTTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 12334 - protein, 832 aa, Rhodobacter sphaeroides
MNIVLLVTALAVLFIVIAACEPVAARLRLPYSVVLAVVGAMLGTLALWLQRSGVAASFPPEVADLLALPIRSSVFLYIFLPTLLFQVSLSLNIRRMIDDWVPILVMAVVAVLVSTLAIGFALQPFSSMSLAACLLLGSIVSTTDPSAVVSIFRSIAAPQRLTRIVEGESLLNDAAAIALFGFFLTFVMAGVPDPTLRQALVEFPLLILGGLGLGYLMARIALFLMTRMASHPTAQLSLSLALPYLTYVLAEQGFHASGVIAVVTAGIAMNLTGPGRLSPATWKLLSDIWEMLSHWAGSLIFIVAALLIPRLIGRATGWDLLLIGVVALAAVVARGVMLSGLLPLLTRFNLSPRVERPYRVAILWGGLRGAVTLALALAVTENPMVPPHVKREVGILATGFVLFTLLAQGTTLRWVIRRLGLARLTPLDLALSNQVIAVALQNVREGVAETVRERELDPQIVRSEAKGFGQRLARAVELADDSADDIPDRDRITLGLVALAGRERDAILAAFRQQIISPRLAEAMLVDVDRLIERTRLQGRDGYRAAGRRALGLGRQHRIAVWAHNRLKITRWLSQLTSDRFEMLLTQRLILGDLHGLIDGKIRRIHGRRVAEILHEMLKRREEETEQALEALRLQYPGYSEEMVRSFIRRTALQLELREYEMLHDDGLIGQELFMTLRQRIQVARGKKERRPHLDLAVQKVELVRQFPLFAEMEEDQLRALERLLQTVYVRPGDVLLRRGDVPRKVFFIASGAVESDVAGQKVRLGRGEMFGQLAILTRKTRKAQVTAISHGTLLSLDEARFLELLRRNRTLQEAAVESAARRNVTIDLSAI

SEQ ID NO: 12335 - protein, 196 aa, Triticum aestivum
  misc_feature (155)..(155): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQADYLIRSKWVPCLEFSKVGFIFREHNASPGYYDGRYWTMWKLPMFGCTDATQVINEVEEVKKEYPDAYVRIIGFNNMPXGQCFSFIPFNPPGLQGARQGPKQLPHEEAIIKRRLCSFGPI

SEQ ID NO: 12336 - protein, 297 aa, Saccharomyces cerevisiae
MKTTTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTEYSLIQDPKYLSIVKEYANDQDKFFKDFSKAFEKLLENGITFPKDAPSPFIFKTLEEQGL

SEQ ID NO: 12337 - protein, 597 aa, Oryza sativa
MDTTIGSVPTASDAAAPPPAPAAATAPREATLGRHLARRLAEVGARDVFTVPGDFNLTLLDELEAEAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLEAAVETAAAFLNKAVKPVLVGGPKMRVAKACKSFVELADACGYPVAVMPSAKGLVPEHHPRFIGTYWGAVSTPFCAEIVESADAYLFAGPIFNDYSSVGYSLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAQAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 12338 - protein, 297 aa, Saccharomyces cerevisiae
MKTTTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTAYSLIQDPKYLSIVKEYANDQDKFFKDFSKAFEKLLENGITFPKDAPSPFIFKTLEEQGL

SEQ ID NO: 12339 - protein, 73 aa, Sinningia tuberosa
ISGTNGEVMPGQWKFQVGPSVGIEAGDHIWCARYLLERITEQAGVVLSLDPKPIEGDWNGAGCHTNYSTKSMR

SEQ ID NO: 12340 - protein, 481 aa, Triticum aestivum
  misc_feature (153)..(153): Xaa can be any naturally occurring amino acid
  misc_feature (177)..(177): Xaa can be any naturally occurring amino acid
  misc_feature (292)..(292): Xaa can be any naturally occurring amino acid
  misc_feature (308)..(308): Xaa can be any naturally occurring amino acid
MALTRIGLAGLAVMGQNLALNIAEKGFPISVYNRPSSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYXYIEDILLKVSAQVPDSGPCVTYIXGKGGSGNFVKMVHNGIEYGDMQLIAEAYDVLKSVGKLTNGELQQVFTEWNKGELLSFLVEITADIFSIKDDQGEGYLVDKVLDKTGMKGTGKWTVQQAAELSVAAPTIEASLDSXRFLSGLKDERVAASKXFQGDYSSGETVDKAQLIEDVRKALYASKICSYAQGMNIIKAKSTEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 12341 - protein, 322 aa, Vibrio vulnificus
MSKIYEDNSLTIGNTPLVRLNKVSNGKVLAKIEARNPSFSVKCRIGANMIWEAEKEGKLKPGVELVEPTSGNTGIALAFVAAARGYKLTLTMPESMSLERRKLLKALGANLELTEAAKGMKGAIAKAEEIVASNPEKYLLLQQFNNPANPEIHEKTTGPEIWEATDGAIDVFVAGVGTGGTITGTSRYIKGEKGKQILSVAVEPTESPVISQALAGEEIKPAPHKIQGIGAGFIPGNLDLSLIDRVEKVTSEEAIEMARRLMEEEGILAGISSGAAVVAANRLAELPEFEGKTIVTVLPSSGERYLSTALFAGIFTEKENQQ

SEQ ID NO: 12342 - protein, 173 aa, Psychrobacter arcticus
MQTIILGGGCFWCTESVFLSVKGVESVISGYMGGNAVSANYEAVCGGDTGHIEVIKVKFNESTVPLEVILDVFFATHDPTTMDRQANDVGSQYRSVVFYTDETQKPTVDRTINKLRDMGINIVTEVHPAVEFYQAEDTHQDFFNRNPGQAYCNFAIPPKLAKLRKEFSQYMVS

SEQ ID NO: 12343 - protein, 257 aa, Unknown
  Synechococcus sp. WH 7805
MMQRSNSLDPISLDGWRWEPFLMEAVSGLKSLNPKPYPVEPVFLDQRDSVGSASRPVQAHTQVWACSTDKCRQIRAACVEAGSAASVLNLVINPRTSYDLPFFGADLVTLPNGHLIALDLQPALKTDRLHTEAVWEQLTPIFQRWRDRLPGGGPIPEEAEPFFSPCFLWTRLPLGPEGDALIKDVVFPAYLDYLTLYLDLMKNADPVSNERESRLLDGQRRYTTYRAEKDPARGMLGRFHGKEWTERLIHEVLFDLH

SEQ ID NO: 12344 - protein, 417 aa, Colwellia psychrerythraea
MFYKNDQIAGFDDSIWQAMEQEDKRQQDHVELIASENYTSARVMQAQGSQLTNKYAEGYPGKRYYGGCEHVDVIEQLAIDRAKELFGADYANVQPHSGSQANAAVFMALLKPGETVLGMSLAHGGHLTHGSKVSFSGKIYNAVQYGLNEATGEIDYEEVERLAKEHQPKMIIAGFSAYSRVVDWQRFRDIADSIGAWLFVDMAHVAGLVAAGLYPNPVPIADVVTTTTHKTLRGPRGGLILAKQNDELAKKLNSAVFPAGQGGPLMHVIAAKAICFKEALGEGYVEYQQQVIDNAREMAKTFQTRGYNVVSGGTDNHLFLLDLIDKGITGKDADAALGRANITVNKNSVPNDPQSPFVTSGLRIGTPAITSRGFGLEEAAALTGWICDVLDDISNEQVIDDVRSKVLDLCEKNPVYR

SEQ ID NO: 12345 - protein, 382 aa, Cryptococcus neoformans
MSAPESSPSTFYTVPTKHILSKAHLAAFQRSKTHSDIFNFIEELNEDIVGKKLTEAGQGSERTRPLISILDSVREIAESTPPVDNKLSRFGNPAFKTFYDKVGDASLELHKRIPGLPEEAIQEVEVYFKESWGNKQRVDYGSGMELNFLSWLLCLAKLGVVTKEDYPFLVLGVFWRYIEVMRYLQSTYWLEPAGSHGVWGLDDYHFLPFLWGSGQLRNHKYLRPKAIHDPEILGEFSKDYMYLSCIEFINSIKTASLRWHSPMLDDISAVKTWEKVNQGMKKMFVAEVLGKLPVMQHALFGSLLPFPTPEEDPELKRALEEEDGQSATDMHGHIHDPSEKGWSMDCCGIPVPSAFAAAQDANSHKGVPTLGNRPGIKPIPFD

SEQ ID NO: 12346 - protein, 240 aa, Zea mays
EYLAPRSYGPPPAPPPHPCLSASGSPPPLSRPPRPQFDPNFAWHQAKPLPPCCVKARAAAPESEAKCHATVVSGWFTETRSRCGKASKLQYYNNPMWPGETHSLKVDKILYQGKSPYQEVLIFESLTYGKVLVLDGIVQLTDKDECAYQEMITHLPLCSIPSPKKVLVIGGGDGGVLREIARHGSVESIDICEIDQLVIDVCKDFFPDLSVGFEDPRVRLHVGDAVEFLRNSPEGTYDAI

SEQ ID NO: 12347 - protein, 217 aa, Corynebacterium efficiens
MAFFFRPEPKMVTPEEALKGGRHPVLESPQPHTVLGTPITGPWKEGQKRVWIGLGCFWGVEQMYWKMDGVESTSVGYAGGYTPNPTYREVCSGRTGHTEIVEVVYDPEKITLAELVARGLEAHDPTQGYRQGNDVGTQYRSAFYVETGEEAETVRQIVSTYGETLKSHGFGEITTEVDVITPADYYLAEDYHQQYLHKNPDGYCPHHSTGIPCGVEA

SEQ ID NO: 12348 - protein, 432 aa, Zea mays
MGLSTVYSPAGPRLVPAPLGRCRSAQPRRPRRAPLATVRCSVDATKQAQDGVATAVATEAPASRKECFGVFCTTYDLKAEDKTKSWRKLVNVAVSGAAGMISNHLLFKLASGEVFGQDQPIALKLLGSERSFQALEGVAMELEDSLYPLLREVSIGIDPYVVFQDVDWALLIGAKPRGPGMERAALLDINGQIFADQGKALNAVASRNDEVLVVGNPCNTNALICLKNAPNIPAKNFHALTRLDENRAKCQLALKAGVFYDKVSNVTIWGNHSTTQVPDFLNAKIDGRPVKEVIKDTKWLEEEFTLTVQKRGGVLIQKWGRSSAASTAVSIVDAIRSLVTPTPEGDWFSTGVYTTGNPYGIAEDIVFSMPCRSKGDGDYELASDVLMDDFLWERIKKSEAELLAEKKCVAHLTGEGNAFCDLPEDTMLPGEV

SEQ ID NO: 12349 - protein, 339 aa, Cytophaga hutchinsonii
MAKVKSKLEYIWLDGYKPTQSLRSKTKIEENFSGKLEDLSNWSFDGSSTEQAKGGSSDCLLKPVFVCPDPQRKNGYLVMCEVLNADGTPHPTNGRAQIEDDDNDFWFGFEQEYFLYDLSTNMPLGFPAGGYPKPQGPYYCSVGAQNAYGREIIEEHLDVCLDAGLNVEGINAEVAAGQWEFQIFAKGAKRAGDEIWVARYLLERIGEKYGVYVNYHCKPLGDLDWNGSGMHANFSNTLLRTAGSKEVFDKVCEAFRPVVKEHIEVYGAHNELRLTGKHETASIHDFSYGVSDRGASIRIPVLVPAKGWSGYLEDRRPNSAADPYKVAARIIKTVKPVQR

SEQ ID NO: 12350 - protein, 239 aa, Unknown
  Synechococcus sp. WH 7805
MAVVTLSEMMEAGAHFGHQTRRWNPKMSRYIYCARNGVHIIDLVQTAVCMNNAYKWVRSAARSGKRFLFVGTKKQASEVVALEATRCGGSYVNQRWLGGMLTNWTTMKARIDRLKDLERMEASGAIAMRPKKEGAVLRRELDRLQKYLGGLKNMRRLPDVVVLVDQRRETNAVLEARKLDIPLVSMLDTNCDPDLCEVPIPCNDDAVRSVQLVLSRLADAINEGRHGSNEQRGGDDSEG

SEQ ID NO: 12351 - protein, 189 aa, Pinus strobus
AWHSAGTYDVKSKTGGPFGTIKHPDELAHGANNGLDIAIRLLEPIKEQFPTISYADFYQLAGVVAVEITGGPDIPFHPGRPDKTEPPEEGRLPDATKGIDHLRDVFGHMGLSDKEIVALSGAHTLGRCHKERSGFEGAWTSNPLIFDNSYFKELLSGEKEGLLQLPSDKALLEDPIFRSYVEKYAADDD

SEQ ID NO: 12352 - protein, 431 aa, Glycine max
MDYLKELEGKSVHDCYHHHQQQQIKMSKMASPIFVPGPVIVGAGPSGLAAAACLKQKGIIPSLILERAQCLASMWQFKTYDRLRLHLPKQFCQLPLMPFPKNLPSYPTKQQFLAYLKAYADHFDIKPVFSQTVVSAEFDHVCQLWRVKTRGVIKKEDTAEYVCQWLIVATGECAEEVVPQIEGMGEFEGQIVHTSKYKSGSMFCGKNVLVVGCGNSGMEVCLDLCNHNARPSLVVRDTVHILPQQMLGKSTFGLSMFLLKWFPIRFVDQFLLLMSHLMLGDTAQFGLRRPKLGPLELKNLYGKTPVLDVGTLTQIKNGKIKVCRGIKRLARNAVEFVDGKVENFDAMVLATGYKSNVPSWLKGSDMFSEKDGFPRKPFPNGWKGENGLYAVGFTKRGLLGASIDAKRIAEDIEHSWKAEAKHVLEFPRPLA

SEQ ID NO: 12353 - protein, 119 aa, Brassica napus
MAKQQNPPIPMPLSLSLPLVLVALLLPAARGAAETPQYTTVHAESDFEVRLYGDTVWMSAPTPDIPSFHVATKLGFHRLFQYLMGANLNSSRIRMTTPVLTSVVPGAGPLRSSAYSVRL

SEQ ID NO: 12354 - protein, 479 aa, Zea mays
MSAAMPPAMDPAAAGEMAREAAAWCSLHGLVVGDRADQLAYGRSATVPGVGLVHAPFSLLPAHFPESFWRQACELAPVFNELVDRVSMDGNFLQNALSKTRQVDDFTSRLLEIHRKMMEINKEENIRLGLHRSDYMLDSETSSLLQIELNTISASFPGLGSLVSDLHRSLIKQYGTSLSLEHKRVPANAASTQFSEALAQAWSEFNIDSAVIMMIVQPEERNMYDQYWLSKHLQDSHGITTIRKTLSQVEAEGQVLPDGTLLVGGQKVAVVYFRAGYAPNDYPSEAEWSARLMMEQSSAVKCPSISYHLVGTKKIQQELAKPNVLERFLKSEEIDKVRKCFAGLWSLDDEYIIKTAVEKPELFVLKPQREGGGNNIYGLDLRETLVRLQKEGGDALAAYILMQRIFPKASPAYLVRGGVCHEGLAISELGIYGAYLRNKDKVVINEQCGYLMRTKVSSSDEGGVAAGFAVLDSLYLTGK

SEQ ID NO: 12355 - protein, 112 aa, Ralstonia eutropha
MKLIIAVIKPFKLDEVREALSDVGVSGITVTEVKGFGRQKGHTELYRGAEYIVDFLPKVKIEVAVPDDVVERAIEAIEKSARTGKIGDGKIFVAPIEQVIRIRTGETGSDAL

SEQ ID NO: 12356 - protein, 482 aa, Burkholderia thailandensis
MTTTNTTTPAAAATPAIRDCGDRYCIIGGGAAGIATAKNLREHGIAFDLIEREDDIGGTWYYGKPCSAIYKSVHMISSREFSEYTDYPMPADYPTYARGDQALAYLRDYARRFGVYEHAEFNRTVLEVAPLAQGGAWRVELDGGEVRHYKGVFVCNGHLSKPQVPDYPGRFDGLQLHSALYKTPDVLKGKRVLVVGAGNSGCDIAVEAVHHASAVFHSTRRGYFYWPKFLFGIPADRWAEWPLKLRMPLWARRFFGERLLRLTTAGQPEDYGLPKPDHKLFEAHFIINSTLFYHLGHGDLVAKPDVVELKGDRVAFSDGSEEQIDAIVYATGFQLSFPFLDQSYLQWDKMQPRLYLNVFDRAHPNLFFIGLFQTSTGNWPLMDYQAQLVARYLRARDAAPRKAARLDRRIGRDRSNWNGGIHFSDTQRHVIEVEHFAYRLQLKRLIRALPDSRVAPRQARPVAVASAAQAAASGARVRTGDA

SEQ ID NO: 12357 - protein, 117 aa, Arabidopsis thaliana
  misc_feature (73)..(73): Xaa can be any naturally occurring amino acid
MAKKRRGVKAVGKRAINGDPLTNKWRTRTPVPSVSGKRKRRFFRKGPKGQKDLGGKGLVPLEDVGMVFVKAAXEDSRKSPRKFSVKKSWRLTNLIIKGKRRKTRKARGEKSVDVLLE

SEQ ID NO: 12358 - protein, 479 aa, Haemophilus influenzae
MALSKNTKLVILMAIPLITFLLPAPDGLSLIAWRLLGVYIATIVGLVLKPYGEPVILLAAIAVSGVIIGNTEGAKELVKVGNMLDGYKSGTTWLIFTAFTLSSAFVITGLGKRIAYHMIGAMGSTTLRLGYVTMFLDLLLSPATPSNTARSGGIIFPIINSVVVALGSDPEKSPKKAGRYLMMNVYMVVKTTSYIFLTAMAPNALALSLMAPILGFETTWIKWFLAASVPGLLCLFLIPLICYWVSPPELKKVDNKAIAKKGLEELGPMSFREKALSVLFVIALFGWIFSNSLHINATIVAIIVMVLCIVLSIVTWDDILKSKGAWNTLVWYGGIIGMSGLLEKSGFFKWLANTLSTILQFEGHGMMALIVILTLSVSVRYLFASGGAYVAAMVPVFATVGHVTGAPTELLALGLVFANSYGGSVTHYGGGPGPIAFGAGYNDIKSWWITGAIIAFGSLIIHLTIGMAWWKLLMSLGWL

SEQ ID NO: 12359 - protein, 307 aa, Unknown
  Nocardioides sp. JS614
MAVVTMRQLLESGVHFGHQTRRWNPKMKRFIMTERNGIYIIDLQQSLAYIDRSYAFVKETVAKGGTIMFVGTKKQAQEAIAEQATRVGMPYVNQRWLGGMLTNFSTVHQRINRLKELDEIDFDDVAGSSRTKKELLQMRRERDKLNKSLGGIREMTRTPSAVWIVDTNKEHLAVEEARKLRIPIIGILDSNCDPDLVDFPIPGNDDAIRAVGLLTRVVADAVAEGLIARSGVKAGEGAEAVGAEEPLAEWERELLGGEAEQAAVDATGGAATEETPAAESTGAASEAAAVSEAAEPATEQPAADAEA

SEQ ID NO: 12360 - protein, 278 aa, Arabidopsis thaliana
MTREFELENNYQLCDEIGRGRFGTITRCFSPATKEFYACKTIDKRVLTDALDRECIETEPRIMAMLPPHPNIIRIFDLYETEDSLAIVMELVDPPMTIYDRLISAGGRLSESESASYAKQILRALAHCHRCDVVHRDVKPDNVLVDLVSGGVKLCDFGSAVWLGGETAEGVVGTPYYVAPEVVMGRKYDEKVDIWSAGVVIYTMLAGEPPFNGETAEDIFESILRGNLRFPPKKFGSVSSEAKDLLRKMICRDVSRRFSAEDALRHSWMMNVGNLQSN

SEQ ID NO: 12361 - protein, 1023 aa, Bifidobacterium longum
MTDVTHVDRASQAWLTDPTVFEVNRTPAHSSHKWYARDPQSGQWSDLKQSLDGEWRVEVVQAADINLEEEPATAESFDDSSFERIQVPGHLQTAGLMNHKYVNVQYPWDGHENPLEPNIPENNHVALYRRKFTVSAPVANAKQAGGSVSIVFHGMATAIYVWVNGAFVGYGEDGFTPNEFDITELLHDGENVVAVACYEYSSASWLEDQDFWRLHGLFRSVELAARPHVHIENTQIEADWDPEAGTASLDAALTVLNAADAATVRATLKDADGNTVWQTTGDAEAQTAISSGPLQGIAPWSAESPTLYELDVDVIDQAGDVIECTSQKVGFRRFRIEDGILTINGKRIVFKGADRHEFDAERGRAITEQDMIDDVVFCKRHNINSIRTSHYPNQERWYELCDEYGIYLIDEANLEAHGSWSLPGDVLTEDTIVPGSKREWEGACVDRVNSMMRRDYNHPSVLIWSLGNESYVGDVFRAMYKHVHDIDPNRPVHYEGVTHNRDYDDVTDIETRMYSHADEIEKYLKDDPKKPYLSCEYMHAMGNSVGNMDEYTALERYPKYQGGFIWDFIDQAIYATQPDGTRSLRYGGDFGDRPSDYEFSGDGLLFADRKPSPKAQEVKQLYSNVHIDVTKDSVSVKNDNLFTATGDYVFVLSVLADGKPVWQSTRRFDVPAGETRTFDVAWPVAAYRADARELVLQVSQRLAKATDWAESGYELAFGQTVVPADATATPDTKPADGTITVGRWNAGVRGAGREVLLSRTQGGMVSYTFAGNEFVLRRPAITTFRPLTDNDRGAGHGFERVQWLGAGRYARCVDNVLEQIDDSTLKGTYTYELATAQRTKVTVSYTAHTDGRVNLHVEYPGEQGDLPTIPAFGIEWTLPVQYTNLRFFGTGPAETYLDRKHAKLGVWSTNAFADHAPYLMPQETGNHEDVRWAEITDDHGHGMRVSRADGAAPFAVSLLPYSSFMLEEAQHQDELPKPKHMFLRVLAAQMGVGGDDSWMSPVHPQYHIPADKPISLDVDLELI

SEQ ID NO: 12362 - protein, 187 aa, Oryza sativa
MSDSNPGAANPALGPDADAAAGEGLELAQFAAGCFWSVELTYQRLPGVARTEVGYSQGHRHEPTYRDVCGGGTGHAEVVRVHYDPKACPYEVLLDVFWAKHNPTTLNRQGNDVGTQYRSGIYYYTAEQEKAARDSLAEKQKEWKERIVTEILPATRFYPAEEYHQRYLEKGGQSAKKSCNDPIRCYG

SEQ ID NO: 12363 - protein, 379 aa, Thermobifida fusca
MARDYYEILGVRRDATQDEIKKAYRRLARELHPDVNPDPETQERFKEVAQAYEVLSNPEKRRMYDMGVDPFARGGAAGGGATGFGAGFPFDDLMNAFFGGSTGTRAARERMRRGRSIKVRVELDLEETAFGVTKDITFPTAVVCNTCQGEGTAQGTHPETCDMCGGRGEVSQVTRSFLGQVMTTRPCPQCAGQGTIIRNPCPDCAGEGRVRERVTRKVQIPAGVEDGTQIQLAGEGEVGPNGGPRGDIFLEIVERPHPIFERRGDDLHCTVTVPMTAAALGATLTIDTLDGPEEIDLRPGTNSGQVITLQSKGCHHLNAPGRGDLHIHVTVETPTRLDEEQEALLRKLAELRGEDRPPGKFSPGQGNFFSRIRDAFGAR

SEQ ID NO: 12364 - protein, 415 aa, Burkholderia thailandensis
MFDRAQSTIANVDPEIWQAIQQENVRQEEHIELIASENYTSPAVMAAQGSQLTNKYAEGYPGKRYYGGCEYVDIVEQLAIDRVKALFGSEAANVQPNSGSQANQGVFFAMLKPGDTIMGMSLAHGGHLTHGSPVNMSGKWFNVVSYGLNENEDIDYEAADKLAHEHKPKLIVAGASAFALKIDFERLAKIAKAVGAYLMVDMAHYAGLIAAGVYPNPVPHADFVTTTTHKSLRGPRGGVILMKAEYEKQINSAIFPGIQGGPLMHVIAAKAVAFKEALSPEFKEYQQKVIENARVLAETLVKRGLRIVSGRTESHVMLVDLRAKNITGKAAEAALGNAHITVNKNAIPNDPEKPFVTSGVRLGSPAMTTRGFGPQEAELVGNLIADVLEHPEDAATIERVRAQVADLTKRFPVYR

SEQ ID NO: 12365 - protein, 957 aa, Pseudomonas putida
MSQSPSLHQLQELNPFLRRHLGPDAAEQQAMLKVLGVASRNELIEQTVPPDIRLNRPLDLPAALDEQAALAKLAGYAEQNQVWTSLIGMGYHGTITPTVILRNVLENPGWYTAYTPYQPEIAQGRLEALLNFQQMVIDLTGLALANASLLDEATAAAEAMALAKRVARNKSNAFFADEHCHPQTLSVLKTRAEGFGFELIVDAVDNLANHAVFGALLQYPDTHGEVRDLRPLIDQLHSQQALACVAADLLSLVVLAPPGELGADVVLGSTQRFGVPMGYGGPHAAYFACRDDYKRAMPGRIIGVSRDARGNTALRMALQTREQHIRREKANSNICTAQVLLANIAGFYAVYHGPEGLQRIAQRVHRLTFILAAGLEAKGIKRLNQHFFDTLTLDVGGAQAAIIESAEAAHINLRILGRGHLGVSLDETCNEHTVLRLLDIFLGVDHGLEIAALDQLALPEGIPASLVRRTPLLAHPVFNLHHSETEMLRYLKQLENKDLALNQSMIPLGSCTMKLNATSEMIPITWPGFAHLHPFAPASQASGYKAMIDELESWLCAITGFDAICMQPNSGAQGEYAGLMAITRYHRSRHQPQRTLCLIPSSAHGTNPASAQMAGMEVVIVDCDNDGNVDLADLKAKAHAAGERLSCLMITYPSTHGVYEEGIREICEVVHQHGGQVYMDGANLNAQVGLARPADIGADVSHMNLHKTFCIPHGGGGPGMGPIGIRAHLTPFVASHPVVPVPGLDPNNSAVSAAPWGSASILPISWMYIAMMGPQLADASEVAILSANYLASQLGGAFPVLYRGRNQRVAHECILDLRPLKALTGISEEDVAKRLMDYGFHAPTMSFPVPGTLMVEPTESESKAELDRFVEAMLAIRAEIAEVQEGNWPAENNPLKHAPHTLADVLGVWDRPYSLEQAVAPSAHARQHKYWPAVNRVDNVYGDRNLFCACVPVEAYR

SEQ ID NO: 12366 - protein, 73 aa, Sinningia conspicua
ISGTNGEVMPGQWEFQVGPSVGIEAGDHIWCARYLLERITEQAGVVLSLDPKPIEGDWNGAGCPTNYSTKSMR

SEQ ID NO: 12367 - protein, 669 aa, Thermoplasma acidophilum
MTLTVCPYCGTGCQIEVDYSGDHYTVHGYTRSAVNEGKLCIKGYQGLSYASSHDRITSPMLRSGDTWVKVSWDEAIDYVVKRLKEIRDRYGPDAIAFQASAKCTNEENYLLQKIARMIGTNNVDHCARSCHSSTVAGLIRTLGTAAATGSIKSLKSTQTFFVIGSNTTEQHPIIGTTIIKQKKAGKKLIVADPRRTKLASIADVFLQFKPGSDVALLNSMMFVILKRGLIDSEFIKSRTEGFEAFAEEIEKYPPELTEQITGVPPDLVEKAAEIYASNRPSAILYGMGITQHIHGTENVMSVSNLALMTGNLGRYGSGIFPLRGQNNVQGSSDMGALSEFYPGYVPPDSPGVEKFERIWEAKLPRKVGLMLSEMFDAAIDGRVKAIYLMGENPVITEANLSDVERGLKNLELFVVQDIFMTDTARYAHVILPATSALEKEGTFTNTERRIQRVVPVKDPPGDARPDWWILSQIYSKIFDREAYRSPEDIFNEIRLAIPNYSGVRYSDLYPDGKQWPINDQHPEGAEILHVDKFARGLGRFMAIPYKSPSESPDEEYPFILTTGRNYYHWHSGTMTRRSEILERESPNPYVEISVNDAKKLSIRNGQTITIESRHGSIKLPAMVTSKIPDGIVFVPFHFKEARVNLLVGENLDPYSKIPEFKVVAVKVKA

SEQ ID NO: 12368 - protein, 141 aa, Unknown
  Acidovorax sp. JS42
MPRMSAPDPAPSAPTPATPFERIGGEPRIRQLVDRFYDLMDLEPGYAELRASHGTTLDDARDKLFWFLCGWLGGPDHYQSRFGHPRLRARHMPFSIGILERDQWVACMDQAMGEVDVPDDLRARLNESFMGTADWMRNRGG

SEQ ID NO: 12369 - protein, 273 aa, Zea mays
MATVETSGTAIGSSGRWALHGKTALVTGGTRGIGRAVVEELAALGAAVHTCSRKAEELGERIKEWEARGFSVTGSVCDLSERDQRERLLREVADRFGGKLNILVNNVGTNIRKPTTEFTAEEYSFLMATNLESAYHLCQIAHPLLKLSGSGSIIFISSVAGAIGIFSGTIYAMTKGAINQLTKNLACEWAKDNIRANSVAPWYITTSLTEGILANKNFEEQVVSRTPLGRVGEPGEVSALVAFLCMPGSTYISGQTIAVDGGMTVNGFYPPKP

SEQ ID NO: 12370 - protein, 148 aa, Triticum aestivum
HGNAVSLLRPNATSGNQNNMLILQETCTDASGSLVVYAPVDVQSMHVVMGGGDSAYVSLLPSGFAILPDGHTAPAAATDPSSQGSSPNAHGGSSNNSPGSLVTVAFQILVNNLPTAKLTVESVDTVSNLLSCTIQKIKSALQASIISP

SEQ ID NO: 12371 - protein, 412 aa, Rhodococcus ruber
MIIIGAGQGGLQAAMSLRDHGYTGRLTIVGDEPGLPYQRPPLSKAYLINDDAMSEELLLLRPHSVFERLDIDLITGDGVTRIDRVRSTVSLSSGRELAFDHLILATGARPRELSVPGADLAGVEALRTCDDAKAIRAGLTGPARVVVIGGGFVGTEVAAAATKRGHSVTIVDMEARLLNRAVSPEISALVTAAHRRRGTAVVLNAGVSRLCGSDGTVEAVELTDGQRIPADFVVVGIGVVPNTEIAHDAGLAVDNGILVDDRLRTNDHRISAIGDCARFPCAHADGQMLRLESVQNAVDHARHVAARLMGDAGPYDAVPWFWTDQCGLKIQIAGIGAQGAESVVIGDEAAERCSVLRFRSGELSCVESVNSSGEHMAARKILRGGPRPVAPVDGSPAAFDLKHIAREVATAR

SEQ ID NO: 12372 - protein, 202 aa, Cryptococcus neoformans
MSERIASVERTTSETHISCTIDLDHIPGVTEQKINVSTGIGFLDHMFTALAKHGGMSLQLQCKGDLHIDDHHTAEDCALALGEAFKKALGERKGIKRYGYAYAPLDESLSRAVIDISSRPYFMCHLPFTREKVGDLSTEMVSHLLQSFAFAAGVTLHIDSIRGENNHHIAESAFKALALAIRMAISRTGGDDVPSTKGVLAL

SEQ ID NO: 12373 - protein, 404 aa, Methanococcoides burtonii
MDLINDTLEIAKGIYWVGVVDWNLRDFHGYATPRGGTYNAYLIVDDKVTLIDTVKGDFAPEMIKRIRKVVNPSKIDHIICNHVEMDHSSGLPAIMELAKDAKIFCTKRGKVGLEEHYEANGCSAWDFEIVDTGYELDIGSRTLMFLETPMLHWPDSMQTYLKEDRILFSNDAFGQHLATSVRFEDEVECGALEDAAIYYANILLPFGSKVLKYADKIAELGLEFDMIAPSHGVIWRKEPMRVVEAYIKWAKGEAVPKVLVIYDTMWGSTEIMAKEIVEGVSECGVEARMFHLRKNDWSMMLRELLSSPVIAVGSPTMHGTMFFTISGFLTYLKGLRPKGKSAVAFGSFGWGGGAVKHVEEMMASAGLEVIEPGLQAKYRPYEDDLKACRELGVRLAQLALDKAE

SEQ ID NO: 12374 - protein, 354 aa, Unknown
  Pseudomonas sp. HR199
MFPKNAWYVACTPDEIADKPLGRQICNEKIVFYRGPEGRVAAVEDFCPHRGAPLSLGFVRDGKLICGYHGLEMGCEGKTLAMPGQRVQGFPCIKSYAVEERYGFIWVWPGDRELADPALIHHLEWADNPEWAYGGGLYHIACDYRLMIDNLMDLTHETYVHASSIGQKEIDEAPVSTRVEGDTVITSRYMDNVMAPPFWRAALRGNGLADDVPVDRWQICRFAPPSHVLIEVGVAHAGKGGYDAPAEYKAGSIVVDFITPESDTSIWYFWGMARNFRPQGTELTETIRVGQGKIFAEDLDMLEQQQRNLLAYPERQLLKLNIDAGGVQSRRVIDRILAAEQEAADAALIARSAS

SEQ ID NO: 12375 - protein, 101 aa, Arabidopsis thaliana
  misc_feature (10)..(10): Xaa can be any naturally occurring amino acid
  misc_feature (18)..(18): Xaa can be any naturally occurring amino acid
  misc_feature (37)..(37): Xaa can be any naturally occurring amino acid
  misc_feature (46)..(46): Xaa can be any naturally occurring amino acid
  misc_feature (55)..(55): Xaa can be any naturally occurring amino acid
  misc_feature (58)..(58): Xaa can be any naturally occurring amino acid
  misc_feature (63)..(63): Xaa can be any naturally occurring amino acid
  misc_feature (69)..(69): Xaa can be any naturally occurring amino acid
  misc_feature (72)..(72): Xaa can be any naturally occurring amino acid
MASSMLSSTXVVTSPAQXTMVAPFTGLKSSASFPGTXKANNDLTSXTSNGGRVSXMKXVWPPXLVKKKXGTXFLTDLGGGWKTLKFAEFGLWPLLCSHLKL

SEQ ID NO: 12376 - protein, 429 aa, Sorghum bicolor
MGLSTAYSPVGSHLAPAPLGHRRSAQLHRPRRALLATVRCSVDAAKQVQDGVATAEAPATRKDCFGVFCTTYDLKAEDKTKSWKKLVNIAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASKNVKVLVVGNPCNTNALICLKNAPDIPAKNFHALTRLDENRAKCQLALKAGVFYDKVSNVTIWGNHSTTQVPDFLNAKIDGRPVKEVIKDTKWLEEEFTITVQKRGGALIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAYCDVPEDTMLPGEV

SEQ ID NO: 12377 - protein, 1751 aa, Unknown
  Caldicellulosiruptor sp. Tok7B.1
MQEMKAIKRVVSITALLVLTLSLCFPGIMPVKAYAGGTYNYGEALQKTIMFYEFQMSGKLPSWVRNNWRGDSGLDDGKDVGLDLTGGWHDAGDHVKFNLPMSYSASMLGWAVYEYKDAFVKSKQLEHILNQIEWANDYFVKCHPSKYVYYYQVGDPTVDHNFWGPAEVMQMKRPAYKCDLSNPASSVVAETAASLAVASVVIKERNSQKAASYLQHAKDLFEFADTTRSDAGYTAATGFYTSGGFIDDLGWAAVWLYIATNDSSYLTKAEELMSEYANGTNTWTQCWDDVRYGTLIMLAKITGKELYKGAVERNLDHWTDRITYTPKGMAYLTGWGSLRYATTAAFLACVYADWSGCDSNKKTKYLNFAKSQIDYALGSTGRSFVVGFGTNYPQHPHHRNAHSSWANSMKIPEYHRHILYGALVGGPGSDDSYNDDITDYVQNEVACDYNAGIVGALAKMYQLYGGEPIDDFKAIETPTNDEIFVESKFGNSQGPNYTEVISYIYNRTGWPPRVTDKLSFKYFIDLTELIQAGYSPDVVKVDTYYIEGGKISGPYVWDKNRNIYYVLVDFSGTKIYPGGEVEHKKQAQFKISVPQGYPWDPTNDPSYKGLTSQLEKNKYIAAYDNNNLVWGLEPGAATSTPAPTSTPTPTPTPTPTVTATPTPTPTPTPTGSPGTGSGVKVLYKNNETSASTGSIRPWFKIVNGGSSSVDLSRVKIRYWYTVDGDKPQSAVCDWAQIGASNVTFNFVKLSSGVSGADYYLEVGFSSGAGQLQPGKDTGDIQVRFNKNDWSNYNQADDWSWLQSMTNYGENAKVTLYVDGVLVWGQEPGGATPAPTSTATPTPTPTATPTPTPTPTPTPTVSATPTPAPTASPVGGSYWTPSESYGALKVWYANGNLSSPTNVLNPKIKIENVGTTAVDLSRVKVRYWYTIDGEATQSVSVASSINPAYIDVKFVKLGANAGGADYYVEIGFKSGAGVLAAGQSTKEIRLSIQKGSGSYNQSNDYSVRSANSYIENEKVTGYIDDVLVWGREPGRNAQIKVWYANGNLGSMTNVLNPKIKIENVGTTAVDLSRVKVRYWYTIDGEATQSVSVTSSINPAYIDVKFVKLGANAGGADYYVEIGFKSGAGVLAAGQSTKEIRLSIQKGSGSYNQSNDYSVRSATGYIENEKVTGYIDGAIVWGREPSRGTKPAGGVTPTPAPTPTSTPTPTPTTTPTPTPTVTVTPTPTPAVTPDVKISIDTSRGRTKISPYIYGANQDIQGVVHPARRLGGNRLTGYNWENNMSNAGSDWYHSSDDYMCYIMGITGNDKNVPAAVVSKFHEQSIKQNAYSAITLQMVGYVAKDGNGTVSESETAPSPRWAEVKFKKDGALSLQPDVNDNYVYMDEFINYLINKYGRSSSATGIKGYILDNEPDLWFTTHPRIHPQKVTCSELINKSVELAKVIKTLDPDAEIFGPASYGFVGYLTLQDAPDWNQVKGNHRWFLSWYLEQMKKASDSFGKRLLDVLDIHWYPEAQVGGVRICFDGENSTSRDVAIARMQAPRTLWDPTYKTTQKGQITAGENSWINQWFPEYLPLLPNIKADIDKYYPGTKLAITEFDYGGKDHISGGIALADVLGIFGKYGVYMAARWGDSGSYAQAAYNIYLNYDGKGSRYGSTCVSAETTDVENMPVYASIEGEDDSTVHIILINRNYDRKLKAEIKMNNTRVYTGGEIYGFDSTSSQIRKMGVLSNIQNNTITIEVPNLTVYHIVLTSSK

SEQ ID NO: 12378 - protein, 398 aa, Moorella thermoacetica
SQPVAITDGIYWVGAVDWNIRYFHGPAFSTHRGTTYNAYLIVDDKTALVDTVYEPFKEELIAKLKQIKDPVKLDYLVVNHTESDHAGAFPAIMELCPDAHVLCTQRAFDSLKAHYSHIDFNYTIVKTGTSVSLGKRSLTFIEAPMLHWPDSMFTYVPEEALLLPNDAFGQHIATSVRFDDQVDAGLIMDEAAKYYANILMPFSNLITKKLDEIQKINLAIKTIAPSHGIIWRKDPGRIIEAYARWAEGQGKAKAVIAYDTMWLSTEKMAHALMDGLVAGGCEVKLFKLSVSDRNDVIKEILDARAVLVGSPTINNDILPVVSPLLDDLVGLRPKNKVGLAFGAYGWGGGAQKILEERLKAAKIELIAEPGPTVQWVPRGEDLQRCYELGRKIAARIAD

SEQ ID NO: 12379 - protein, 447 aa, Oryza sativa
MAQAVVPAMQCQVGAVRARPAAAAAAAGGRVWGVRRTGRGTSGFRVMAVSTETTGVVTRMEQLLNMDTTPFTDKIIAEYIWVGGTGIDLRSKSRTISKPVEDPSELPKWNYDGSSTGQAPGEDSEVILYPQAIFKDPFRGGNNILVMCDTYTPAGEPIPTNKRNRAAQVFSDPKVVSQVPWFGIEQEYTLLQRDVNWPLGWPVGGYPGPQGPYYCAVGSDKSFGRDISDAHYKACLYAGINISGTNGEVMPGQWEYQVGPSVGIEAGDHIWISRYILERITEQAGVVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTALLAETTILWEPTLEAEVLAAKKLALKFLENHATFHSPVNILVEHHT

SEQ ID NO: 12380 - protein, 317 aa, Rickettsiella grylli
MDFNINLYIKREDTIDNIGSGNKYRKISYIIDDAVSKKSTVLVTTGSVASNQCKAVSYFAAANQLKAHVVYGGDTQKKPHHAQGNYLLTSLFNPSVTWFEESKWEDISNKMDEIVDALLDRGESVYRINSGASEWPGIVGSIELGFELAGQCFENNIDGEVNIVLPFGSGGTCLGLHVAADILGLSWNIYGMCIGDEPDIGMKRLENMKFDLLKRIPFLSNNIQNVFLLKLPSNGKYDEPSKIELDAMQKALQNYALLLDTNYMIKAYLGLNFLTSLDQSTRKKVTILLHTGGSIGIFNLNNNMMNWHANQFKDWVV

SEQ ID NO: 12381 - protein, 465 aa, Ostreococcus tauri
MRFAAASSAPSSARAPFNLSPSLFRVRLVPGRDDVFDVRVDRDRPRRARVRGHVLTTASARLDRYRLVKTSHPTPQRATRGVHRASVTTTMKIAVFGSGSFGTAMASVVARNGHDVIILTRREDVATCINENGRNPQHLTAYELPKNVRATMDAEEAISNAGAIVHAIPMQSTEEFLDGVKDLVKRSGALFVNTSKGLHGETLELMHDVLKRSLGSNHPCAFFGGPTFAEQLMNGTPSGGVMAARDMATAERASALFAGPKMRVYPSTDVVGVEIGGALKNVIAILAGGLEGMGLGVNAQTLLITRGCREMTRLGVAMGAKEHTMAGLSGIGDLMLTCLGDASRNKAVGIAFGRGQKVEDILSERAQSLKGVAEGVATAPAAERLARKLGVAAPMITTCAQCLRGELDAKAALMQCMTLPIRPDEPLDDNKGVAARVISFVTHGTCALLGAFTASWIRSRSRDRA

SEQ ID NO: 12382 - protein, 345 aa, Solanum tuberosum
MDDEMYGFHSTRDDYADKALMSPENLMMQTEYNNFHNYTNSSILTSNPMMFGSDDIQLSSEQTNSFSTMTLQNNDNIYQIRSGNCGGGSGSGGSSKDHNDNNNNNEDYDEDGSNVIKAKIVSHPYYPKLLNAYIDCQKVGAPAGIVNLLEEIRQQTDFRKPNATSICIGADPELDEFMETYCDILLKYKSDLSRPFDEATTFLNKIEMQLGNLCKDDGGVSSDEELSCGEADASMRSEDNELKDRLLRKFGSHLSSLKLEFSKKKKKGKLPKEARQMLLAWWDDHFRWPYPTEADKNSLAESTGLDPKQINNWFINQRKRHWKPSENMQLAVMDNLSSQFFSSDD

SEQ ID NO: 12383 - protein, 176 aa, Sulfolobus acidocaldarius
MEVATLGGGCFWCTEAVFKRVKGVVSVKPGYSGGKVPNPTYEEVCTDETGHAEVVQITFDPSVITYRELLEIFFEIHDPTTPNRQGNDVGSQYRSIILYHSEEQKKIAEEMIKLYERKLGKKVVTELVPFEAFYEAEDYHHDFYDKHKNYPYCKLVIDPKVKKFMKNFPDKASIRI

SEQ ID NO: 12384 - protein, 628 aa, Rickettsiella grylli
MCGIVGILSNLDKSFHISNLLNSMSGTLTHRGPDGSGVYLDDNIAMAHRRLSIIDLSSNANQPFSSYDKSLVLIFNGEIYNYSKIKNLVYNYPFKSTSDGEIILPLYQKFGPDFIKHLEGMFAFALYDKKQKLLFLVRDRVGEKPLYYTWYKNCLFFSSELKSFWEITDFRPPLSKIAILNYLAYTQSPAPYSMYENIYKVIPGHYLIIDCKNKVTQKNYWNIDFTNKTKITAYEATEQLDTLLRDTMKKTLVSDVSIGITLSGGIDSSVLLGHMSGIYSEAINSFTLGSNHQPNSIDPELDRAKIVAKLYQTHEHFCDFKDISFKDFLKANSYYDEPVGILDTVHSMFLSQYISQYHKVVITGNGADEVFGGYKSYSNFLRKNFLKQCLIQASRKYAIKNIQSFFTKTVLKTISNYSLKFLTNDMILFSNNPYLIEYLDVYYKMSNFDNLLDGKLFFELLVTLNHCASMSDTLGMTHSLEIRSPFLNHHIVEFAASLPVYYKVKFFSPSNRNKYILKRLALKYMPKELIFIKKYGCGSFINYHGKFKTSWRADIEQILFHSAAGIYEFFSKEKTRCLWIKFLSGVLSPNEKMLLNKLIILFAWYNSVFLKRKSSFQLASNQIQPNLH

SEQ ID NO: 12385 - protein, 143 aa, Arabidopsis thaliana
MSNKMRKLQQLVPNCHKTDKVSVLDKTIEYMKNLQLQLQMMSTVGVNPYFLPATLGFGMHNHMLTAMASAHGLNPANHMMPSPLIPALNWPLPPFTNISFPHSSSQSLFLTTSSPASSPQSLHGLVPYFPSFLDFSSHAMRRL

SEQ ID NO: 12386 - protein, 605 aa, Triticum monococcum
MAALVTSQLATSGAVLGITDRFRRAGFQGVRPRSPADAALGMRTVGASAAPKQQSRKAHRGTRRCLSVVVRATGSGGMNLVFVGAEMAPWSKTGGLGDVLGGLPPAMAANGHRVMVISPRYDQYKDAWDTSVVSEIKVADEYERVRYFHCFKRGVDRVFVDHPCFLEKVRGKTKEKIYGPDAGTDYEDNQLRFSLLCQAALEVPRILDLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDNFLTVNYNVTTALEGKVLNKEALQAEVGLPVDRKVPLVAFIGRLEEQKGPDVMIAAIPEIVKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEHVLLELGVEGSEPGIVGEEIAPLAMENVAAP

SEQ ID NO: 12387 - protein, 726 aa, Escherichia coli
MSTSDDIHNTTATGKCPFHQGGHDQSAGAGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVGPDPEAAPIEEQGLGWASTYGSGVGADAITSGLEVVWTQTPTQWSNYFFENLFKYEWVQTRSPAGAIQFEAVDAPEIIPDPFDPSKKRKPTMLVTDLTLRFDPEFEKISRRFLNDPQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGVVGVEKAASAAGLSIHVPFAPGRVDARQDQTDIEMFELLEPIADGFRNYRARLDVSTTESLLIDKAQQLTLTAPEMTALVGGMRVLGANFDGSKNGVFTDRVGVLSNDFFVNLLDMRYEWKATDESKELFEGRDRETGEVKFTASRADLVFGSNSVLRAVAEVYASSDAHEKFVKDFVAAWVKVMNLDRFDLL

SEQ ID NO: 12388 - protein, 485 aa, Hyphomonas neptunium
MSSASPAILWFREDLRLTDNPALNAAVNSGRPLICVYLRETGAGAPREMGGASRWWLNKSLASLGASLEAIGGKLTLRTGPAEKIIPALVEETGAAAVFWNRRYGLPERETDAAIKKTLKDNGVECQSFNGRLLMEPWDLKTGSGGWYKVFTPFWRALQAQYKPPAFIPSPKKIAGASAETENLKDWGLHPEKPDWSGGIAAAWEPGEVGAQKRLDAFLDGPVSDYVGTRNLPGVSTGTSRLSPHLRFGEIGPAQIWRAVRARLEAQQADEDSARVFLSEIAWREFSYTLLYYNPALATENYNSNFNQMAWRKDDSGFAAWSRGQTGYPIVDAGMRELWHTGWMHNRVRMIVASFLTKHLLLPWQQGEQWFWDTLVDADPAANPASWQWTAGSGADAAPYFRVFNPISQGQKFDEDGAYVRHWCPELAGLPDKYLHAPFEADAQTLKRARVMLGTDYPEPIIDHPVGRQRALDAYKAMKEEQTAE

SEQ ID NO: 12389 - protein, 136 aa, Mycobacterium tuberculosis
MGLLSRLRKREPISIYDKIGGHEAIEVVVEDFYVRVLADDQLSAFFSGTNMSRLKGKQVEFFAAALGGPEPYTGAPMKQVHQGRGITMHHFSLVAGHLADALTAAGVPSETITEILGVIAPLAVDVTSGESTTAPV

SEQ ID NO: 12390 - protein, 490 aa, Staphylococcus aureus
MTSKSSPLIFERSREGRYAYSLPKSDIKTNSVESLLDDKFIRKNKAEFPEVAELDLVRHYTELSNKNFGVDNGFYPLGSCTMKYNPKINEKVARIPGFSESHPLQDEDQVQGSLEIIYSLQEELKEITGMDEVTLQPAAGAHGEWTALMIFKAYHENNGEGHRDEVIVPDSAHGTNPASASFAGFKSVTVKSNERGEVDIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSEHFEIPYKQYCKHEFVLSGVRQKEFGVRTLDMAKRLLDFGVHPPTIYFPLNVEEGMMIEPTETESKETLDYFIDTLISIAEEAKNDPDKVLEAPHTTVIDRLDEATAARKPILKFENLKQEK

SEQ ID NO: 12391 - protein, 448 aa, Staphylococcus aureus
MSHRYIPLTEKDKQEMLQTIGAKSIGELFGDVPSDILLNRDLNIAEGEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDETAAVAVQYPNFYGSIEDLEKIQSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 12392 - protein, 441 aa, Nostoc commune
MLERMYNQGAVEGAANTELGSRIFLYEVVGLRQSEETDQTNYPIRKSGSVFIRVPYNRMNQEMRRITRLGGTIVSIQPATALQPVNGKASLGNATSEVSELATSGETANTEGNGKATPVNAHSAEEQNKDKKGNTMTQAKAKKDHGDVPVNTYRPNAPFIGKVISNEPLVKEGGIGIVQHLKFDLSGSNLKYIEGQSIGIIPPGLDKNGKPEKLRLYSIASTRHGDDVDDKTVSLCVRQLEYKHPETSETVYGVCSTHLCFLKPGEEVKITGPVGKEMLLPNDPDANVIMMATGTGIAPMRAYLWRQFKDAERAANPEYQFKGFSWLIFGVPTTPNLLYKEELEEIQQKYPDNFRLTAAISREQKNPQGGRMYIQDRVAEHADELWQLIKNEKTHTYICGLRGMEEGIDAALTAAAVKEGVTWSVYQKELKKAGRWHVETY

SEQ ID NO: 12393 - protein, 112 aa, Prochlorococcus marinus
MKKIEAIIRPFKLEDVKVALVNSGIVGMTVSEVRGFGRQKGQVERYRGSEFTVEFLQKLKIEIVVADESVPTVLTAIAEAAKTGEIGDGKIFISPVESVVRIRTGELDGSAL

SEQ ID NO: 12394 - protein, 607 aa, Lactuca sativa
MASSSSTTSTSTWTNQRSRFLSSSKDVLGSSSTSISFCKKPNARTAQNSTLCALHTPSILQFPKQSVGKTSTCPVELPSSSSSSSSSPVVQQNWNLIQKFAAMALDAVEDGLKAREKLQTLPKTADPNVQIAGNFSPVPEQPVRHCLPVAGKIPEHIQGVYLRNGANPLFEPTSGHHLFDGDGMIYAVKFDNGSASYACRFTETQRLVQERAIGKPVFPKAIGELHGHSGIAKLLLFYARGLCGLIDVTQGLGVANAGLVYFNNHLLAMSEDDLPYHVRVTPSGDLKTGGRYNFEGQLNSTMIAHPKLDPVSGELFALSYDVIQKPYLKYFWFSPDGKKSKDVAIDLGKPTMVHDFAITENFVVVPDHQVVFKMSEMITGGSPVMYDKEKVSRFGVLDKYAENGSDIKWVEVPDCFCFHLWNAWEEPESDEVVVIGSCMTPADSIFNECNEELKSVLSEIRLNLKTGKSTRRPIISPENDVNLEAGMVNKNLLGRKSKYAYLAIAEPWPKVSGFAKVDLSTGDTQKFIYGDEKYGGEPLFLPRDPNSEAEDDGHILAFVHDEKTWKSELQIVNAMTMELEATVKLPSRVPYGFHGTFINAKDLATQA

SEQ ID NO: 12395 - protein, 875 aa, Oryza sativa
MASKGTEGGHGGVERKEQQQQRGYQLPRDSRGSLEVFNPSSASSFRTAAAAPKSASPFLAIPDREEDNVVAQQRAAEWGLVLQTDHHTGLPQGVSARPSSGSARTSSEDNPQQQQSAAAIPRVSEELRAALSVFQQTFVVSDATHPNHPIMYASAGFFNMTGYTSKEVVGRNCRFLQGSGTDPHEIDKIRQSLANGSNYCGRILNYKKDGTPFWNLLTIAPIKDEDGRLLKFIGMQVEVSKYTEGKKDTVVRPNGLSESLIKYDARQKDHARSSVSELLLALKNPRSLSESSNNTLKRKSQESLSMSMSEVPSKRSSESGSRRNSRSGTRSSLQKINEVPDQVNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRATVRKIRDAIDNQAEVTVQLINYTKSGKKFWNLFHLQPMRDQKGDVQYFIGVQLDGTEHVQDDAAKEGVVLVKKTADNIDEAAKELPDANLRPKDLWANHSKVVLPNPHMKDTASWRAIQKVLESGESIGLKHFRPVKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYAAEVVVALEYLHCQGIIYRDLKPENILLHRDGHISLTDFDLSCLTSCRPQVFLPEDADEKKGRKNGSYPIFFAEPMRASNSFVGTEEYIAPEIITGAGHTSAVDWWALGILLYEMLYGYTPFRGKTRQRTFANILHKDIRFPASISVSKSSVIFFKLEKLNRFEFSGQPSGEAANV

SEQ ID NO: 12396 - protein, 578 aa, Unknown
  Orpinomyces sp. PC-2
MHFNKVSALLLTLATSVAGQFREGFVQTDGTNFVVDGCKRYFSGSNTYYLMVSNHERVDLALETYARHNLNVVRAWAFCDECEDATRLVDFSGPEVTLNGENMEKVDYYLAAAAQRNIRVVLTLTNNWTDYGGMDVWVKQFGGKYHDEFYTNKDIIKGYKQYIKAMINRVNTYTGQLYKDDPTIFSWQLANEARCNNGPHGLPVKNCNTDTITKWMDEIATFIHQEDPNHLVSSGIEGIGLTPPAGVDKNTYVYTYTEGTDYEAISALDSIDYNTVHMYPVGWGLKDYAKDGVTWIKAHADVDKKFNKPTVVEEWGLSTSADNVPIEQRDPIYTQWMNEVLANDNIGMNMFWYVCGEDYYGTDGYLLEEDEITAVIDPFTKKLYANQTCENLDTISIVHTDLVDVYYEVEGCQPKYGTCTGGKCCAHGTRCEGSEYYGQCRPITEPPYRGATSPVEGYVLPGAKSTSKKNNTTKKTTTKTTTSAKSEPTSSSSDECFSIALGFPCCSDNTVVYSDNDGDWGVENGEWCGIGGTIVDNDSCFAKSLGYSCCSSCDVVYTDNDGNWGVENGEWCGIKDSC

SEQ ID NO: 12397 - protein, 417 aa, Oryza sativa
MQNGEPLLPDHGFPVRAIIPGCIGGRMVKWVKRIIVTTAESDNYYHYKDNRVLPSHVDAELANADAWWYKPEYIINELNVNSVITTPGHDEILPINGITTQRGYTMKGYAYSAYGLHILAKVLIQTTPSTARPTSPTSPPSARPSRRPAPVALSSPRDKVPCQLVDKKELSRDVRLFRFALPSSDQVLGLPVGKHIFVCASIEGKLCMRAYTPTSMVDEVGHFDLLIKVYFKNEHPKFPDGGLMTQYLDSLPVGAYIDVKGPLGHVEYTGRGEFVINGKPRNARRLAMIAGGSGITPMYQVIQSVLRDQPEDTTEMHLVYANRTEDDILLRDELDRWAAEYPDRLKVWYVIDQVKRPEEGWKYGVGFVTEEVLREHVPEGGDDTLALACGPPPMIKFAVSPNLEKMKYDMANSFIVF

SEQ ID NO: 12398 - protein, 313 aa, Oryza sativa
MDTEYPFWWRNVSNLANSKCSDNSVHGASNLSQLAPIREAIKAPAPVALSSPRDKVPCQLVDKKELSRDVRLFRFALPSSDQVLGLPVGKHIFVCASIEGKLCMRAYTPTSMVDEVGHFDLLIKVYFKNEHPKFPDGGLMTQYLDSLPVGAYIDVKGPLGHVEYTGRGEFVINGKPRNARRLAMIAGGSGITPMYQVIQSVLRDQPEDTTEMHLVYANRTEDDILLRDELDRWAAEYPDRLKVWYVIDQVKRPEEGWKYGVGFVTEEVLREHVPEGGDDTLALACGPPPMIKFAVSPNLEKMKYDMANSFIVF

SEQ ID NO: 12399 - protein, 399 aa, Oryza sativa
MAASVQPRQFGHLEPGSAPVRGAASSNGAKAYPPANGIPRRADSPVRGCGFPPLVSPPPRKPPSDGSDDEEEEQEDWRELYGSHLQLEVEPPVRDARDEGTADAWIERNPSLIRLTGKHPLNCEPPLARLMHHGFITPAALHYVRNHGAVPRGDWSTWTVDVTGLVKRPMRLTMDELVNGFPAVEVPVTLVCAGNRRKEQNMVQQTVGFNWGAAGVSTSVWRGARLRDVLRRCGIMPSKGGALNVCFEGAEDLPGGGGSKYGTSITRQWALDPSRDIMLAYMQNGEPLLPDHGFPVRAIIPGCIGGRMVKWVKRIIVTTAESDNYYHYKDNRVLPSHVDAELANADAWWYKPEYIINELNVNSVITTPGHDEILPINGITTQRGYTMKGYAYSGGLKNL

SEQ ID NO: 12400 - protein, 245 aa, Antirrhinum majus
WVLVQFGAFIVLCGATHFISLWTFQLHTRTVAVVMTTAKICTAVVSCATALMLVHIIPDLLSVKTRELFLKNKAAELDREMGLIRTQEETGRHVRMLTHEIRSTLDRHTILKTTLVELGRTLGLEECALWMPTRTGLELQLSYTLRHQNPVGFTVPIQLPVINQVFNTNNAVKISPNSPVARLRPAGKYMPGEVVAVRVPLLHLSNFQIHDWPELSTRRYALMVLMLPSDSARQWHMHELELVEV

SEQ ID NO: 12401 - protein, 588 aa, Oryza sativa
MAASVQPRQFGHLEPGSAPVCGAASSNGAKAYPPANGIPRRADSPVRGCGFPPLVSPPSRKPPSDGSDDEEEEQEDWRELYGSHLQLEVEPSVRDARDEGTADAWIERNPLLIRLTGKHPLNCEAPLARLMHHGFITPAALHFVRNHGAVPRGDWSTWTVEVTGLVKRPMRLTVDELVNGFPAVEVPVTLACSGNRRKEQNMVQQTVGFNFGAAAVSTSVWHGARLRDVLRRCGIMPSKGGALNVCFEGAEDLPGGGGSKYGTSITRQWALDPSWDSVLAYMQNGEHAAPRPRLPRPRHHPRVAPACRIVNWVKRIIVTTAESDNYYHYKDNRVFPSHVDAELANADAWWYKPEYIINELNVNSVITAPGHDEILPINGITTQRGYTMKGYAYSVNSGNQIQQISSEFSDRIIPHQHMEYIAKVLLAPIREAIKAPAPVALSSPRDKVPCQLVDKKELSRDVRLFRFALPSSDQSVLRDQPEDTTEMHLVYANRTEDDILLRDELDRWAAEYPDRLKVWYVIDQVKRPEEGWKYGVGFVTEEVLREHVPEGGDDTLALACGPPPMIKFAVSPNLEKMKYDMANSFIVF

SEQ ID NO: 12402 - protein, 688 aa, Oryza sativa
MAASVQPRQFGHLEPGSAPVCGAASSNGAKAYPPANGIPHRADSPVRGCGFPPLVSPPSRKPPSDGSDDEEEEQEDWRELYGSHLQLEVEPSVRDARDEGTADAWIERNPLLIRLTGKHPLNCEAPLARLMHHGFITPAALHFVRNHGAVPRGDWSTWTVEVTGLVKRPMRLTMDELVNGFPAVEVPVTLACSGNRRKEQNMVQQTVGFNFGAAAVSTSVWHGARLRDVLRRCGIMPSKGGALNVCFEGAEDLPGGGGSKYGTSITRQWALDPSRDIMLAYMQNGEPLLPDHGFPVRAIIPGCTGGRMVKWVKRIIVTTAESDNYYHYKDNRVFPSHVDAELANADAWWYKPEYIINELNVNSVITAPGHDEILPINGITTQRGYTMKGYAYSGEDKIFPILRLSYDDLPSHMKQCFAFCAIFPKDYEIDVETLIQLWLAHDFIPLQEEDHLETVAQNIFKELVWRSFFQDVNKISQREENVYRSQLRDRTTCKIHDLMHDISQSVMGKECLSIIGSSNLKNLMREHPLYHVLIPYTSIALPDDFMGNEAPALRTLLFRGYYGNVSTSHLFKYNSLQLRALELTRREELPIRPRHLQHLRYLNLSDNSNIHELPADISTMYNLQTLNLSDCYNLVRLPKDMKYMTSLRHLYTNGCSKLKYMPPDLGQLTSFSKTEHLLVITIQIYFEM

SEQ ID NO: 12403 - protein, 533 aa, Pisum sativum
MWDLNGSPSKRKDQESEGCSSPKTSLDGDEDKAKRVGVGGSVSNSSSSAIVIEEDSEEDNNNNNNRSMVKKKNSKIFGFSVTQEQEQEQEEEESLDSENFPVTRNFFPMDQEAENMVVASSGGNGTSSCSSTFPRAHWVGVKFCQSETLGSGKSMEVSSSSQPMKKSRRGPRSRSSQYRGVTFYRRTGRWESHIWDCGKQVYLGGFDTAHAAARAYDRAAIKFRGVEADINFNIEDYEEDLKQMSNLTKEEFVHVLRRQSTGFPRGSSKYRGVTLHKCGRWEARMGQFLGKKYVYLGLFDTEVEAARAYDKAAIKCNGKEAVTNFEPSIYDSELNTAEPASSGSDHNLDLSLGNSSSKHMNNTQSFGNNTSNVANHDQSNWQNGGNINKPKLVNILPKPYNRPNNMEPYGRDLHGENEALRMLSQTHLQSSSPNGIHRYGSLSRSTTNVHSFAHTNHQPPNFHFPSSSYGGRVGSDLSLSTNNHQQQQQQWQPGSHYLSSAAAASSGFPPQIRTPSSQTWLHKNGFHTLMRPS

SEQ ID NO: 12404 - protein, 248 aa, Glycine max
MILHDGSSSNCNSSFNISPETVVMVDPLSSACDRRNLPSEEESKNNDHGSGNKWMSSKMRLMKKMMRPSISPTTDKAINSSPRFQNHQGLESRRYSQRSPRNNNGSSTPRVCSDCNTSTTPLWRTGPKGPKSLCNACGIRQRKARRAMAEAANGLVTPIACEKTRLHNKEKKSRMNHFAQFKNKYKSTTTTTTTTVGSSEGVRKLEYFNNFAISLRSNNSDFEQMFPRDEVAEAALLLMDLSCGFVHL

SEQ ID NO: 12405 - protein, 465 aa, Unknown
  uncultured bacterium 105
MVTKETKAHSHTATSYTSDVLASVLERNTAEPEFHQAVEEVFTSLGPVLERRSDYRNARILERIVEPERVIMFRIPWQDDQGGIHVNRGFRIEMNSAIGPYKGGLRFHPSVNLGILKFLAFEQVFKNALTTLPMGGGKGGSDFDPKGKSDSEVMRFCQSFMTELARHIGPNTDIPAGDIGVGGREIGYMFGQYKRLRNEFTGVITGKGLNWGGSLIRPEATGYGSVYFAAEMLATKGKSLEDKVCLVSGSGNVAQYTVEKLIQLGAKVVTLSDSSGYVYDEAGIDKEKLEFIFDLKNVRRGRIKEYADKYKNVEYTASNPALDHNPLWNHQAQCAFPSATQNEINEKDAMAMLKNGVELVSEGANMPVTINGINQFLDAGIFYGPGKAANAGGVATSGLEMTQNAQRLVWTRAQVDERLQHIMKAVHKACYETAEHFGMPNNYLVGANIAGFVKVADSMLDQGIV

SEQ ID NO: 12406 - protein, 674 aa, Cryptococcus neoformans
MPDTPPHKHHYTSLRSLMHSPDPGNPAKRDSLTPRQPRPSRNSSSSRSRERRLDPPRKADKDKGRLSTWKLMCLTVSMGGSQIAWTVELGYGTPYLLSLGLSEQLTSLVWLAGPISGLIAQPLIGAISDSSHSRYRRRYWIVTSTMLLVFSGLGLAFTEPIAKALVDLIGGGQGDWDPKTIRLVKNTAIGIAVFSFYCLDFALNALQASLRNLVLDITPGEQLATANAWHGRFNHVGNIVGFTMGFLNLSHVPIIRLVGGGQFRKVCIVALVLLVMTVWITCWTQEEKETDSIFGERRSKIRDVVGTIYEAVLHLPKPIRRVCIVQIAAFMGWFPYLFYSTTYVAEVMAKELHHKPDIDRATRAGSLALLIYSFVAIIAGTLLPYLAARDRRLLKPTSEKLRDGEIEIENEDEEDEEHVEMERIREMVQQWKAEAAREGRPLKLPTMPFMLRNIWTAGLVIFGCLMMSTFFITKVWQATVMIALVGICWAIACWVPFAIIMEFLKELDDKPPPRISDGRPRPTHARTASTPLGWRSHPTSPAGRASPDERTPLARSYSTADLDGANEMEYTGQGPVAGGTIMGIHNLAIVFPQFIIAVVASIIFKLADTQPDIQPTSPEIGGPHGQDKNGVAWVLRFGGLMAFVGALVSRKVPPTKTEKAMRRRLADMREESAE

SEQ ID NO: 12407 - protein, 145 aa, Brassica napus
MGRRPARCYRQIGNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNA

SEQ ID NO: 12408 - protein, 605 aa, Aegilops speltoides
MAALVTSQLATSATVLGITDRFRHAGFQGVRPRSPADAPLGMRTVGASAAPKQQSRKAHRGTRRCLSMVVRATGSGGMNLVFVGAEMAPWSKTGGLGDVLGGLPPAMAANGHRVMVISPRYDQYKDAWDTSVVSEIKVADEYERVRYFHCYKRGVDRVFVDHPCFLEKVRGKTKEKIYGPDAGTDYEDNQLRFSLLCQAALEAPRILDLNNNPYFSGPYGEDVVFVCNDWHTGLLACYLKSNYQSNGIYSTAKVAFCIHNISYQGRFSFDDFAQLNLPDRFKSPFDFIDGYDKPVEGRKINWMKAGILQADKVLTVSPYYAEELISGEARGCELDNIMRLTGITGIVNGMDVSEWDPTKDNFLAANYNITTALEGKALNKEALQAEVGLPVDRKVPLVAFIGRLEEQKGPDVMIASIPEILKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 12409 - protein, 604 aa, Aegilops tauschii
MAALVTSQLATSGTVLGITDRFRRAGFQGVRPRSPADAALGMRTVGASAAPTQSRKAHRGTRRCLSMVVRATGSGGMNLVFVGAEMAPWSKTGGLGDVLGGLPPAMAANGHRVMVISPRYDQYKDAWDTSVVSEIKVVDKYERVRYFHCYKRGVDRVFVDHPCFLEKVRGKTKEKIYGPDAGTDYEDNQQRFSLLCQAALEVPRILNLDNNPYFSGPYGEDVVFVCNDWHTGLLACYLKSNYQSNGIYRAAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 12410 - protein, 568 aa, Rickettsia typhi
MSIKLKQRFVPQLAAINYQFEEDFSKMLKTVDTSHIKEKTVVKGQVIEIKNDMIIVDVGLKNEGRIPKSEFLSLPEVGDVVEVFIEKIEGRNGRTILSREKAVKEELWGQLEIMCSKGEFVDGTIFGRVKGGFTVDLSGVVAFLPGSQVDVRPIKDPTSIMNIKQPFKILSMDKKLGNIVVSRRVILEESRSEARDEMLSKIKEGMILEGVVKNITDYGAFIDLGSVDGLLHLTDISWGRVNHPSEVLEFNQKVKVMVIKFDEKTKRISLGIKQLDSNPWDAIKEEFPVGKKMTGKVTNFADYGVFLELKDGLEGLVHSSEISWLKSNQNPRKMLTIGQEVEFIVLEVDTEKHRVSLSIKQCQENPLIKFAENNPIGTIIKAPIRNITDFGIFVVLGNNMDGMIHEGDISWEDNGTDLLKSYKKGDEIECKVLAINFEKEQVSLGIKQLSPNPYQKISDEYKKGTIVKAVVTEIKDDGLVVLLNNKVTGFIKRVELSDEKDEQKPEMFQVDEEIDAKVVSIEKSTGRVLLSVKAHKIAERQKTLKEYGSSDNTTNMGDILANVLEEKK

SEQ ID NO: 12411 - protein, 583 aa, Lactuca sativa
MATASTSSSTIWANPNPRTTFSSSPKLPSSFSVSSRKKLKKISCALQSPSILQFPKQSPFQLPSSTPDSWNLLQKFSAMALDAIENGLIEQEKKHALPKTADPKVQISGNFSPVPEQSVRHCLPVVGEIPEHVQGVYLRNGANPLFEPTSGHHLFDGDGMIYAVKFENGSASFACRHTETQRLVQERALGKPVFPKAIGELHGHSGIAKLLLFYARGLCGLVDHSQGIGVANAGLVYFNNRLLAMSEDDLPYEVRVTPTGDLKTVGRYNFDEQLKSTMIAHPKLDPVSGELFSLSYDVIQKPYLKYFRFSPDGTKSKDVAIDLAKPTMVHDFVITENFVVVPDHQVVFKMSEMITGGSPVVYDKEKVSRFGVLDKYADDGSSIKWVEVPDCFCFHLWNAWEEPETDEVVVIGSCMTPADSIFNENNEELKSVLSEIRLNLKTGKSTRRAIISPENDVNLEAGMVNKNLLGRKSKYAYLAIAEPWPKVSGFAKVDLSTGETKKFIYGNQKYGGEPLFLPRDPNSETEDDGHILTFVHDEKTWKSELQIVNAITLQLEATVKLPSRVPYGFHGTFISANDLATQA

SEQ ID NO: 12412 - protein, 516 aa, Juglans regia
MEVESANKDMRAAQRSTLIRIVLVASIAAGVQFGWALQLSLLTPYVQLLGIPHTWAAFIWLCGPISGMLVQPIVGYYSDRCTSRFGRRRPFIAVGACFVAMAVFLIGYAADLGHLCGDHVDKPTRPRAIAFFVVGFWVLDVSNNMLQGPCRALLADLSGNDQKKMRTSNALFSFFMAVGNVLGYAAGSYTRFYKIFPFTKTKACDVYCANLKSCFFLSIALLSTVTILALTSVKERALSSQPKPENAAGEDEERVTESAGLPFFGEMWSAFKGLQRPMRILLLVTCLNWIAWFPFLLFDTDWMGKEVYGGTVERSGGKIVRSGVRAGALGLMLNSVVWGFTSLGVNVISRGIGGVKRLWGIVNFLLALCMAMTVLITKLAESARHTAAANGGATLSPPPAGVKAGALALFAVLGIPLAVTYSIPFALASIFSHASGAGQGLSLGVLNLAIVFPQMLVSVASGPFDALFGGGNLPAFVVGAISAAASGILSLTMLPFPTTDLLCFLKMQYPQFPAFH

SEQ ID NO: 12413 - protein, 241 aa, Unknown
  Synechococcus sp. WH 5701
MLSGPPASATASAEQLLERFSSSSPRQRRSLLPQIEARSQELRPLLLDALSRHDPDSDDWIAGLWVQMLLAENDSLREALLEGHPGGWLNVASADGIAYAPLQEALAEGSFELADRITSEVLRQLAGAEAVRRGYVYYSEVAPMPSLDLTSLDRLWVSYSRGRFGFSVQGRLLRACNGRWDQLWPRLGWKSEGTWTRYPSAFQWNLEAPEGHMPLINQLRGVRLMDALLNHPAVQQRISTG

SEQ ID NO: 12414 - protein, 769 aa, Oryza sativa
MATPDDGGGGVGGGAGKKFWRSASWSASRDTPPDAATPAGAGCVCCAWAGQARRIPPPPPLTPRGGNGRSCLPPLQPLNITRRSFDEWPRAGSEDVGDWPNGPPPAASKGEGAGSAKPGEGLRLDLSSLRSQGRKDQIAFFDKECSKVADHVYLGGDAVAKNRDILRKNGITHVLNCVGFVCPEYFKSDLVYRTLWLQDSPTEDITSILYDVFDYFEDVREQGGRVFVHCCQGVSRSTSLVIAYLMWREGQSFDDAFQLVKAARGIANPNMGFACQLLQCQKRVHAIPLSPNSVLRMYRMAPHSPYAPLHLVPKMLNEPSPAALDSRGAFIVHVLSSIYVWVGMKCDQVMEKDARAAAFQVVRYEKVQGHIKVVREGSEVPEFWDAFSSAPVNSDSNTKISKDQIDSASKTGPGNRRVESYDADFELVYKAITGGVVPAFSSSGAGDETHLPARESTWSSLRRKFISRSLARVYSDSALIRDLDPRVDRVQHLAAEASTSPPFLSPSSLSSDSSISSKYSSDSPSLSPSTSSPTSLGLSPASSNFSHTLVPSSRSPLHQSSNEEPSKSGLGSIRSPSKTSSIAERRGGFSSLKLPSFQKDLVLPPRVPTSLRREEEVTDKSNNNSVKQLTGVCCPEKCTGNTSTVHTKTGITERTDSISEACGNLQLLVYRWPSKEKLTTFTRKDLDPKSVLIFVTPEDSRSEAVKTVHIWVGGEYESSKCVDTVDWQQVVGDFFHLKELGNTLPVKVPTLILYNIYFVYSTLLLKVQC

SEQ ID NO: 12415 - protein, 434 aa, Anabaena variabilis
MTTLQVASSLNDIAQQTRQAASLLAMLSTEAKNQAIAAVAQALESAKEEILQANIADCEAATAEGIAKPLYKRLQLDEHKLRDAIAGVRDVGKLADPIGQVQIQRELDTGLVLKRITCPLGVLGIIFEARPEAAIQIISLAIKSGNGVILKCGKEAVRSCEAIVKAVKQGLSTTDVNPDVVQLLTTREETLELLRLDKYVDLIIPRGSNSFVRFVQENTRIPVLGHADGICHVYIDKSADIEKAIAVSVDAKVQYPAACNAIETLLVHHSIAAEFLPKVAQALAERQVELKGDERTLQILPEIAAATAIDWETEYSDFILSIKIVDSLTEAIAHINQYGSRHTDAIITEDVAAVETFFGLVNSAGVFHNCSTRFADGFRYGFGAEVGISTQQMPPRGPVGLEGLVTYKYQMTGTGHIVATYTGENAKPFTHQDF

SEQ ID NO: 12416 - protein, 483 aa, Ostreococcus tauri
MIPAAFDDDLMISFDDDEEDVGEDDKEMEERALIEATVARLRSRQALGKTLMTEKPKAPVAMTAGAKAARKLGRNTVKKSDWQSFVDWKTLEHQEFETLSDEEFAKLSKKLALEPQWRPMVSYLKSLGLKTRDLEKVAINCTDLLNRPVSRVISRVEYLEGELGLEKKNLRQIVNKDPRILLQRNRHSIPRCRYLTKIGLPQEKLADVLGKQPSILHLSVQKGLMPRVQYLKDEVGVSAEDIPLLIQRSPAVLTFSIENQIQPRVEFLYDLGISKENVVKMLTRHPQMLQYSFENLEEKLKFLGDIGMDDNEAALTVTRLSQFFSLSVEDSLRPKFKYMTDELGGTKDTCVKYPAYFSLSLDNRIRPRHKFLEQFDLAPDPFPMKLLSVRDDEFVLRASKSLNEFEEYKTQMVPIFTAQTAREKSLRMNSSMAQHEKLLLERRRVEFIRRNQQETARQREMSDRVAKARQSLRILRNSQHRSR

SEQ ID NO: 12417 - protein, 423 aa, Unknown
  Burkholderia sp. 383
MDIDQYMTDLGRRARHASRAMARASTAAKNAALDAVARAIERDAQVLKDANARDVARAREKGLDAAFVDRLTLSDKALNTMVEGLRQVASLADPIGEISNLKYRPSGIQVGQMRVPLGVIGIIYESRPNVTIDAAALCLKSGNATILRGGSEALESNTALAKLIGEGLEAAGLPQDAVQVVATADRAAVGKLITMTEYVDVIVPRGGKSLIERLINEARVPMIKHLDGICHVYVDDRADLAKALTVCDNAKTHRYGTCNTMETLLVSSGVAAKLLPPLGKLYRDKQVELRVDAAARTVLADAGVGPLVDATEEDWHTEYLAPVLAIKVVDGLDAAIEHINHYGSHHTDAIVTEDHDRAMRFLREVDSASVMVNASTRFADGFEFGLGAEIGISNDKLHARGPVGLEGLTSLKYVVLGHGEGRQ

SEQ ID NO: 12418 - protein, 407 aa, Unknown
  Nocardioides sp. JS614
MDEYSTYPSGLRLSGRRVVVVGGGQVAQRRVPHLIAAGADVHVVSPQVTPAIEGMVGSGEVTWHERGFADTDLDEAWYVVAATDDHAVNEQVSDAAEARRVFCVRSDDASRASAWTPAVGRHAGVTVAVLGQREPRRSAAVRDEILEGLREGTIVARHQRDRSAGVVLVGGGPGDPELMTVAGRKALVEADVVVADRLAPRELLGELPADVELIDVAKLPRGRSALQEEINRVIIERARAGKRVVRFKGGDNFVFGRGFEEVIACREAGVPVTVVPGLTSSIAVPAVAGIPVTHRGVAHEFTIVSGHLPPGHPQSQVNWTALGALRGTVVLMMAVENAPRIATALVAGGRAGSTPVAVVCEGTMPGERTVLATLDTLATRLEEESVRPPAVIVVGEVVRVAHPRHFA

SEQ ID NO: 12419 - protein, 377 aa, Hordeum vulgare
MAPVSNETFLPTEAWGEATLRPSFVRDEDERPKVAHDRFSDAVPLISLHGIDGARRAQIRDRVAAACEDWGIFQVIDHGVDADLIADMTRLAREFFALPAEDKLRYDMSGGKKGGFIVSSHLQGEAVQDWREIVTYFSYPVKARDYGRWPEKPAGWCAVVERYSERLMGLSCNLMGVLSEAMGLETEALAKACVDMDQKVVVNFYPRCPQPDLTLGLKRHTDPGTITLLLQDLVGGLQATRDGGKNWITVQPISGAFVVNLGDHGHFMSNGRFKNADHQAVVNGESSRLSIATFQNPAPDARVWPLAVREGEEPILEEPITFTEMYRRKMERDLDLAKRKKQAKDQLMQQQLQLQQQQAVAAAPMPTATKPLNEILA

SEQ ID NO: 12420 - protein, 415 aa, Arabidopsis thaliana
MANNNVYSVLKSLLLLLHLVFLSKQHVDSASIVKFLPGFEGPLPFELETGYIGVGEEEEVQLFYYFIKSERNPKEDPLLLWLTGGPGCSAISGLLYQNGPLAMKLDVYNGTLPSLVSTTYSWTKTSSMIFLDQPVGTGFSYSRTQLFNKPSDTGEAKRIHEFLQKWLGKHQEFSSNPFYVGGDSYSGLVVPATVQEISKGNCQCCNRPINLQGYVLGNPLTDCVYDCNYRVPFAHKMALISDELYERTCRGEYVNVHPHDTECLKFVEEFNKSYRFMLTTYWANDETVRKALQINKESIGEWTRCYRGIPYNHDIKSSVPYHMNNSIDGYRSLIYSGDHDIQVPFLGTQAWIRSLNYSIIDDWRPWMIKDQIAGYTTSYVNKMTFATVTGGGHTAEFTPKETFMMFQRWINGQPL

SEQ ID NO: 12421 - protein, 349 aa, Oryza sativa
MDPDAVKSTLSNLAFGNVMAAAARDYQKVTSLTHSRNWLWRLVSEPGVLLDGSRHQRGGIESRFLIGSGVDGRLIRPRSTRLSCAAGLQPWIVEGRGNGEDDLVILLIFFLDLQQQNVVFASKCRGSFATGMDCGRYNHRSTWRMILEIVAKEKAQAANASHDEVDLDELLDDPELEKLHAERIAALKKEVEKREVLKRQGHGEYREITEGDFLGEVTGSEKVICHFYHREFYRCKIMDKHLKTLAPVYLGTKFIKLDAENAPFFVTKLGIKTLPCVILFKKGIAVDRLVGFQDLGSKDDFSTRALENILKMKGIIDEKKKDEDDEDDETDMSMNRRIRSSTAQDSDSE

SEQ ID NO: 12422 - protein, 307 aa, Carboxydothermus hydrogenoformans
MERYDVIIIGAGPAGLSAALYSARSKLSTLYIEKLSTGGQAATTDEIENYPGFAHGISGPELTAQMEEQAKRFGAKKLLAEVKGIELAGADRIVKTTKGNFVAKVVIIASGAAPKLLGCPGEQEFRSRGVSYCATCDAAFYEGANVMVVGGGDSAVEEACYLTKFADKVTLVHRRDTLRATKVLQERAFANEKLEILWNTVVEEIIGTDVVEKVRLKNVVTGEVFEREIDGIFIYVGLKPNTEFVKGLVNLDEQGYIITDENMRTNIPGIYAAGDVRQKLLRQVVTAAADGAIAAYHAEKYLEECTE

SEQ ID NO: 12423 - protein, 469 aa, Oryza sativa
MATRLEQCCLLLLLLLLLCSCSSAAVAAASPAAMSSSRKAVDRLPGFAGPLPFSLETGYVAVGEARFFYYFIESERSPEEDPVLLWLTGGPGCSAFSGLIYEIGPLFFDFHGYKGGLPTLHYKANSWSKISNVIFVDSPPGTGFTYATTAEGLKSSDTIVVHQLYTFIQKWFDDHPQFSSNPLYVSGDSYSGIIIPTLTMEIAKGKESSDERHLNLKGYIAGNPLTDTTHDDNSKFPFLHSLGIIDDELYEVARKNCKGDYMTPPNSQCANSVQAIRDCIRDVNDLHILEPRCEEDGISLVSDNSASSHDRRTKLLESAVSSICRNATYVLSKIWANDEAVRESLGIHKGTVTTWERCNHDLLYKKQIVSSVEYHLSLITQGYRGLVYSGDHDSVVSLIGTQGWLRSLNLSITHGWRPWYVNSQVVGFTRTYSNNLTYATVKGAGHTAPEYMPKECLAMVDRWLSGEPL

SEQ ID NO: 12424 - protein, 404 aa, Thermobifida fusca
MSQARAWDTRLSHHWAQSTSGEKQTSMSTKDYLEKDYYKVLGVSKTATADEIRSAYRKLARKYHPDANKGDAQAEKKFKEISEAYSVLSDEKRRKEYDEARSLFGGAYRPGGGGIGDFNLGDLFGHTTTGGERLTDLFGGLFGGRGRATQSRRGADLETETTLSFTEAVSGTTKSFTLTTTVSCPTCRGSGAKPGTTPRVCPRCAGTGHESTNLGGFSLSEPCALCKGRGYLADDPCLTCSGTGNVKGTRTVQARIPPGVSDGQRIRLRGKGEPGERGGPAGDLFVTVRVTPHPVFGRSGDNLTLTLPVTFPEAVFGAEVRVPTLSGPPVTVRIPPGTRNGRVFRVRGKGATRRDGTTGDLLVTVEVAVPQNLNSEAREALQRFQAATADHNPRADLEARAKGA

SEQ ID NO: 12425 - protein, 693 aa, Cucumis melo
MMMMFNEMGFCDDMDFLSASIVEGDAVAPPTDPEVLVEDDYSDEEIDMDELERRMWRDKMRLKRLKEQSKVKEGIDIVKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPSGAEEWWPQLGLPKDQGPPPYKKPHDLKKAWKVGVLTAVIKHMSPDIAKIRKLVRQSKCLQDKMTAKESATWLAIINQEEILARELYPDSCPPLSSGGGSGSLVINDCSEYDVEGAEEEPSFDVQDRKPDNHSSFNLGMDRMRDRVSLRQPPYAMKGEVTTNLDFMRKGKPTSDLNMMMDQKIYTCEFLQCPYSELRLGFNDRTSRDNHQLTCPYRTSSEFSGSSFHVNEVKPVIFPQSFAPPKSMHPPSAQFRHFRLSTLGVPEDGQKLTSELMSIYDTNIQGNKNNLNTVNSATTENQNLPQLKIQPQQDDYFRNQGLMMEGNFFDGSNVSSSHQMFTRDEGQFDRFKPMNSPFENNHHHHNNNNNFHLMFSSPFDLSTFDYKEEVPSVQPSTHCRNSRIFHYGIIKPALTPMLYRRILSVKSISSNISCSSEIHSSSFYSLSISLSLSWGLPFAFTRNQSKLPFGVCLTWCYVI

SEQ ID NO: 12426 - protein, 615 aa, Cucumis melo
MNTMGIFEDISFCRNLEYFSAPPGEQETAQEHEAEAVLEEDYSDEELDVDELERRMWRDRMLLRRLKEQSKEKEGADSSKQRQSQEQARRKKMSRAQDGILKYMLKMMEVCKAQGFVYGIIPEKGKPVSGASDNLRAWWKEKVRFDRNGPAAIAKYEADHAIPGNNDECNTVASTPHTLQELQDTTLGSLLSALMQHCDPPQRRFPLEKGVSPPWWPTGNEEWWPELGLPKDQGPPPYKKPHDLKKAWKVSVLTAVIKHMSPDIAKIRKLVRQSKCLQDKMTAKESATWLAIVNQEEALARKLYPDKCPPVSICGSGSLLISDTSDYDVEGVEDEPNVEAEESKPHDLNFFNMGAPGSRERLMMPPVCPQIKEEFMENNSDFNQKRKQMTDESNTIMNPKMYTCEYSQCPYNSARLGFLDRNSRNNHQLNCPFRSDSSHIFSMPSFQSNEDKSASPIPPSFNHPKAPARLMNLTPPFRVSGLGLPEDGQKMISDLLSFYDSNLQQDKHLNSGNLDMQDDHNQQQQLPKFQLQVDDNLYCQATMVGNTMPIQQHPDFSSNKHPFDEYKAAFDSPFGMYPNDNISDFRFGSPFNLASIDYAAADTQLPKQDTPLWYL

SEQ ID NO: 12427 - protein, 963 aa, Unknown
  Acidovorax sp. JS42
MSAAPHTGAGAVPFELDGELLQALPGETLWQAARRYGVQIPHLCHTDGLRPDGNCRACVVEIEGERTLAPSCCRAPTPGMRVHAQSPRALKSQQMVLELLLSDMPETGYKWNDATKIIADSACQESVGAQFDQVPTPPGQHGELSAWADALGVAVRPALAALRRAQPAPDLSHPAMAVHLDACIQCNRCVRACREEQVNDVIGYALRGADSKIVFDLDDPMGASTCVACGECVQACPTGALSPKTHIGPQKVDRTVDSVCPFCGVGCLVTYHVKDEKIVRVDGRDGPANRGRLCVKGRFGFDYAHHPQRLTVPLVRKPGVPKDWQGAVRPEDWREVFREATWDEALQRAAGGLRALRDAHGPKALAGFGSAKGSNEEAYLFQKLVRTGFGSNNVDHCTRLCHASSVAALLEGVGSGAVSNPVSDVAHAEVILVIGSNPTSNHPVAATWIKNAARRGAKIVLADPRVTDIGRHAWRVLQFRPDTDVAVLNALIHTVIEEGLADEAFIRDRALNYEALRENVRAYSPEAMAPLCGIPADTLREVARAFATAKASMVLWGMGVSQHVHGTDNVRCLIALATVTGQIGRPGTGLHPLRGQNNVQGASDAGLIPMMFPNYQRVDNAEARAWFEQFWGLPLDDAPGYTVVEIMHKALAHEADPHKVRGMYIMGENPAMSDPDLNHARQALASLAHLVVQDIFLTETAWLADVVLPASAWPEKTGSVSNTDRMVQLGRRALTPPGDARPDLWIVQQMAKGMGLAWDYEGAEAGVAAVYEEMRQAMAGAIAGISWDRLERESSVTYPCLSAEDPGQPIVFTERFPTPTGRVTLVPADIIPADERPDAHYPLVLITGRQLEHWHTGSMTRRSAVLDAIEPHATASLHGDELARLGLAPGDWAAIRSRRGAVQVRVRRDDGTPRGAVFMPFAYVEAAANLLTNAALDPFGKIPEFKYCAVAVRGIAPPQGQGG

SEQ ID NO: 12428 - protein, 135 aa, Erwinia carotovora
MRLLHTMLRVGDLQRSIDFYTQILGMRVLRTSENTEYKYTLAFVGYTEESEGAVIELTYNWGVDSYDLGNAYGHIALGVDDVAATCERIRKAGGNVTREAGPVKGGTTVIAFIEDPDGYKIELIENAHAGSGIGH

SEQ ID NO: 12429 - protein, 365 aa, Unknown
  Rhodococcus sp. RHA1
MTTAVSPKPGAALRNRAFHTLTVADVESLCDDAVAVTFDVPAELADEFAFGPGQSLTLRRTIDGVEHRRSYSICAPSGSAPRVGVREVSDGLFSTWLVRDVRPGDRIEVQGPSGTFVADPAAGGRHVLIAAGSGITPMLSIAASMLANPEAEVVLLYGNRRTRSVMFAEEIADLKDTYGSRFDIIHVLSREPREVELFTGRLDADRLRAIFDAVVPVADIDHFWLCGPYGMVTDAETVLGDLQIDKSRVHHELFFVDDVPPPMETHREPGVTGPSSEVTLVLDGRSTTATLPRDESILDAAEKYRSDLPFACKGGVCGTCRAKITCGDVDMRRNYALEDYEVDSGFVLTCQTFPVSDNVTVDFDA

SEQ ID NO: 12430 - protein, 589 aa, Unknown
  uncultured bacterium 105
MASADETENIELTQGGPDSTVVKSEPHDLVEDPDTPDPDEYARLLELYDSSFRNIAEGEVVSGTVLQVTSSEVVVDVGYKSEGMIAIEEFRNERGEIVVQMGDIVDVLLERTEDRHGYVVLSREKAEKMKIWDEIEKAYNDQKVVIGHVIERIKGGLAVDIGVRAFLPGSQIDVRPVRNLDSLRGEELRMRVIKVNKKRGNIVLSRKVLLEEENADKKQKTLSTLAEGKVIKGIVKNLTDYGAFVDLGGFDGLLHITDMSWGRVSHPSELFKINDEAEVIVLKFDPETERVSLGYKQLIADPWDGVGDRYPVNERVNGRIVSLTDYGAFVELEPGVEGLIHVSEMSWSKRVKHPSKILTVGDTVEALVLAVDPNARRISLGLKQIEVNPWLQIADRYPLGTKITGTVRNVTEFGAFVEVEEGVDGLIHISDMSWSKRLQHPSEVVNKGDEVESVVLNVDAENQRLSLGLKQLSTDIWDEFLSNNSAGDVVEGKIVKLTNFGAFVELADGIEGLIHISEFDDEQGDEKIELEVDQAYSMKIIKLSAVDRKIGLSIRALKLGDEAVDWTSQDEQSSSPEATLGDHFKGLQE

SEQ ID NO: 12431 - protein, 90 aa, Malus xiaojinensis
TGVRMGALGLMLNSVILGITSVLMEKLCRKWGAGFVWGISSILMTLCFFAMLVITFVNKSIGVGGHDLPPDGIVIAALVVFAVLGIPLAI

SEQ ID NO: 12432 - protein, 73 aa, Sinningia micans
ISGTNGEVMPGQWEFQVGPSVGIEAGDHIWCARYLLERITEQAGVVLSLDPKPIEGDWNGARCHTNYSTKSMR

SEQ ID NO: 12433 - protein, 316 aa, Arabidopsis thaliana
IKKKIRAMSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 12434 - protein, 356 aa, Saussurea medusa
MVAVSGNTRVESLATSGIHQIPKEYIRPQHELQTITNIFDEQNDQNAPQLPTIDLNDIHSHDPMTRQRCRDELTKAATEWGVMHLVNHGISGELIDRVKAAGESFFNQPVEEKERYCNDIGSGKIQGYGSKLANNACGQLEWEDYFFSSRLPRGERDLNVWPTTPDDYIPATTEYAKQLRALATKILSVLSLGLGLEEGRLEKEVGGMEELLLQLKINYYPKCPQPELALGVEAHTDVSALTFILHNMVPGLRLFYGGQWVTAKCVPDSIIVHIGDTIEILSNGKYKSILHRGLVNKEKVRISWAVFCEPPKEKIVLKPLPETVFEKEPPLFPPRTFHQHMEHKLFRKNNDIVDPK

SEQ ID NO: 12435 - protein, 338 aa, Glycine max
MDTKVLSSGVQYSNLPESYIRPESERPRLSEVSECEDVPIIDLGCQNRAQIVHQIGEACRNYGFFQVINHGVALEAAKEMAEVAHGFFKLPVEEKLKLYSEDPSKTMRLSTSFNVKKETVHNWRDYLRLHCYPLDKYAPEWPSNPPSFKETVTEYCTLVRELGLRIQEYISESLGLEKDYIKNVLGEQGQHMAVNYYPPCPEPELTYGLPGHTDPNALTILLQDLQVCGLQVLKNGKWLAVNPQPNAFVINIGDQLQALSNGLYKSVWHRAVVNVEKPRLSVASFLCPNDEALISPAKPLTEGGSEAIYRGFTYAEYYKKFWSRNLDQEHCLEFFKNK

SEQ ID NO: 12436 - protein, 179 aa, Photobacterium profundum
MILMSTDIIIIIPKQTLVFCTNKLELYMQVTTRTMNKSKHIALVAHDNCKQDLLRWVKEFEDKLEDHTLYATGTTGHLLSKETGLKINCMISGPMGGDQQLGALISESKIDMMIFFWDPLNAVPHDPDVKALLRISAVWNVPVATNRASAKFMITSPLLAEEISIEIPDYEAYLAERIG

SEQ ID NO: 12437 - protein, 178 aa, Ustilago maydis
MFITTEEETLAAFQHHHTGACRTIATTMLLQTLRTTTKAAPLCGSPIAASAAVRTFASTSRAYKVYENVSAADFQSRVLSPSGADAETPVLVDFFATWCQPCKLLSPALKKVASNPDVVGGKHIDLVTIDVDQHQDIAQQFKVSAMPTVIAMKGGKVLDGFVGMLPENKVIEFVQNLK

SEQ ID NO: 12438 - protein, 554 aa, Vibrio vulnificus
MCSVFGILDIKSDAAALRPIALEMSKKLRHRGPDWSGIYASDRAILAHERLAIVGLNSGAQPLYSPDKKLILAVNGEIYNHKEIRARYEGKYDFQTDSDCEVILALYQEMGADLLEELNGIFAFVLYDEEKDQYLVGRDHIGIIPLYQGYDEHGNYYVASEMKALVPVCKTISEFPPGSYYSSTDAGPQRYYIRDWNEYAAVQGNTSSKEELTAALEAAVKRQLMTDVPYGVLLSGGLDSSITSAVAKRYAAMRIEDDEQTEAWWPQLHSFAIGLDGAPDLKAAREVAAKIGTVHHEMTYTIQEGLDAIRDVIYHIETYDVTTIRASTPMYLMGRKIKAMGIKMVLSGEGADEIFGGYLYFHKAPNAQEFHEETVRKLLALNMFDCARANKSLAAWGVEGRVPFLDKEFIDVAMRLNPADKMCGNGKMEKHILRECFEHYLPDSIAWRQKEQFSDGVGYGWIDTLKAVAEEKVTDQQMEAAKFRFPYNTPTTKEGYVYREIFEELFPLPSAAECVPGGPSVACSSAKAIEWDESFKNCIDPSGRAVKAVHNEAY

SEQ ID NO: 12439 - protein, 964 aa, Prochlorococcus marinus
MRNTKASKFSDRHLGLIEEAQVEILNALGHADINDFISSVVPEEILDAQPPDELLPKALNEIEALEELRSIAKKNQIKRSLIGLGYYGTYTPAVIQRHVFENPAWYTSYTPYQAEIAQGRLEALFNFQTLITELTGLPIANASLLDEGTAAAEAMSLSFAVNKQTKARKFIVDDQVLPQTLAVLKTRAEPLELDIEVVNLTDLVINETVFGLLIQLPGKSGQLWDPSSLIAQAHEFNALVTVAIDPLAQVLIAPMGQLGVDIAIGSSQRFGVPIGFGGPHAAFFAIKEEYKRLVPGRLVGQSIDSKGHSALRLALQTREQHIRRDKATSNICTAQALLATIASFYAVYHGPHGLEEIAKNIIYLRSQLELYLKEFGYTFAPDCRFDTLEIHCLEAPEIHRLSILSGFNLRILPLGASIEKSKGFAVSFDELSTTKELYKLCKIFADVKDKNFEPRENTNFNFKESLTSLPLRTTPWLKQQVFNNYRTETELMRYIQKLASRDFSLVNGMIPLGSCTMKLNATAELLPITWKEFSSIHPFVPSDQAKGYGYLSEQLEGWLCALTGFDGVSLQPNAGSQGEFAGLLVIRAWHKAINQADRNICLIPKSAHGTNPASAVMAGFKVVAVECDEYGNIDFEDLVLKVETYSSELGALMITYPSTHGVFEPNIRQICDQVHLHGGQVYLDGANLNAQVGLCRPGAFGADVCHLNLHKTFCIPHGGGGPGIGPIAVAKHLVAFLPSKNFHASDNNAAIGAISASPLGSASILPISWMYIRMMGADGLRQASSLAILSANYIANKLDPYFQVLFKAPNGKVAHECILDLRSIKRITGIEVDDVAKRLMDYGFHAPTISWPVAGTLMIEPTESESFEEINRFCEAMISIRSEIDAIESGITDLSNNPLRLAPHTMETVTAEIWDRPYTRQQAAFPLKDQFMNKFWPAVSRIDNAFGDRNLVCSCSTLEELSET

SEQ ID NO: 12440 - protein, 435 aa, Trichodesmium erythraeum
MGNTIALLAYDSKKDNLVEFVKKHKIVLSRYQLVATESTAQYILQEVDIEINSVLAGPLGGDAQLAVEVTTGNVVAVICLVDYLFSQSYEPDIKLLLRLCQVHNVPIAINIATAEIIIKGFIQTTVAHLIFNPISGKGNAQQDLLLIKSLLEPHLHLDIHQTTPEKTAEELTELAIAKQADIIIACGGDGTVSAVAGALVNTNIPLGIIPRGTANAFCMALGIPSIAPIRGACDLILAGKTRVIDVGRCNERTMILLAGVGYEAETIERADREAKNRWGVLAYMMAGWRQLTEQQLFDIEIEIDGVAKTFQAGAITIANAAPPTSFLAQGLGKVIMNDGLLEVMIITSKNTLQAVNAGVRMFGSAIFQTPTQHEDTIALRTKRVKVSADPPQKVVLDGEIIGTTPIEVECIPNGLTVLAPPTNEAEEKPAWGFFS

SEQ ID NO: 12441 - protein, 319 aa, Bacillus cereus
MKRIGVLTSGGDSPGMNAAIRAVVRKAIFHDIEVYGIYHGYAGLISGHIEKLELGSVGDIIPRGGTKLYTARCLEFKDPEVRLKGIEQLKKHGIEGLVVIGGDGSYQGAKKLTEQGFPCVGVPGTIDNDIPGTDFTIGFDTALNTVIDAIDKIRDTATSHERTYVIEVMGRHAGDIALWAGLADGAETILIPEEEYDMDDVIARLKRGSERGKKHSIIVVAEGVGSAIDIGKHIEEATNFDTRVTVLGHVQRGGSPSAQDRVLASRLGARAVELLIAGKGGRCVGIQDNKLVDHDIIEALAQKHTIDKDMYQLSKELSI

SEQ ID NO: 12442 - protein, 148 aa, Brassica napus
  misc_feature (6)..(6): Xaa can be any naturally occurring amino acid
  misc_feature (12)..(12): Xaa can be any naturally occurring amino acid
  misc_feature (14)..(14): Xaa can be any naturally occurring amino acid
  misc_feature (17)..(20): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (42)..(42): Xaa can be any naturally occurring amino acid
  misc_feature (47)..(48): Xaa can be any naturally occurring amino acid
  misc_feature (53)..(56): Xaa can be any naturally occurring amino acid
  misc_feature (59)..(59): Xaa can be any naturally occurring amino acid
  misc_feature (68)..(68): Xaa can be any naturally occurring amino acid
  misc_feature (71)..(71): Xaa can be any naturally occurring amino acid
  misc_feature (73)..(73): Xaa can be any naturally occurring amino acid
  misc_feature (77)..(77): Xaa can be any naturally occurring amino acid
  misc_feature (99)..(99): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(107): Xaa can be any naturally occurring amino acid
  misc_feature (109)..(109): Xaa can be any naturally occurring amino acid
  misc_feature (111)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (119)..(119): Xaa can be any naturally occurring amino acid
  misc_feature (126)..(126): Xaa can be any naturally occurring amino acid
  misc_feature (128)..(128): Xaa can be any naturally occurring amino acid
  misc_feature (131)..(131): Xaa can be any naturally occurring amino acid
  misc_feature (139)..(139): Xaa can be any naturally occurring amino acid
  misc_feature (144)..(144): Xaa can be any naturally occurring amino acid
KREQVXASSMFXSXAVXXXXAQATMVAPFTGXLKSSXAXPVXRKANXXITSIXXXXGRXSCMKVWPPXGKXKXESLXYLPDLTEVELGKEVDYLLRNKXIPXVEXEXEXGXXYXEXGSXPGYYDGXYXTMXNLPLVGCXDSAQXLEGS

SEQ ID NO: 12443 - protein, 168 aa, Zea mays
MAAWSTATSVHDFIVKDASGKDVALSTYKGKVLLIVNVASQCGLTNSNYTELAQLYEKYKAQGFEILAFPCNQFGGQEPGTNEEIVQFACTRFKAEYPIFDKVDVNGNNAAPIYKFLKSSKGGLFGDSIKWNFSKFLVDKEGRVVDRYAPTPSPLSIEKDIKKLLGSS

SEQ ID NO: 12444 - protein, 415 aa, Bordetella pertussis
MFNRNLTLDQVDPDVWAAIQKEDVRQEQHIELIASENYASPAVMQAQGTQLTNKYAEGYPGKRYYGGCEYVDVVEQLAIDRLKQIFGAEAANVQPNSGSQANQGVYMAVLKPGDTVLGMSLAEGGHLTHGASVNASGKLYNFVPYGLDADEVLDYAQVERLTKEHKPKLIVAGASAYALHIDFERMARIAHDNGALFMVDIAHYAGLVAGGAYPNPVPHADFVTSTTHKSLRGPRGGVIMMKAEFEKAVNSAIFPGIQGGPLMHVIAAKAVAFKEALSPEFQDYAQQVVKNAKVLADTLVKRGLRIVSGRTESHVMLVDLRPKGITGKEAEAVLGQAHITVNKNAIPNDPEKPFVTSGIRLGTPAMTTRGFKEAEAELTANLIADVLDNPRDEANIAAVRARVNELTARLPVYGN

SEQ ID NO: 12445 - protein, 652 aa, Ostreococcus tauri
  misc_feature (1)..(2): Xaa can be any naturally occurring amino acid
XXVPGASGGTVHVLGVRERWDDDAFARWLDGLGVRRASARTRRGRGYGFVTFGDVRDRLAGQRAMENAMIGGGGRVRVREAMTRGRGGVVGEDGDAEDGRDVVARANARARRDIRDVITPMWRASYGEQLCAKKEIVAESLREITRGAGMAATCDWLRDALGRDKLCCEIEGIVRSPVLDGYRNKSEFTIGPSADGEITCGFNVGSFRDGVVAVAPPVGCRNISETAKYLGDATQTYLRERATAGEGLPVYDKRTATGFWRLFLCREGGTAPSSEHGWRHWLRPGTGPPKPPTGENGEPAETENVEPFEYPDEEASLPAPTTKDEKSEVMVMFQVRRSGYTEEQIREECDGARDAVLEAAAKATPPINVKVIVVQFYDGVSNVAPDDAEIRDMRTFETSEKSSDVIHERMCGLEFSLSATAFFQVNTLAAEALYRLAGEWASPNGKSLLLDVCCGTGTIGMTLAGNVKKVVGVDIVEESIKDAFVNAQLNGVTNTDWLAGKAEVVIPKVLREYNSRIRPVVDAPKIGTKRKATSNDPELSDGSDDEAAIQAAVTTIIDENEYEFDDVVAIVDPPRGGLHRSVLTALRREKRLKRLVYVSCNSSTMAKNVIDLCAPQGYDGNGGGAPFAPVKAIALDLFPHTAHVEAIVLLER

SEQ ID NO: 12446 - protein, 279 aa, Pseudomonas aeruginosa
MNTTVIPPSLLDVDFPAGSVALVGAGPGDPGLLTLRAWALLQQAEVVVYDRLVARELIALLPESCQRIYVGKRCGHHSLPQEEINELLVRLARQQRRVVRLKGGDPFIFGRGAEELERLLEAGVDCQVVPGVTAASGCSTYAGIPLTHRDLAQSCTFVTGHLQNDGRLDLDWAGLARGKQTLVFYMGLGNLAEIAARLVEHGLASDTPAALVSQGTQAGQQVTRGALSELPALARRYQLKPPTLIVVGQVVALFAERAMAHPSYLGAGSPVSREAVACA

SEQ ID NO: 12447 - protein, 625 aa, Cornus unalaschkensis
MASSGEQNQVELLENLKNRLAIAVRSIQWSYAIFWSISSRQPGVLEWGDGYYNGDIKTRKTVQVVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDTDLDAALECGEIVMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNVDGILSLSIKSKFKGSTVASTGMIIQALQRIICKC

SEQ ID NO: 12448 - protein, 196 aa, Triticum aestivum
MDTHIGSVDGPSPAAVNGAVGCPASAPGCPIMSSHPVVSAGEASLGRHLARRLVQVGVSDVFAVPGDFNLTLLDHLVDEPGLRLVGCCNELNAGYAADGYARARGVGACAVTFTVGGLSVLNAIAGAYSENLPVICIAGGPNSNDYGTNRILHHTIGIPDFSQELRCFQTVTCHQAVVTNLDDAHEQIDTAIATAP

SEQ ID NO: 12449 - protein, 625 aa, Cornus cf.
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSCYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKVSILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 12450 - protein, 524 aa, Burkholderia thailandensis
MSFGPLDSTNREETLDIAIIGTGFSGLGMAIRLRQTGNQDFAVFEKANSVGGTWRDNHYPGCACDVQSHVYSFSFAPNPRWTRMFAPQPEIRAYMEDCVQRFNVGSHLRFNHELVNATYDETAHRWRLTFANGKRVCARVLVSGMGGLSRAAYPNIPGIETFKGEAFHSQHWNHDYSLEGKRVAVIGTGASAIQFVPQIAPRVANLALFQRTPPWIMPKPDRPVRGIEQWLFRNLPFTQKLMRAGLYWMLESRVLGFAVHPSTMKLVQKLALRHIDRQISEPELRAAVTPDYTIGCKRILMSNDYYPALTRKNVDVITTGIERIEEDAVVTTDGKRHEVDCLIYGTGFQINNPFPRGTIVGRGGVDVVDAWRDGLHAYLGATVPGYPNWFILMGPNTGLGHNSMVYMIESQIEYVLGALKAMRTERAEAIEVRPLVELEYNNRIQNKLKGTVWSTGGCSSWYLDPRTGKNTTLWPTFTWRFRQETAFFSMADYHVYYANPRQNAQAVPALPNAAAATAAAETTA

SEQ ID NO: 12451 - protein, 112 aa, Unknown
  Nocardioides sp. JS614
MRLVTAVIKPHKWEDVREALEAFGVTGMTVSEVSGYGRQKGHTEVYRGAEYDIALVPKVRIEIVVADDDADDVVGIIVKTAQTGRIGDGKVWVSPIDTVVRVRTGDRDDAAL

SEQ ID NO: 12452 - protein, 350 aa, Thermosynechococcus elongatus
MRINSLLWASIASLGLWMASPVHANSPVSRLMQEGQRLVEGGNYAQALAIYQQLLESESRNPRVHSAIGYIYAQQGQFGEAARAYQRAIELDQQNADFYYALGYSLGMMGENQGAAAAYRQAIRLNHRNAQAYEGLAVILARLGDPQGAIEAYRSALRLAPGNWAAQKGLGVLLLQQGNIPEALSRLQQAAALAPGSASIQINLGMALLAAGDPSNGWQAIDRAAHLGQRDADLLQQVAELAAAANQPERAIQAYRRLITLQPERVATYFSLGELLMQQNHPLEAAAIYRQATQINPQDPEGFYRLGKALAAQGRRQEARNAYQVALKLYREQNNPTGETKVRNAMRQRN

SEQ ID NO: 12453 - protein, 625 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRTICKC

SEQ ID NO: 12454 - protein, 483 aa, Caulobacter crescentus
MNRRDILRGAALTGAAAVLTPETLWAAAANDWTLGIADVEADIAPTGLTRIHGRAPADLTGTLFRNGPAKFRRPGGAVGHWFDGDGMVRKFQMADGQARMTARFVDTVKRRQDTAADAVITPGYGTASGPGARLGSADDANAANTSVMMAGGELWALWEGGSPTAMDPVTLETRGFKALSPDMKGMPFLAHPRVEPDGTVWNLGLAGKRAVVWNLSADGALRKAEVITLPRAGYMHDFTATERSLVIILQPWVQEGMSMPIATNMVWRPELGTKVLVLDKNDLSKRRVFELPPFFFFHLGDAWEEADGTIRFDACIDKDPSGTAANGGAIVRGEFLKAPPPRRAMITLRANGQAELAAEAVSAEFPRSDPRFAGLARRYSVHLTNERPDRPLFQSVAVRDWKKDRDQVFDFGARHLVEEMVFALRPGSSAELDGWLVGTTLNLDARATELHVFDARHVERGPLVTWRASVALPVTFHGVFVGA

SEQ ID NO: 12455 - protein, 325 aa, Staphylococcus aureus
MSVEEYGKVYLIGAGPGNPNYLTKKAERLIREADVILYDRLVNPLILQYANLTTEIIDVGKKPYAKHIQQEKINDCIVEAARRYNKVVRLKGGDPAIFGRVQEEVDTLNEHHIAFEIVPGVTSASAAVATMQTGLTMRTVAKSVTFSTGHFKDSEENEVDVNSLVNGGTLAIYMGVKRLGKIITQIQQYTDIDYPIAIVFQASCFNEFVVKGRLSNIISKLQHYSIEAKPGICIIGEVVDYTENTPKSYDPMKQFYVVSGSKHDALMLCEHLYDEGYGCLLNPNDTSNGTYHSSQYDYYDAFIKQQENVTYISTDRADANTVLCH

SEQ ID NO: 12456 - protein, 625 aa, Cornus cf.
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSRQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 12457 - protein, 453 aa, Unknown
  Magnetococcus sp. MC-1
MAKDANAVDMFCYQCAMSAPSGCGSSGQTLGTCGKDDTTARLQDLMIFGLKGLAAYREHARELQANTLEIDDVINETLYFTMTNVNFNFDHHIAQLMKVGNAGVKVMDLLSEAHTHKLGVPTPVQVTQNRAEGHAILVSGHNLDMLQKLLVATQDRGVNIYTHSEMLPAHGYPELNKFAHLKGNIGGAWHDQGKLFQQWQGPMVVNTNCIAPLRKDANYLERLYGYKMVGVEGIQEIKDDDFEPLIQQALTLPVVDGFVAESTITTGHHYKTLLTLAPAVVEAVKEGKIRQFFVIAGCDAPGSGGDYYRQMAQALPSDCVILTSSCGKFRFNDLDFGNVPGTSIPRYLDLGQCNDSNGAVHIALALSAALDTPVNELPVSIVLSWMEQKAVIILLALFSLGIQNITIGPKAPQFVNDGILEFLVQQFNLKLTTDAASDLQQLLLPEAKEAKVA

SEQ ID NO: 12458 - protein, 489 aa, Brassica napus
  misc_feature (293)..(293): Xaa can be any naturally occurring amino acid
MAPSLSLVLLIVLLSSPAIYAGHDYRDALRKSIMFFEGQRSGKLPPDQRLRWRRDSALRDGSSAGVDLSGGYYDAGDNVKFGFPMAFTTTMLSWSIIDFGRTMGPELKNAVKAVKWGTDYLLKATAIPGVVFVQVGDAYSDHNCWERPEDMDTLRTVYKIDRAHPGSDVAGETAAALAASSIVFRKRDPAYSRRLLDRATRVFAFANRYRGAYSNSLYHAVCPFYCDFNGYQDELLWGAAWLHKASRKRAYREFIVKNEVILRAGDTINEFGWDNKHAGINVLISKEVLMGKXAEYFESFQQNADGFICSILPGVSHPQVQYSRGGLLVKTGGSNMQHVTSLSFLLLAYSNYLSHARKVVPCGELTASPSLLRQVAKRQVDYILGDNPLGMSYMVGYGQRFPRRIHHRGSSVPSVSAHPARIACKEGSRYFLSPNPNPNLLVGAVVGGPNVTDAFPDSRPYFVQSEPTTYINAPLVGLLGYFSTHSSWR

SEQ ID NO: 12459 - protein, 801 aa, Staphylococcus aureus
MAKQKLVMIGNGMAGIRTIEEILERANDLYDITVIGKEPYPNYNRIMLSNILQNKMTVEETIMNPYEWYEEHGIELITNDPVIEVDRANQSVTTANGIEVSYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPADLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAGICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARRIFEVEKV

SEQ ID NO: 12460 - protein, 197 aa, Methanocaldococcus jannaschii
MFGGNMRIFEVMRETKETNIYLKINIDGTGKYKIDTGIPFFDHLLASFAKHGCFDLIVKARGDLEIDDHHTVEDVGICLGLALNQIEKRNIFRFGWAIIPMDDARATVAIDLSGRSYCVGNYEPKREFVGDLATENINHFFESVASYGMLNIHYEVIGKNEHHKAEALFKAFGVALDLATKIDERKGVISTKGEVKL

SEQ ID NO: 12461 - protein, 328 aa, Unknown
  Synechococcus sp. WH 8102
MSRIYDDNSLAIGNTPLVKLNSVTKNCKATVLAKVEGRNPAYSVKCRIGANMIWDAEKSGKLTKDKVIVEPTSGNTGIALAFTAAARGYKLILTMPESMSIERRRMMAVLGAELILTEAAKGMPGAIAKAKEIADSDPGKYFMPGQFDNPANPEIHFKTTGPEIWNDCDGAIDVLVAGVGTGGTITGVSRYIKNEAGKAIESVAVEPSHSPVITQTINGETVKPGPHKIQGIGAGFIPKNLDMSMVDKVEQVTNDESIAMALRLAQEEGLLVGISCGAAAAAAIRLAEQDAYAGKTIVVVLPDLAERYLSSVMFADVPTGIIEQPVAV

SEQ ID NO: 12462 - protein, 234 aa, Antirrhinum majus
VLVQFGAFIILCGATHLISLWTFSLHSKTVAIVMTVAKIATALVSCVTALVLVHIIPDLLSVKTRESFLRKKAEELDREMGNIIKQEETSRHVRMLTHEIRSTLDRHTILRTTLVELGRTLELEECALWMPGQRGPNLQLSHTLNNLIPVGSTVPINLPIVNGVFNSEEAIKIPHTCPLAKIRPLGGGYVPPEVVAVRVPLLHLSNFHINNWPEQSSKSYAVMVLILEWHKNMA

SEQ ID NO: 12463 - protein, 625 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIIWKC

SEQ ID NO: 12464 - protein, 405 aa, Bacillus thuringiensis
MPKHRKQSKIKIYRITSYKKDKRSELDSDKFELEQQEVENKQGKHSKQDKQDKQDNLDKQDNLDKQDNLDKQDNLDKPDNLDKPDNLDKQDNLDKQVQSENVVIVPTDSHNLDIWDEISLKEIQAGEHTNLFAEQSNYQNINLLQVSDIRLYLDKQLQFSSIDEQIYHEALVHPIMSKVIDPKRVLILGGGDGLALREVLKYETVLHVDLVDLDGSMIDMARNVPELVSLNKNAFFDNRVNTHVCDAKEFLSSPSSLYDVIIIDFPDPATELLSTLYTSELFARIATFLTEDGAFVCQSNSPADAPLVYWSIGNTIEHAGLTVKSYHTIVPSFGTDWGFHIAANSADVLDQIEQLYVVPTPRTLPSLLFPLFQFKEEHLEQRNFALLNSESNLILHQCYKKEMEF

SEQ ID NO: 12465 - protein, 553 aa, Thermotoga maritima
MKKPFLLLAFVFLLFLTSCFQTSMSQSLVSSNPHSNSTNTDGTSSNLEEVKYPVVYEIFIRSFYDRDGNGVGDLNGVSQKVDYLKELGVDAVWFMPFNEAVSYHGYDITDYYNVEKDYGTMEDLENMIQVLHENGIKVIMDLVINHTSDEHPWFKDAVENTTSSPYWDYYIMSLEDHSGQDHWHWKINSKGQKVWYFGLFGYNMPDLNHDSQKVREEVKKIVDFWISKGVDGFRIDAAKHIYGWSWDDGIQESAEYFEWFRDYVLSKKPDAILVGEVFSGNTYDLSLYPIPVFNFALMYSIRNYPEGQDGMIENNWVEESFLFLENHDLHRFFSHLQEHYKKFSESDYEFIKKRAALWYFLIFTLKGSPVIYYGGEIGTRGFKWHGPVYDEPVREPMQWYASGTGEGQTFWTKEVYKNAGITFGNADVDGCIYDDPYDGFSVEEQESDPKSLLNFIRFILNFRKDHDAILNGDQTIFRDWKNLIAFYRESSNEKLLVVLNPDPVWQNSFTFEENMTMILEVDFENFIWNESNVSFSAGESFTVDPMKAYIFKK

SEQ ID NO: 12466 - protein, 780 aa, Unknown
  Magnetococcus sp. MC-1
MSILHKLWGHSIRHQLMLGIALVHAVLMTLFIFDLVDRQRDFLHKQAVAQATSLSRTLAANSISWVLARDFVGLEELLSSMLDYPELRYAMVVDVNGKVLSHSDKSKAGKFLADPLSLKLIDAPNTLQVLLQSKQVIDVAMPILTNQQLVGWARVSLSQNKSGQELLHVTYKGFLYTLFAIVVGIVFAYFMARGLTKDLYHLLHVANTTRLGQLNHRVQIKRHDEIGLLSNGFNQMLGVLEQEEQQLRLIQQSLTQSNQALRQSEEKFRRLVESLSSEYFLYSHNTEGVFEYVSPSIRTVLGYDPQEFMTHYATYFTENPINMQAVNHTEASIRGEQQASYVIEIFNKQGQAVRLDVLEYPIFDKDGRVIAVEGLAHDVTERHRAEFELLTAKEQAEAANRTKSEFLAMMSHEIRTPMNSILGMAELLSESPLTPEQQGYLKIQRRAGHGLLELINDILDLSKLEAGRIELYIQPFNLPELLQSVVDLLENLARERGLALRLERMEEIPTLCQGDRARLRQIMVNLVGNAIKFTHDGSVKISVEKSSDDATNLLFHVIDSGIGIAEKDQSSVFQRFTQIDSSNSRFYGGSGLGLAITHHLVELMGGKIWLKSALGEGSCFTFTLPLPPVQIDEPALAATHDEEAPMVATESCCATKPLRILLAEDSPDNELLIRIFLRDSPHSLCCVKNGLEAYQQVQKENFDLILMDIQMPVMGGDEAIIKIRAWEQSQQCDPTIIIALTAHAMSEHQKHYLTLGFDAFLSKPINKKTLLNALAQYGQS

SEQ ID NO: 12467 - protein, 419 aa, Thermoplasma acidophilum
MTYMPENMDPFEMALQQLEKAAAVLKLDEQALEILKQPEKILQVSIPVRMDNGRIKVFTGFRVRYNTARGPGKGGIRYHTEETLSTVKALAAWMTWKCAIVDIPFGGAKGGVICDPKSMSQGELERLSRGYIRAIADFIGPEVDVPAPDVYTNPQIMAWMMDEYENVVRHSAPNVITGKPLEVGGSEGRGDATAKGGMYVLREGAKRIGLDLSKARVAVQGFGNAGQFAVKFVHEMFGSKVVAVSDTKGGIYVKDGIDYAALLEHKKKTGSVVGFPGSEPITNEELLESDVDVLIPAAIEEQITGKNADRIRAKIVLELANGPTTPEADEILYKRGILDLPDFLSNSGGVTVSYFEWVQNNYGEYWTADDVYKKLDQKMTKAAHDVFDAMDKYKVNPRTAAYVVSVKKVADAMKARGMY

SEQ ID NO: 12468 - protein, 98 aa, Mastigocladus laminosus
ATYKVTLINEAEGLNKTIEVPDDQYILDAAEEAGIDLPYSCRAGACSTCAGKLISGTVNQSDQSFLDDDQIEAGYVLTCVAYPTSDCVIETHKEEELY

SEQ ID NO: 12469 - protein, 334 aa, Prochlorococcus marinus
MSKNIKGLVLITGTTSGVGLNTLKPLLRFGWEVIAVNRSNKRAIKIADEFLTKEEIKDVHFIEIDLSDLDDVRKGCDEILERFKKPINSLICNAAVYKPRLKRPERSPQGYENSMAVNHFGHFLMIKLLMENILSSEREIFLNGKSTVFKPRITVLGTVTANYSELGGRIPIPAPADLGDLSGFKNGFLSPISMANGKKFKPGKAYKDSKLCNMVTVQELSKRYPAEKIIINSLYPGCVADTKLFRDTPWLFRFLFPIFQKFITKGYVSQRLAGERVAQVASYKEYSKPSVHWSWGNRQKAGRKAFSQKLSKRIIDTKTSQQTYDLTKKLVGLN

SEQ ID NO: 12470 - protein, 180 aa, Medicago sativa
MALISSAAVTTVNRASSAQANLVAPFTGLKSSAGFPVTKKTNNDITSIASNGGRVNCMQVWPPVGKKKFETLSYLPPLTEEQLAKEVEYLIRKGWIPCLEFELEKGFVYRENHRSPGYYDGRYWTMWRLPLFGATDSSQVLKELADCKAEYPDSFIRIIGFDNVRQVQCISFIAHTPKNY

SEQ ID NO: 12471 - protein, 356 aa, Medicago sativa
MSLLSDLINLNLSESSEKIIAEYIWVGGSGMDLRSKARTLPGPVSDPAKLPKWNYDGSSTNQAPGQDSEVILYPQAIFKDPFRQGNNILVICDVYTPAGEPLPTNKRHNAAKIFSHPDVAAEVPWYGIEQEYTLLQKDTNWPLGWPIGGFPGPQGPYYCGIGADKAYGRDIVDAHYKACLYAGINISGINGEVMPGQWEFQVGPSVGISAGDEIWAARYILERITEIAGVVVSFDPKPIPGDWNGAGAHTNYSTKSMREDGGYEIIKKAIEKLGLRHKEHIAAYGEGNERRLTGKHETTDINTFSWGVANRGASVRVGRDTEKDGKGYFEDRRPSSNMDPYVVTSMIAETTLLWKP

SEQ ID NO: 12472 - protein, 563 aa, Salmonella enterica
MMPFSIIKNIANRERMEIFFTILIMTLVVSLSGVFTRVLPFQLPLPLMQIAIGALLAWPTFGLHVEFDPELFLVLFIPPLLFADGWKTPTREFLEHGREIFGLALALVLVTVVGIGFLIYWLVPGIPLIPAFALAAVLSPTDAVALSGIVGEGRIPKKIMGILQGEALMNDASGLVSLKFAVAVAMGTMVFTVGGATLEFFKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILESSLAAAEADPNVETWMLFTDIVLIYAALMLVRFGWLWTMKKFSLRFLKKKPMEFASWTSREILIASFAGVRGAITLAGVLSIPLLLPDGSGFPARYELVFLAAGVILFSLFVGVIMLPLLLQHLEVADHAQQLKEERIARAATAEVAIVAIQKMEERLAADTEENIDNQLLTEVSSRVIGNLRRRADGRNDVESSIQEENLERRFRLAALRSERAELYHLRATREISNETLQKLLHDLDLMEALLIENQ

SEQ ID NO: 12473 - protein, 261 aa, Hypocrea lixii
MDHRPQAWGRPRDDVYGAYDHSYMQDNGPKQNTQQPIVTGTSVIGIKFKDGVVMAADNLASYGSLARFTDVKRLRTFADSSIVGFSGDISDMQYLDRHLIDLSLSEAYESPDKPRLNAANLHRYLSKLLYNRRSKFDPLWNHLLIGGLDDNGEPFLAAADLLGSTYSAPSLATGFGAMLAQPIMRRYVPDEESAKKLSREEAINIVKEAMKVLFYRDARSLDSYSLAVVTKEGVELKQDEKLEDQSWAFADRIKGYGTQTV

SEQ ID NO: 12474 - protein, 370 aa, Clostridium tetani
MTNFKELGLSNDLIQNLKTQGINSPTPIQRESILLIKEGNDVIAEAQTGTGKTLAFLLPMFENMSPNINTIQGLIVTPTRELAIQITEEAMKLNESKDLNILSAYGGKDIGSQLNKLKGNIHLVIATPGRLLDHLDRNTIDLKNLKTLVLDEADQMLLMGFKNEVETIIKHTSKNRQTLCFSATMNSSVKKLAYKYMDDPKLITIQKEEITLKNIKQVLIETTDRNKLDDLCKVLNETNPFMAIIFCRTKRRVDKLEMDLYQRGYNCKKLHGDLTQSKREKVMKDFKNTKIQYLIATDVAARGLDITGVTHIYNYDIPENTENYIHRIGRTGRAGEKGYAYLFIDLKDKETLNIIEKGIKTKIERIKNHK

SEQ ID NO: 12475 - protein, 181 aa, Lactuca sativa
MASISSSAIATVNRTTSTQASLAAPFTGLKSNVAFPVTKKANNDFSSLPSNGGRVQCMKVWPPIGLKKYETLSYLPPLSDEALSKEIDYLIRNKWIPCLEFELEHGFVYREHHHSPGYYDGRYWTMWKLPMFGCTDSAQVMKEVGECKKEYPNAFIRVIGFDNIRQVQCISFIVAKPPGVL

SEQ ID NO: 12476 - protein, 567 aa, Hordeum vulgare
MASPALISDTDQWKALQAHVGAIHKTHLRDLMADADRCKAMTAEFEGVFLDYARQQATTETVDKLFKLAEAAKLKEKIDKMFKGEKINSTENRSVLHVALRAPRDAVINSDGLNVVPEVWAVKDKIKQFSETFRSGSWVGATGKPLTNVVSVGIGGSFLGPLFVHTALQTDPEAAECAKGRQLRFLANVDPVDVARSIKDLDPATTLVVVVSKTFTTAETMLNARTIKEWIVSSLGPDAVSKHMIAVSTNLKLVKEFGIDPNNAFAFWDWVGGRYSVCSAVGVLPLSLQYGFPIVQKFLEGASSIDNHFHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLHSEKVPENLIPHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 12477 - protein, 180 aa, Stellaria longipes
MASSIMSSAAVATRSNGAQASMVAPFTGLKSNASFPVSRKTNLDITSIASNGGRVRCMQVWPPINMKKYETLSYLPDLSSEQLLSEIEYLLKNGWVPCLEFETEHGFVYREHTSSPGYYDGRYWTMWKLPMFGCTDATQVAAEVQEAKKAYPDAHIRIIGFDNVRQVQCISFIAYKPEAF

SEQ ID NO: 12478 - protein, 168 aa, Saccharum sp.
MALTVMASSATAAAPFQGLKSTASLPVARRSTTSLAKVSNGGRIRCMQVWPAYGNKKFETLSYLPPLTQEQLLKQVDYLLRNNWVPCLEFSKEGFVYRENSTSPCYYDGRYWTMWKLPMFGCTDASQVYKELQEAIASYPELRAILGFDNIRQTQWLTFIAYKPAGSE

SEQ ID NO: 12479 - protein, 334 aa, Zea mays
SARDLKCFLSADPQALSTVCAELSEACKKHGFFLVVNHGVDSKLIAQAHKLIDDFFCMQLSQKQKAQRKIGEHCGYANSFIGRFSSKLPWKETLSFHYSADKSRKTVEDYFLNVMGEDFKQFGSVFQEYCEAMSKLSLGIMELLGMSLGVGRECFRDFFEGNESVMRLNYYPPCQKPELALGTGPHCDPTSLTILHQDQVEGLQVFVDGRWYSVAPKEDAFVVNIGDTFMALSNGMFKSCLHRAVVNNKIVRKSLAFFLCPNRDKVVTPPKDLISYENSRTYPDFTWPSLLEFTQKHYRSDTKTLDAFSRWLLEKNNPNRGAPTNVPWPTKSIN

SEQ ID NO: 12480 - protein, 182 aa, Manihot esculenta
MASSMLSTATVASINRVSPAQATMVAPFTGLKSTPVFPTTRKTNSDITSITSNGGKVQCMKVWPTLGMKKFETLSYLPPLTREQLASEVEYLLRSGWIPCLEFELEHGLVYREHARVPGYYDGRYWTMWKLPMFGCTDAAQVLKELDELIKHHPDGYARIIGFDNVRQVQCISFLAYKPPGA

SEQ ID NO: 12481 - protein, 108 aa, Psychrobacter arcticus
MSDLIINTTDANFDQDVLQSDVPVLVDFWATWCGPCKAIAPILEDLATEYQGKVKIVKVDVDNNPQAASRFGIRNIPTLFVFKGGEKVDSVMGLQPKAELAKVLDKHL

SEQ ID NO: 12482 - protein, 597 aa, Oryza sativa
  misc_feature (324)..(324): Xaa can be any naturally occurring amino acid
MDTTIGSVPTASDAAAPAPAANSAPREATLGRHLARRLAEVGARDVFTVPGDFNLTLLDELEAEAGAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLETAVETAAAFLNKAVKPVLVGGPKMRVAKACKSFVELADACGYPVAVMPSAKGLVPEHHPRFIGTYWGAVSTPFCAEIVESADAYLFAGPIFNDXDPPGCRLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAKAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 12483 - protein, 478 aa, Salmonella enterica
MARKTLRARRFFSLIFPFFFITSVYAEQTPVSAKTVTVEAKNETFAPQHPDQYQSWKATSEQSAREDALAEDPRLVILWAGYPFSRDYNKPRGHAYAVTDVRETLRTGAPKTAEDGPLPMACWSCKSPDVARLIQQEGEDGYFHGKWARGGPEIVNDLGCADCHNTASDDFAQGKPAITLSRPYAERAMEAIGKPFDKAGRFDQQSMVCGQCHVEYYFDGKNKAVKFPWDEGMKVENMEQYYDAIAFSDWTNSLSKTPMLKAQHPEYETWSAGIHGKNNVTCIDCHMPKVQNAEGKLYTDHKIGNPFDNFAQTCANCHTQDKASLQKVVAERKQAIHDLKIKVEDQLVHAHFEAKAAWDAGATDAEMKPILNDIRHAQWRWDLAIASHGIHMHAPEEGLRMLGSAMDKAADARTKLARLLATKGITHEIPLPDISTKEKAQKAIGLNMQQINAEKQDFLKTVVPQWEDQARKNGLLSQ

SEQ ID NO: 12484 - protein, 465 aa, Triticum aestivum
  misc_feature (273)..(273): Xaa can be any naturally occurring amino acid
  misc_feature (280)..(280): Xaa can be any naturally occurring amino acid
  misc_feature (311)..(311): Xaa can be any naturally occurring amino acid
  misc_feature (342)..(342): Xaa can be any naturally occurring amino acid
IRHEHQYTPGRPVSVSALQPSDTFPRRHNSSTPAEQAVMASECGFNTLDALIDATVPAAIRAPPMQFTGKFDAGFTESQMLEHMAHLASMNKTYKSFIGMGYYNTHIPAVILRNLMENPAWYTQYTPYQAEIAQGRLESLLNYQTMVADLTGLPMSNASLLDEATAAAEAMAMCLGIVKSKKKTFLIASNCHPQTIDICQTRATGFDINVVVSAAKDFDYSSGDVCGVLVQYPGTEGEVLDYAEFVKDAHAHGVKVVMATDLLALTTLRPPGXEIGADIXVGSAQRFGVPMGYGGPHAAFLATSQEYKRAXCPGRIIGVSVDSSGKPVLRMAMQTREQAHPXETRPPANICTAHALLANMAAMYAVYHGPAGLKAIADRVHGLAGTFAHGLKKLGTVTVQELPYFDTVKITCADANANAEEARKSEMNLRVVDANTITVAFDETTTWRMLTAVQGFSGGKQWTHS

SEQ ID NO: 12485 - protein, 576 aa, Listeria monocytogenes
MQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPSVFKSMLNSVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 12486 - protein, 409 aa, Aeropyrum pernix
MTLSSAGGSRSHRHNGGHSERDVEIRILKDKVRSLTKEKISLQKELEYYKNEITKLLSPPYIEAVVLEVIDDNRVVVKSSTGPNLIVNVAAGVDARSLKPGAIVALNNRGSTIVDVLPGRYDPLVKAMEVEERPKVFFKDVGGLEEQIREIYEAVVLPIKNPHLFRELGIDPPKGVLLHGPPGTGKTLLAKAVAGETEATFIRVVGSELVNKFIGEGARLVREIFRLAREKAPSILFIDEIDAIASKRVDIGTSGDREVQRTMLQLLAELDGFDPLDNVKVIAATNRLDLIDPAVLRPGRFDRIIEVPLPSLRGRLEILGIHTRKAKMAPDVDLEAIAKLTEGFSGADLKAVVVEAGYNAIRRGSRVITMDDMIKAVEKVKAALDKRGGGDPFIRAQQKSGDDTIATVI

SEQ ID NO: 12487 - protein, 364 aa, Unknown
  marine gamma proteobacterium HTCC2080
MREAEDWFLYNCWYAAAWTSEIDDGKPFSRTLLEKPIVIYKNESGVYVALDNRCCHRSAPLSMGRIEGDCLRCMYHGMKYDPSGQCVEIPGQAKISSNHRVHSYPLVDRGGMLWIWMGEAHKANSDDIPHFEPLDDPQWCGLPNRCYLHYDANWMLIVDNLADFSHLAFVHTSTLGGSEDYATESAQQVDKLDNGFEFERWHRGSEQPPYLQKITPWPADRIVDRRNFVRMYTPGIFLMDTQFGPEGWDQEAQRPELLEFRNCQYMTPETRNSSHFFWEYLRNFRKGDNDAGETLKAAMFDGFFEDKVIIEAQQQLLEAHGDFQPRGLASDNALAQFRRVWFERIAEERKSFPVPMETIKNPVI

SEQ ID NO: 12488 - protein, 290 aa, Oryza sativa
MASSVAAAASTFLGTRLADPAPQSGRIVARFGFGGGKKAAAKKAARPSAPTTDRPLWFPGAVAPDYLDGSLVGDYGFDPFGLGKPAEYLQFELDSLDQNLAKNNAGEIIGTRFETGEVKSTPFQPYTEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLASDPEKKERLQLAEIKHARLAMVAFLGFAVQAAATGKGPLNNWATHLSDPLHTTIFDTFSSSS

SEQ ID NO: 12489 - protein, 530 aa, Solanum lycopersicum
MADVEGSPGSSMHGVTGREPVLAFSVASPMVPTDTSAKFSVPVDTEHKAKQFKFYSFSKPHGLTFQLSWISFFTCFVSTFAAAPLVPIIRDNLNLTKMDVGNAGVASVSGSILSRLTMGAVCDLLGPRYGCAFLIMLSAPTVFCMSFVSSAGGYVAVRFMIGFSLATFVSCQYWMSTMFNSKIIGLVNGTAAGWGNMGGGATQLIMPLLYDIIRRAGATPFTAWRIAFFIPGWLHVVMGILVLTLGQDLPDGNRGTLQKTGTVAKDKFGNILWYAATNYRTWIFVLLYGYSMGVELSTDNVIAEYFFDRFDLKLSTAGIIAATFGMANLLARPFGGFSSDYAAKKFGMRGRLWVLWILQTLGGVFCVLLGRSNSLPLAVTFMILFSIGAQAACGATFGIIPFISRRSLGIISGMTGAGGNFGSGLTQLLFFTSSKYSTATGLTYMGFMIIGCTLPVTFCHFPQWGSMFLPPTKDPVKGTEEHYYTSEYTEAERQKGMHQNSLKFAENCRSERGKRVGSAPTPPNLTPNRV

SEQ ID NO: 12490 - protein, 371 aa, Prochlorococcus marinus
MVENSPEASQKLETEEQAAKSIDESQTSSPEINNKTPEETGNQVDTDIPEDIPTADDPSSRVKKHDFDGVGFTLEEFDSLLSKYDYNFKPGDIVNGTVFALETKGAMIDIGAKTAAFMPMQEVSINRVEGLSDVLQPSEVRQFFIMSEENEDGQLSLSIRRIEYQRAWERVRQLQKEDATIYSEVFATNRGGALVRVEGLRGFIPGSHISTRKAKEELVAEFLPLKFLEVDEERNRLVLSHRRALVERKMNRLEVGEVVVGAVRGIKPYGAFIDIGGVSGLLHISEISHEHIETPHSVLNVNDQMKVMIIDLDAERGRISLSTKALEPEPGDMLSDPQKVFDKAEEMAAKYKEMLLEQAEEGENPIATMEI

SEQ ID NO: 12491 - protein, 582 aa, Cornus unalaschkensis
VLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIIWKC

SEQ ID NO: 12492 - protein, 302 aa, Clostridium thermocellum
MIYDDMQQLIGNTPLVRLRHSGFPDGVRVYAKLELYNPSGSVKDRIGKYMIEDAEKRGVLVPGSTIVEGTAGNTGLGIAFAALNRGYRLIMVVPTKFSQEKQALLRALGAEVINTPREEGMLGAERKAEELRQSIPKAVSLEQFRNPANPLAHYETTGPEIWEDLGADIDYFVAGAGSGGTYAGIVRYLKEQKPDIKGILADPIGSTMGGGEHGDYDIEGIGNDFIPETMDMSLVDEVIKVSDDEAFTETRLLARNEGIIAGSSSGANLAAVRKLAMRIQRGTIVTVLPDRGERYLSKNLFL

SEQ ID NO: 12493 - protein, 530 aa, Solanum lycopersicum
MTDVEGSPGSSMHGVTGREPVLAFSVASPMVPTDTSAKFSVPVDTEHKAKQFKFYSFSKPHGLTFQLSWISFFTCFVSTFAAAPLVPIIRDNLNLTKMDVGNAGVASVSGSILSRLTMGAVCDLLGPRYGCAFLIMLSAPTVFCMSFVSSAGGYVAVRFMIGFSLATFVSCQYWMSTMFNSKIIGLVNGTAAGWGNMGGGATQLIMPLLYDIIRRAGAIPFTAWRIAFFIPGWLHVVMGILVLTLGQDLPDGNRGTLQKTGTVAKDKFGNILWYAATNYRTWIFVLLYGYSMGVELSTDNVIAEYFFDRFDLKLSTAGIIAATFGMANLLARPFGGFSSDYAAKKFGMRGRLWVLWILQTLGGVFCVLLGRSNSLPLAVTFMILFSIGAQAACGATFGIIPFISRRSLGIISGMTGAGGNFGSGLTQLLFFTSSKYSTATGLTYMGFMIIGCTLPVTFCHFPQWGSMFLPPTKDPVKGTEEHYYTSEYTEAERQKGMHQNSLKFAENCRSERGKRVGSAPTPPNLTPNRV

SEQ ID NO: 12494 - protein, 625 aa, Cornus unalaschkensis
MASSGEQNQVGLLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 12495 - protein, 315 aa, Cytophaga hutchinsonii
MSVEKVHCLIIGSGPAGYTAAIYASRAGLKPVMYQGAQPGGQLMITNDVENFPGYPDGVMGPEMMEHFKAQATRFGADIRYGTISSVDFTGPVHKVTVDEKVVLEADTIIISTGAGAKWLGIESETRLNGRGVSACAVCDGFFFRGQEVAIVGAGDTACEEASYLSKLCKKVYMLVRKDKFVAASVIMQQRVLNTPNIEVLFSTETDEILGKEDVEGMRVRNNVTGETREIPVTGFFVAIGHKPNTDIFKGWIDMDENGYIKTIPGTSKTNVEGVFACGDAQDHVYRQAVTAAGTGCMAALDAERYLAAKEAVTA

SEQ ID NO: 12496 - protein, 625 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIVMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 12497 - protein, 472 aa, Zea mays
  misc_feature (449)..(449): Xaa can be any naturally occurring amino acid
MEAADYGLLFVGGISWETSEERLREYFGRFGEVTEAVIMRDRSTGRARGFGFVVFADAAVAERVTMDKHTIDGRMVEAKKAVPRDDHSIVSKSNGSSTGSPGPGRTRKIFVGGLPSSVTEADFRRYFEQFGIITDVVVMYDHNTQRPRGFGFITYDSEDAVDKALHKSFHELNGKMVEVKRAVPKEQSPGPVVRSPVGVGQNYATNRVHSFLNGFNQGYNPNPVGGYGMRVDGRYGLLSGARNGFSFFGPGYGMGMNVEGGMSGTFGASPCFISNSNGRQMGSLFNASSNRLGSPIGYLGLNDVPGSMLSSMSRNVWGNGSLNYPSNPTNMSAFTSPGNGSQVSLTGDNWGGLPSVHGMGNISSLGSGNLARGAGDNNFGLLSGSYGRSNSTGTIGEPFSAAGNTYDVNNPDTYGSSSIYGGTAWRFTSSEVDMPFGHDIGNFDPTIKXDMSASHMCNYPVNNNQPSRGITS

SEQ ID NO: 12498 - protein, 649 aa, Triticum aestivum
  misc_feature (637)..(637): Xaa can be any naturally occurring amino acid
MNSSMDEINLLRQHQRHQQHHLSVRGIGEEIDLEIDQCEDPTFSGAALEGVTSHHPQDPVVPADDHKSFLIPCSQPGAVDGQPQPTPPQAEERAGMLRLSAHTKKKKKVVKKWRDEWADTYKWAYVAVHDNTSRIFCTVCNARGRKHRRNPYGNEGSRNMQMSALEEHNNSLLHREALRLQSASKEKVQTPEKERLVYVKALSKTAASILESLFKKDPYEAEFIQSIQEVVHSIEPVLVKNSQYVQILERLLEPERCFIFRVPWVDDRGEAHVNRGFRVQFSQALGPCRGGLRFHPSMNLSVAKFLAFEQTLKNALSLYKLGGAAGGSDFDPKGKSEIEVMRFCQSFMDELYRYLGPDQDFPAEDVGVGPREMGFLFGQYRRLSGHFQGNFTGPKIFWSGSSFRTEATGYGLVFFARVVLADMNKELKGLRCAISGSGKIAMHVLEKLLSCEAIPVTVSDSEGYLFDGDGFDYVKYTLIRNIKAQQRSLKEYLKTFPRAKYINDAKPWGEQCDIAFPCASQNEIDQGEALSIISSGCRVLIECSNMPCTGQAVDILRKAKVHVAPAKATAAGGVAVGELELNPEFSLMQWSVEDFENKIQEAVKQTYDRSMKAAQEYGILKENPESLVHGANISAFXNIAQAMTDQGCV

SEQ ID NO: 12499 - protein, 625 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFRGSTVASTGMIIQALQRTICKC

SEQ ID NO: 12500 - protein, 653 aa, Unknown
  Bradyrhizobium sp. BTAi1
MDMLLEPVTLPPFPEGLRISLRQMHLLQAPMGGTLVTGGATFRVFAPHARAVYVSGPFNDWAQDASCRLAPIGNGHWAVFIPGLKDGDAYMYFVEGEGSSGYKRDPHARLLTVDPPFPQAHSVLRNPQAFPWHDTDFTPPPWNELLIYQLHVGSFDMKAGNPDGCFFDVIERVPHLARLGVNAIELLPVQEFPTMFSMGYNGTDLFSPETEYGEAEETHLAAYFTRTNEILAAAGAAPYADINVVRHCDDQLRALIDVCHVHGIAVLFDVVYNHAGGGFDENSIWFFDRQPYGDPNRSLYFTDQGWAGGQVFAYWNADVRQYLVDNAIMFYREYHADGLRFDEVSVMDRFGGWATCQQLTEALRAEKPDAIQIAEYWPVNPWVVKDIAQGGAGFDATWSDGLRLALRGAIASAAGGAGALVPMQPIAAAIADLSLDKRWRAVNSIENHDIVYAGREPRIPRLADPVNSRCWYARSRSRVATGLLLTAPGIPMLFMGQELFEDRPWSDTPSLDTTIQWPLLDGEDKITADAVRFTAELIAIRRSHPALTAEGCAIVHAHDGNRVLAFHRWDGQGDDVIVIVSLNETPWRDYAIGFPAPGQWHEVFNSDVYDNWVNPGVVGNNGAVTASGPALHGQPSSAMVTIPANGLLVFARG

SEQ ID NO: 12501 - protein, 573 aa, Daucus carota
MASSLNTTNIFTSPSFRNNTKTNVHSSIQVPSIPFSPNKSSTTYQTPCNNNNNNSPPIPKWNILQKAAAMALDAVESAIISRELQLPLPKTTDPEIQIAGNFAPVPEQPVKQNLSVSGKIPECINGVYVRNGANPHFEPKAGHHLFDGDGMVHAVQFKNGSASYACRFTETERLVQERSLGRPAFPKAIGELHGHSGIARLALFYARGMFGLLDHKHGMGVANAGLVYFNDRLLAMSEDDLPYHVRVGPSGDLETIGRYNFDGQLDSTMIAHPKIDPETSELFALSYNVIQKPYLKYFRFSSDGSKSEDVDIQLSDPTMMHDFAITENFVVIPDQQVVFKMSEMIQGGSPVVYDKNKVSRFGVLDKYASDASGIRWVDVPDCFCFHLWNAWEEKETDEVVVIGSCMTPADSIFNECDEGLQSVLSEIRLNLKTGKSIRKPILSCYDQVNLEAGMVNKNMLGRKTQFAYLAIAEPWPKVSGFAKVDLSSGQVNKFFYGDEKFGGEPLFFPNPDSKNEDDGYILAFVHDEKNWESELQIVNAATLELEASIKLPSRVPYGFHGTFISAKDLETQA

SEQ ID NO: 12502 - protein, 579 aa, Oryza sativa
MVPLYVAMILAYGSVKWWRIFTPDQCSGINRFVALFAVPLLSFHFISTNNPYTMNLRFIAADTLQKLIVLALLTLWSHLSRRGSLEWTITLFSLSTLPNTLVMGIPLLKGMYGEFSGSLMVQIVVLQCIIWYTLMLFMFEYRGARILITEQFPDTAGAIASIVVDADVVSLDGRRDMIETEAEVKEDGKIHVTVRRSNASRSDVYSRRSMGFSSTTPRPSNLTNAEIYSLQSSRNPTPRGSSFNHTDFYSMVGRSSNFAAGDAFGVRTGATPRPSNYEEDAAAPNKAGSKYGQYPAPNPAMAAPPKPKKAANGQAKGEDGKDLHMFVWSSSASPVSDVFGNGAEYNDAAAVKEVRMAVASPRKADGVERDDFSFGNRGVAERDAEAGDEKSVAAAVSGEHGKPGLTPAPTAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASIAVGLRGTLLHVAIVQAALPQGIVPFVFAKEYSVHPDILSTAVIFGMLIALPITLVYYILLGL

SEQ ID NO: 12503 - protein, 450 aa, Leuconostoc mesenteroides
MDDKHKGQGLPNLPLSTIWMLSFGFLGVQMAFSLQSSQMGRIFQTLGADPTKLGFFFILPPLAGLFVQPLVGYFSDRTWTKRFGRRMPYLLVGALVSVIVMFLLPNSGSFGFSTTAALWFGAITILFMDLSSNVAMQPFKMVVGDMVNEDQKSYAYSIQSFLSNTGSVLATIFPFLLTAIGVANTADKGQVPASVIISFYVGAVVLVVFSLVAVFNVKEYDDATYELYHGYALNTPNDNDGGFLTLLKRAPKTFWMVTVTQFFCWMAFQYLWTYGTGAVADNVFHATDPTTAGYQNGGNWFGILSAVYAIAAVLWSLVLSKIPAEKNKFGYALSLLLGSTGFISVFFIHSQYLLIASFILIGISWAGMMAYPFIMVTNALNGDHMGTYLGLFNGSICLPQIVASVASFVVFPALGSHFPSMILVSGVLMLLGAVSVGFIKEIHSNPVNAH

SEQ ID NO: 12504 - protein, 595 aa, Glycine max
  misc_feature (246)..(246): Xaa can be any naturally occurring amino acid
  misc_feature (549)..(549): Xaa can be any naturally occurring amino acid
  misc_feature (562)..(562): Xaa can be any naturally occurring amino acid
MTMEEGRVENEDYTQDGTVNIKGKPILRSKSGGWKACSFVVVYEVFERMAYYGISSNLILYLTTKLHQGTVSSANNVTNWVGTIWMTPILGAYIADAFLGRYWTFVIASTVYLSGMSLLTLAVSLPSLKPPQCFEKDVTKCAKASTLQLAVFYGALYTLAVGTGGTKPNISTIGADQFDDFHPKEKLHKLSFFNWWMFSIFFGTLFANSVLVYIQDNVGWTLGYALPTLGLLVSIMIFVAGTPFYXRHKVPAGSTFTRMARVIVAACRKSKVPVPSDSKELYELDKEGYAKKGSYRIDHTPTLKFLDKACVKTDSNTSPWMLCTVTQVGETKQMIRMIPILVATFVPSTMMAQINTLFVKQGYYSRQTPWKLQIPQQSLAAFVTVSLLVCIVLYDRFFVKIMQRFTKNPRGITLLQRMGIGLVIHTLIMIIASGTESYRLKVAREHGVVESGGQVPLSIFILLPQFILMGTADAFLEVAKIEFFYDQSPEHMKSIGTSYSTTTLGLGNFISSFLLSTVSNITKKNGHKGWILNNLNESHLDYYYAFFAXLNFLNLIFFAYVXRYYVYRVEVSDSIDKLAKELKEKTVSNVVNPKD

SEQ ID NO: 12505 - protein, 123 aa, Zea mays
  misc_feature (53)..(53): Xaa can be any naturally occurring amino acid
  misc_feature (74)..(74): Xaa can be any naturally occurring amino acid
  misc_feature (76)..(76): Xaa can be any naturally occurring amino acid
  misc_feature (90)..(90): Xaa can be any naturally occurring amino acid
  misc_feature (95)..(95): Xaa can be any naturally occurring amino acid
MGRRPARCYRQIKNKPYPKSRYCRGVPDPKIRIYDVGMKKKGVDEFPSCVHLXSWEKENVSSEALEAARIACKXVXMRRNAGKDAFHLRXRVHSXLFRIKKDGFLAALPHRFPISFPFPTLTT

SEQ ID NO: 12506 - protein, 480 aa, Cryptococcus neoformans
MTEDIYKDDLYGDLDLEDLDASQLEELVEPPELDTAPTSTPAASNAAAAPSQPAITASSSTSAPVEPGSQQYDHQPSYDAATPYQQGQQDNNFGQQQDGQDRIKPSDMPDEGKMFIGGLNWETTEAGLSEYMGQFGEIDACTIMRDPSGRSRGFAFLTYRDPASVTKVMAQTHHLDGKQIDPKRAIPRAEHERTAKVFVGGLAPSVTGESLKSFLCQFGQVMDATVMFDKETGRSKGFAFATFQDEESVGRAMAASGVELEGKQIEIKKAQPRGTAQGSKFGGNMNPRFNQGTGFSGGMGSFGGGFDPSSVAMMYQNMMKTGGNMMGGFDPSAMAMMYQNMMKSMGNAPAINPSLAMRNNAGGTTAGAAAGGAMPMGMGMGAMGGMGGMGGMGGMGGMGMGGMGMGGMGMGGMGGMGGMGMGGGMNRMGNTRQIPNAPRGPAAMRGPGQQPMGGAGNAPQGGGPGAQRYSTQGNARARPY

SEQ ID NO: 12507 - protein, 454 aa, Leuconostoc mesenteroides
MSSNEHKKGQLPMLTSMQLFLMTFGYAGVQVAFSVQTGNMGRIFQTLGSDPTKLGFFFILPPLAGMITQPLIGLFSDKTWLPKLGRRMPYLIGGCLVSLIVLLLLPNTGSFGFGYGSMTALWFGAVTVLFMDLSANVSMQPFKMIIPDMVNEKQTDKAWSLQNIWGSLGGVIAFVFPFILTSFGVANTAARGVVPDSVKISFYVAAAILLLSTIFTIINVKEYDPETLAYYHGFRSDDKTHESFIDILKHAPKVFWTLGIVEFFVWFGIPYMWTYSTGALSENIWHVSDPASAGYQAAGNWFGILQAVYSVVAIVVGILFQRLNDKTRKMTYFLSLIAGGLGFIIVAYGHTHVSSLIGFVLIGIGWIALISIPFTILTNALDGKHDGVYLGLFNCFICIPQIVASVASFAIFPAVGKSMAHMLAIAGVFLMIGGCLIWIVKEEKTQVDMTQKGE

SEQ ID NO: 12508 - protein, 397 aa, Arthrobacter nicotinovorans
MSPTTDRIAVVGGSISGLTAALMLRDAGVDVDVYERSPQPLSGFGTGIVVQPELVHYLLEQGVELDSISVPSSSMEYVDALTGERVGSVPADWRFTSYDSIYGGLYELFGPERYHTSKCLVGLSQDSETVQMRFSDGTKAEANWVIGADGGASVVRKRLLGIEPTYAGYVTWRGVLQPGEVADDVWNYFNDKFTYGLLDDGHLIAYPIPGRENAESPRLNFQWYWNVAEGPDLDELMTDVRGIRLPTSVHNNSLNPHNLRQFHSKGESLFKPFRDLVLNASSPFVTVVADATVDRMVHGRVLLIGDAAVTPRPHAAAGGAKACDDARTLAEVFTKNHDLRGSLQSWETRQLQQGHAYLNKVKKMASRLQHGGSFEPGNPAFAFGLPKVDEPSVVTNS

SEQ ID NO: 12509 - protein, 216 aa, Triticum aestivum
  misc_feature (106)..(106): Xaa can be any naturally occurring amino acid
MKGGTVPTWLELLLATQFFAICTNHLSSTRNECNLFCIDCEESKGALCYYCRSHHHSTHRVIQIRRSSYHDVVRVAELKDVLDISDVQTYVINSATVVFLNERPQXHRGCGVSAVKASSSSYNCEICNRALLDPFRFCSLGCNLKGIKEDMRTSIPIRDIIDYTRKDDDTDCSNTSGNTGNNEESCSDADYCKEKPSPPRVIRHRRKGIPQRAPFY

SEQ ID NO: 12510 - protein, 73 aa, Nematanthus villosus
ISGTNGEVMPGQWEFQVGPSVGIEAADHTWCARYLLERITEQAGVVLSLDPKPIEGDWNGAGCHTNYSTKSTR

SEQ ID NO: 12511 - protein, 205 aa, Fucus distichus
MSRNDSPFDMQIKLLMIGDTGVGKTCLLLRYANDSFSQTFITTIGIDFKIKNIDLDSKRIKLQIWDTAGQERFRTITTSYFRGAQGILLVYDVTDKKSFNSIRNWVAQIQQHADVAVNKILIGNKCDMDEDREVSKEEGANLAAEYGIQFFETSAKNDINVEKGFITIAREVKDRLMADGPGGGGGHGRTVDINGQASKKKTGCC

SEQ ID NO: 12512 - protein, 182 aa, Brassica napus
  misc_feature (126)..(126): Xaa can be any naturally occurring amino acid
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWXKLPLFGCTDSAQVLKEVQECKTEYPNAFIRIIGFDNNRQVQCISFIAYKPPSFTGA

SEQ ID NO: 12513 - protein, 715 aa, Salmonella enterica
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLESVSWDEALNYVAERLSAIKAKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYSKIVEGYTPESVEEITGVSAQEIRQAARMYASAKSAAILWGMGVTQFYQGVETVRSLTSLAMLTGNLGKPSAGVNPVRGQNNVQGACDMGALPDTYPGYQYVKFPENREKFAKAWGVESLPAHTGYRISELPHRAAHGEVRAAYIMGEDPLQTDAELSAVRKAFEDLELVIVQGIFMTKTASAADVILPSTSWGEHEGVFSAADRGFQRFFKAVEPKWDLKTDWQIISEIATRMGYPMHYNNTQEIWDELRHLCPDFYGATYEKMGELGYIQWPCRDTSDADQGTSYLFKEKFDTPNGLAQFFTCDWVAPIDKLTEEYPMVLSTVREVGHYSCRSMTGNCAALAALADEPGYAQINTADAARLGIEDEALVWVHSRKGKIITRAQVSDRPNKGAIYMTYQWWIGACNELVTENLSPITKTPEYKYCAVRVEPIADQRAAEQYVIDEYNKLKTRLRESAMG

SEQ ID NO: 12514 - protein, 287 aa, Prochlorococcus marinus
MFENENPNGSWLDEYQNDVRYGLKGKKIIEEISNFQKITIFESNRYGKALLLDNCWMTAEYQEKQYHECIVHPALCGSKEINKVLIIGGGDGGSARECLKYQELKNLDLIEIDKRVVELSQQYLSVIGGNCWKDQRLNLKLTNGINWVKDAKDNSYDVIIIDGSDPKGPAKGLFNKDFFKDCHRILKPDGVLGAQTESPESFEDIHINTVKMIKEVFKYADPLYGYVPIYPSGIWSWTFASIKKPRHLYPIISRANTISKTCQVWSPRWQRGGFDAIPANIERKLQQ

SEQ ID NO: 12515 - protein, 421 aa, Pseudomonas fluorescens
MTESVLDYMTRLGRAARQASRVIARATTAQKNRALLAAADALDAARPELTAANEQDLANGRANGLEPALLDRLALTPARIDEMIEGLRQVAKLPDPIGEIRDMRYLPSGIQVGKMRVPLGVIGIIYESRPNVTIDAASLCLKSGNATILRGGSEAIHSNRAIATCIQQGLAAADLPPHVVQVVETTDRAAVGALITMPEFVDVIVPRGGKSLIERVSRDAKVPVIKHLDGVCHVYIDVAADLDKAIRIADNAKTQRYAPCNTMETLLVHSAIAERVLPPLAAIYRDKGVELRGCAQTRALLGAGVLEATEEDWRTEYTAPILSIRVLDNLEQAIEHINTYGSHHTDSIVTENFSDARRFLNEVDSSSVMVNASTRFADGFEYGLGAEIGISTDKLHARGPVGLEGLTSEKYVVFGDGHVRT

SEQ ID NO: 12516 - protein, 341 aa, Brassica juncea
MKMSSDQSRFLASLPLLLLLLSFLIASFFHTAAAQIGVCYGRIGNNLPRPADAVALYRNRNIRRMRLYDPNQEVLSALRGSNIDLLLDVPNPDLQRIASSQAEADTWVRNNVRNFNGVRFRYISVGNEVQPSDPTSRLVLPAMQNIDRAVSGLGIKVSTAIDTRGISGFPPSSGTFTPEFRNFIAPVITFLVSKQSPLLVNVYPYFSYINNMRDIRLDYALFTSPSTVVNDGSNAYRNLFHALVDTVYAALEKTGGGSVEIVVSESGWPTAGGTATNVDNARTYVDNLIQTVKSGSPRRQGRPIETYIFGMFDENQKSPEFEKFFGMFLPNQQPKYGVNFN

SEQ ID NO: 12517 - protein, 91 aa, Arabidopsis thaliana
MPSLQTSLPPELANNVVRLYRECLRRAKFIGKQQHNTELVVGMVRQQFKKHMNETDPEKIQKLKDDAARGLINHMLFESAKLTGGKVSQRS

SEQ ID NO: 12518 - protein, 220 aa, Edwardsiella tarda
AETLQRLNPETTLFLVASKTFTTQETMTNAHSARDWFLQAAGDERHVAKHFAALSTNAQAVAAFGIDTANMFEFWDWVGGRYSLWSAIGLSIALSIGYDNFEQLLAGAHAMDRHFASAPLQQNLPVLLALIGIWYNNFFGAETEAILPYDQYMHRFPAYFQQGNMESNGKYVDRNGQAVDYQTGPIIWGEPGTNGQHAFYQLIHQGTKLIPCDFIAPAIS

SEQ ID NO: 12519 - protein, 383 aa, Alkaliphilus metalliredigenes
MSHDMEELMEEIEKSLIRPKRGEVVTGKVIQVSDKGITVNIGYKADGIVPRDEISNDPTITPQDVAKADDEISVYIIKTDDGEGNVLLSTKRVEHTKGWEDLEKIHDTESLVESKVVESVKGGVIAIARGIRCFIPASQLSDRYVDDLKTFVGKSFNAKVIEIDRQKNKAVLSRKEVLQQENKEKKADVFAKLEKGMQIRGEVKRLTNFGAFVDIGGIDGLVHISELSWGRVKNPSEVVSVEDQVEVKVIDFDETTGKVSLSIKQTQPEPWTLIADKFKAGDILEGKVVRLVDFGAFVELMPGLDGLVHISQISEAHIAKPSEELHVGQNVNVKVLDINIDGKRISLSMTAAQEDSTENEPTEYTDEDNNVTIGDIIDMNDKK

SEQ ID NO: 12520 - protein, 175 aa, Solanum lycopersicum
MASKMCEPLVIGRVIGEVVDYFCPSVKMSVVYNNNKHVYNGHEFFPSSVTSKPRVEVHGGDLRSFFTLIMIDPDVPGPSDPYLREHLHWIVTDIPGTTDCSFGREVVGYEMPRPNIGIHRFVFLLFKQKKRQTISSAPVSRDQFSSRKFSEENELGSPVAAVFFNCQRETAARRR

SEQ ID NO: 12521 - protein, 457 aa, Unknown
  Synechococcus sp. WH 8102
MSVDASGHIENIVILGSGPAGYTAAIYAARANLQPLLITGFQRGGIPGGQLMTTTHVENFPGFPDGILGPDLMDLMKAQAVRWGTHLIEADADRIDLSQRPFRIEAEGQTIQAHAVVIATGASANRLGLPSEDRYWSSGISACAICDGATPQFRNEELAVVGGGDSACEEAVYLTKYGSHVHLIVRSDQFRASAAMADRVMANPAITVHWNSEIEDVAGGTWMESLTLRDRVTSETRALAVRGLFYAIGHTPNTDLLKDQIDLDGKGYLLTASGRPETSVDGVFSAGDVADAEWRQGITAAGSGCKAALAAERWLTHHNLATRVPRASVDPAKAEQPVNVAVTTEESYDPQGLWQKGSFALRKLYHDSDKPLLVVYTSPTCGPCHVLKPQLQRVINELDGHAQAVVIDIEADQAIAEQAGVSGTPTVQLFHNKEMVKQWRGVKPRSEFKAAIESLAA

SEQ ID NO: 12522 - protein, 717 aa, Cytophaga hutchinsonii
MSYPGLTIINKTITLPDGREIQIETGKLAKQADGSAVVKLGNAMILATVVSAKEAKPGVDFMPLSVDYQEKFASNGKIPGGFLKRESRLSDYEILISRLVDRAMRPLFPEDFHADTQVAITLISADADVLPDALACLAAQAAMSVSDIPFNGPVSEVRVISLNGEFIINPKPAQIEKAELELIVAASYDNVIMVEGEMSEVSEELMLNAIKVAHDAIRTQCIVLKELESAAGKTEKRTYSHEVNDWDLKKKINDAVYQQVYEVAKLGNANKNTRAEGFKAVKKAYIESLPADHTEDLTLIGKYYHDVEKDAVRNLILDERKRLDGRSLEQIRPIWSEVGYLPSAHGSAIFTRGETQSLTTVTFGTRLDEQMIDSAMFSGNNKLMLHYNFPGFSTGEVKPNRGPGRREVGHGNLAYRAIKKVMPPEIENPYTIRIVSDILESNGSSSMATVCAGTLALMDAGIKIKAPVSGIAMGLITDTKTGRWAVLSDILGDEDHLGDMDFKVTGTEKGITACQMDIKVDGLSYDILSQALQQANRGRLHILSEMKKTLATPREDLKPHAPRMIMIQIPKELIGAVIGPGGKIIQEIQKTSGATVNIEEKDNAGWVSIFSKDKTALDSALSQIKGIVTLPEVGEVYEGKVKSITAFGAFVEFLPGKDGLLHISEIKWERLDTMEGVLEVGETVKVKLVEVDKKTGKYRLSRKVLIPKPEQQATSNS

SEQ ID NO: 12523 - protein, 624 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIVMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 12524 - protein, 572 aa, Streptomyces coelicolor
MTVNEPVPDTFEDTPAGDRHPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRKNPDGPYGDYYVWADDDTRYADARIIFVDTEASNWTHDPVRGQYYWHRFFSHQPDLNYENPAVQEEMLAALKFWLDLGVDGYRLDAVPYLYAEEGTNCENLPASHAFLKRVRREIDAQYPDTVLLAEANQWPEDVVDYFGDYSTGGDECHMAFHFPVMPRIFMAVRRESRYPVSEILAKTPAIPSGCQWGIFLRNHDELTLEMVTDEERDYMYAEYAKDPRMRANIGIRRRLATLLDNDRDQIELFTALLLALPGSPILYYGDEIGMGDNIWLGDRDAVRTPMQWTPDRNAGFSTCDPGRLYLPAIMDPVYGYQVTNVEASMASPSSLLHWTRRMIEIRKQNPAFGLGTYTELPSSNPAVLAFLREYEDDLVLCVNNFARFAQPTELDLREFAGRHPVELFGGVRFPAIGELPYLLTLGGHGFYWFRLTRVASRIGRRA

SEQ ID NO: 12525 - protein, 624 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIVMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNVDGILSLSIKSKFKGSTVASTRMIIQALQRIICKC

SEQ ID NO: 12526 - protein, 157 aa, Oryza sativa
MQTAASSVVGLSAVLPAAVKGRSLQIQAPRRVALRVRAAAAAVAVEAAEVDYSSNISVFPMEACDLIGGEACNVQMYPEAKLSSSAAVAVSRAAAEEVDRDYLSYDEPTTAGTMAGYKPATNIFYEDKSRERRATGYRFVASCSTDSKTQCVYDRWD

SEQ ID NO: 12527 - protein, 379 aa, Staphylococcus aureus
MAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINEQPSNFKDRAKRFFKGE

SEQ ID NO: 12528 - protein, 318 aa, Unknown
  Bradyrhizobium sp. BTAi1
MPRFVNVAIGQLGPIARSEPRHAVVRRLTALMRQAHANGCDLIVYPELALTTFFPRWYMADQAEIDSYFEREMPGPETQALFALANELRIGFCLGYAELAVEDGVVHRYNTAILVDKSGQIVAKYRKVHLPGHAEHEPWRKFQHLEKRYFEPGKAFGVTDAFGGVIGMAICNDRRWPETYRVMGLQGVEMVLIGYNTPVHNPPAPEHDDLSLFHNRLVMQSGAYQNGTWVIGVAKGGIEEGVDHIAGSCIIAPSGEIVAACATKGDEIALARCDLDLCNSYKQTIFNFDVHRQPQAYRMIVERRGTTRMADGAPVRKP

SEQ ID NO: 12529 - protein, 624 aa, Cornus unalaschkensis
MASSGEQNQVGLLENLKNRLAIAVRSIQWSYAIFWSISSRQPGVLEWGDGYYNGDIKTRKTVQAVEFNADQLGLQRSEQLKELYESFAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIVMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNVDGILSLSIKSKFKGSTVASTRMIIQALQRIICKC

SEQ ID NO: 12530 - protein, 487 aa, Brevibacterium linens
MSTSGEDLTLVWFRDDLRVADHEALTAARADGRVIAVWIRETRDEEGLGPRPLGGACRWWAHESLTVLHEELSDLGIPLLFAAGRAEKIIVQLASSLGVTAVRWTRRYASASRALDGQIKTVLNDQGFTVHSHTGALLVEPWTAAPQSSDHYKVFTPFWKAVAGRDVGDVLPKPQAQSPLSQTLLSRAHECPAVMELDGLGLLDGTETGAGEAAAASGPRWWQDTIAGHWSPGLRAAEDQLDDLSAIIDGYTTSKDVPSDAASTSRLSPRLRHGELSPRQLLQAARTTSSLTQDDRAAWIRQLYWREFSWHLTYHYPHIDSAPIRPEFHNFPYEDDDDALTHWRAGTTGYPLIDAGMAQLWQTGWMHNRVRMVTASFLTKNLLQHWWFGEQWFWDTLVDADEANNPVSWQWVAGSGADAAPYFRVFNPERQRERFDPDDAYIEDWLPYTPATAPPPLVDLRQSRQAALSAYDHMKNRSTTRDNPGES

SEQ ID NO: 12531 - protein, 624 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASKNTRTEKDLILAKPNHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIIWKC

SEQ ID NO: 12532 - protein, 104 aa, Brassica napus
MGLSRFAITTATKQILKLNSLANKNRTSSSLDHVPKGHVAVYVGEQIEKEKKRFVVPISFLNHPSFREFLSRAEEEFGFNHPMGGLTIPCREEVFLDLIASRLQ

SEQ ID NO: 12533 - protein, 262 aa, Unknown
  Magnetococcus sp. MC-1
MAKYSVRELLEAGFHFGHQTKRWNPKMKRHIFGARNGVHIINLQKSVVMLRDACNFVRDTVQGGGTVLFVGTKRQAVELVSAEARRTGQFYVNHRWLGGTLTNWRTIQGSIRRLKEIDKMRVDGTFEALTKRETQQLDREGQKIERALGGIKDMERQPNLIIVVDTRKESIAVKEANKLGIPVVALVDSNCDPDPIDYPVPGNDDAIRALTLFISKMGDSVIEGMQLAGREIPNSGISAGEGSMEAQMLSQAGEGEMQSAEA

SEQ ID NO: 12534 - protein, 743 aa, Porphyromonas gingivalis
MLNVVSKTIDLGDGRSIKIETGKLAKQADGAVTVTMGNTVLLATVCAAKDANPGCDFMPLQVEYKEKYSAIGRFPGGFTRREGKASDYEILTCRLVDRALRPLFPDNYHAEVFVNVILFSADGEDMPDALAGLAASAALAVSDIPFNGPISEVRVARVDGRYIVNPTFEQLERADIDLMVGATMDNIMMVEGEMDEVQESEMLEGIRVAHEAIKVQCKAQLELSEAVGKLQKREYSHEVNDEDLRKKVHDECYARAYEVATSGTGKHERGEAFEKIVEEFKAQYTEEELAEKAEMIARYYHDVEKEAMRRAILDEGKRLDGRKTTEIRPIWIETDCLPGPHGSAIFTRGETQSLTTVTLGTKSDEKLVDDVLNYTKERFLLHYNFPPFSTGEARPQRGVGRREIGHGNLAHRALKRMIPTDYPYVVRVISDILESNGSSSMATVCAGTLALRDAGVQIRKPVSGIAMGLISENQGKNYAILSDILGDEDHLGDMDFKVTGTKDGITATQMDIKVDGLSYEILENALEQAKQGRLHILGKIMEAQPETRDDLKPHAPRIEKMHIGKEFIGAVIGPGGKIIQGIQEKSGATVNIEEVDGMGVIEISGTNKPCIDAAIGMIKGIVAMPEVGETYPGKITSVMPYGCFVEFLPGKEGLLHISEVDWKRFETIEDTNLKEGESINVKLLDIDPKTGKFKLSRKVLLEKPEGYVEPQPRERRERREGGREGGRNFERRGGDRDHREPRG

SEQ ID NO: 12535 - protein, 330 aa, Unknown
  Acidovorax sp. JS42
MKIVVLGAGAWGTALAMSAAAHAACHEVTLWARDAQQAQAMQAKRQNQRYLPGLAFPPGLHVASGDMGALAADADLVVVGTPMAALRGMLERLDGCAAPIAWLCKGFEADTGLMAHEVCAQVAPRLHSGVFSGPSFAQEVATAQPTAMVAASPRATVRDALVQAFHGPALRVYASEDIVGVEVGGAVKNVLAIATGLCDGLQLGMNARAALITRGLAEMTRLGLALGARPETFMGLSGLGDLVLTATGDLSRNRRVGLLLAEGRTLAQAVESLGHVAEGVYSARTVVQRARAVGVEMPIAECVVALLDGELRAAEAVARLMEREPTVERH

SEQ ID NO: 12536 - protein, 97 aa, Hyoscyamus niger
ATYKVKLVTPDGPVEFNCPDDVYILDQAEEEGHELPYSCRAGSCSSCAGKVSAGTVDQSDGNFLDDDQIADGFVLTCVAYPQSDVTIETHKEEDLTG

SEQ ID NO: 12537 - protein, 97 aa, Hyoscyamus niger
ATYKVKLVTPDGPVEFDCPDDVYILDQAEEEGHELPYSCRAGSCSSCAGKVKAGTVDQSDGNFLDDDQMADGFVLTCVAYPQSDVTIETHKEEDLTG

SEQ ID NO: 12538 - protein, 437 aa, Triticum aestivum
  misc_feature (31)..(31): Xaa can be any naturally occurring amino acid
  misc_feature (277)..(277): Xaa can be any naturally occurring amino acid
  misc_feature (343)..(343): Xaa can be any naturally occurring amino acid
MATGGDRAAEELVSVEMPAPEGWTKKFTPQXGGRSEIVFVSPTGEEIKNKRQLNSYLKANPGGPTSSEFDWSTGDTPRRSARISEKVKVFDSPEGEKIPKRSRNSSGRKGKQEKKEDPETEEDKEAEAGKEAPSEDAAKSTDVEMTVAEAIDAAKSTDVEMKPAEANDAAKSADVEMKVAEEVKAAPSEDAGKPEDSTPAPAEHKEDVKPAESDAAPVPAAEDKNEDVKPTESDAPPAPTVEDKKEDAKPAEADAPPAPAVEDKEDAKPAEADAPSXPAEADAPPAPAVEDKEDAKPYEADAPPAPAVEDKDDAKPAEADAASAPAVEDKKEDVKPSEADAPXPVSSEEVKIEEAPLVSSEGAKTEEVAPPASKPTENSVVAPSEPAIAPAPAAVSETKSDAAAVDSQPGAATNESPSAVNNGQLSPAWRLRRWKCT

SEQ ID NO: 12539 - protein, 487 aa, Photobacterium profundum
MSKKWTRNTAAMAAILSALCLSTNALATSEQAVTDENQTTTQQEGMRFEPRNEKFAEAHAEQYKSWKATQESEEIEDALEGDPNMVVLWAGYGFSKDYNKARGHFYAITDVRETLRTGGPTDDKSGPMPMACWSCKSPDVARVIDDRGEDGYFEGKWARLGAEINNAIGCSDCHNTGSEEFAKGGPALQMSRPYAERAMETIGKKFEDQSRFDQQAQVCGQCHVEYYFTGPKKSVKFPWDKGTSVDDMEVYYDEIGFKDWTHGVSKAPMLKAQHPGYETWREGIHGKNNVTCIDCHMPKVQNEDGTVFTDHKVGNPFDRFEDTCAQCHTQTKAALKSVVATRKASVLEMKLRAEKQIIAAHFEAKAAWDAGATEAEMEPILMDIRHAQWRWDYAIASHGVHMHAPEVALRILGTALDKAGDARAKVIRLLATKGITEEIQIPDISTKVKAQQALGMDMNKMNAEKDEFLKTIVPEWDKQADAREAKY

SEQ ID NO: 12540 - protein, 312 aa, Unknown
  Rhodococcus sp. RHA1
MTQHRITSPFGAASTAAEVLEGIDLRGKRSIVTGASSGIGLETARALATAGADVTIAVRNPDAGRGVADDINTALGQERVAVRTLDLADLSSVHRFAEQWGSTALDVLINNAGIMATPLGRTRSGWESQFATNHLGHFALANALHDALAHANGARIVSLSSRGHLSSDIVFDDINFDNREYDPWLAYGQSKTANVLFAVEATRRRAHDGITANALHPGGIWTNLTRHLPENVYNSLRADPTAEYKSPQQGAATSVFVATSPLLRGIGGRYFEDSNQAVRYVGGPERVGVADYALNPESAQRLWTLSLAAVDG

SEQ ID NO: 12541 - protein, 560 aa, Glycine max
MLFSLRVREEGTKMGGRSGGLVCSTSSYTGIRTRRLCTSNNTTFPFPQQPQSLSFAKPLKLMSQPLTTNSVLVEEAAADGDSSAAAPPLFDYHRIDQKLLQNIVYDALVWSTLNCLLVGDKSVQRSGRVPGVGLVHLPLSLLPGPFPESHWKQGCELAPIFNELVDRVSLDGKFLQESLSRTKNADEFTSRLLDIHSKMLQINKKEDIRMGIVRSDYMIDEKTKSLLQIEMNTISTSFALIGCLMTGLHKSLLSQYGKFLGLNSNRVPANNAVDQSAEALAKAWSEYNNPRAAILVVVQVEERNMYEQHYISALLREKHHIRSIRKTLTEIDQEGKILPDGTLSVDGQEISVVYFRAGYTPKDYPSESEWRARLLMEQSSAIKCPTISYHLVGTKKIQQELAKPGVLERFVENKDHIAKLRACFAGLWSLEDSDIVKKAIENPELFVMKPQREGGGNNIYGDELRETLLKLQEAGSQEDAAYILMQRIFPATSPAILVRDGNWDTGHVISEAGIFGTYLRNKDKIIINNESGYMVRTKISSSYEGGVLPGFGVVDTVYLT

SEQ ID NO: 12542 - protein, 102 aa, Brassica napus
MASGSLKNLVTSAVTVGVTEARARIFGHMLNPTGQRSPHKILRKKLFGDKVAEWYPYDIKNEDPNVLAREEKERLSKLEMLKRRNKGPPQKGHGRRAAKRNK

SEQ ID NO: 12543 - protein, 969 aa, Prochlorococcus marinus
MKSTVNSDLFINRHLGLSDVDEQKMLSKIGFNNIDQFINQVIPEDIQLNDKSSEILPQGCSEIEALNELEEIANKNTKMRSLIGLGYYDNHMPKVIQKHVLENPRWYTSYTPYQAEIAQGRLEALFNFQTIVCELTGFPIANASLLDEGTAAAEAMAMSFAARKNKSSKLYLVESNVFDHTFNVLQTRAKPLGISLKRFNQSNLPNHDDVFGILLQLPGKNGELFDPTFLISQAHRSEIIVTGCIDPLAQVLIKPISEFGVDVAVGSMQRFGVPLGFGGPHAAFFACSEKYKRLIPGRIVGQTLSKNGEKSLRLALQTREQHIRREKATSNICTAQSLLAIISSFYAIYHGPTGLTQIAKRLVQLRINLESCLADLGFDIPDGIRFDSVDVYSEHSQKIHNEALNNGYNLRILPLGSTIENSTGFGISLDEMSNEKEIEDILTFIANVIEKKEDLDNIKFDQGFQLESLALRSTEWMQQDIFTTYQSETELMRYIFRLAEKDFSLVDGMMPLGSCTMKLNSAAELNPVSWANLSSIHPFSPPNQTKGYSKIISDLEKWISDIVGLKSVSFQPNAGSQGEFAGLLAINSYFVSKGELSRKKCLIPKSAHGTNPASAVMAGFDVLTVECDEEGNIDFQDLSIKVTKFDTQIGALMLTYPSTHGVFELQIRKICDLIHSIGGFVYLDGANLNAQVGLCKPGNYGVDICHLNLHKTFCIPHGGGGPGVGPVAASETLSPFLPTHSLKDNNLSNSSNYVSSAKHGSASILPISWMYIKMAGLCGLRKATSHAILSANYIAHTLKHKFKILYKGKNNFVAHECILDFRDLKSKTGLSVNDLAKRLIDYSFHAPTISWPVPETIMIEPTESESLAELDRFCEAMLLIGEEISEIENNIELNNNNVISNAPHTLKELIADTWNYPYSKEKASFPYGTQTAIKFWSAVSRINNAYGDRNLICSCNVNQEETLDEKKCA

SEQ ID NO: 12544 - protein, 395 aa, Triticum aestivum
  misc_feature (136)..(136): Xaa can be any naturally occurring amino acid
  misc_feature (286)..(286): Xaa can be any naturally occurring amino acid
MSFPAMEVARSPHLPCVPVDANATDSNSATDVLDLWRQQKQIPAPFVWPHADARPSSMLELDVPVVDIGAALHSAAGMGRAAAQVAEACASHGFFQVTGHGVDLALARAALDGAADFFRLPLATKQRVRRSPGTRXGYASAHADRFAAKLPWKETLSFSHNHDDVGARGNSHVVVDYFTSALGDDFKHLGEVYQEYCEAMEEASLAIMEVLGVSLGLGRGYYRDYFADGSSIMRCNYYPRCPEPDRTLGTGPHCDPSALTILLQDGDVDGLQVLVDGAWRFVRPKXGELVVNIGDTFMALSNGRYKSCLHRAVVHREKERRSLAYFLAPREDRVVRPPPSPAPAPRLYPDFTWAELMRFTQRHYRADSRTLDAFARWLDPPSFSAAPLPTRPRPK

SEQ ID NO: 12545 - protein, 370 aa, Unknown
  Iris x hollandica
MAPGASTPPFLPTCSNGTTLPVTFVRDEEERPKVAYNAFSDEIPVISLEGIDEAGDGGRREEIRRKIAAACEDWGIFQVVDHGVDAGLVADMARLAREFFALPPEEKLRFDMTGGKKGGFIVSSHLQGEVVQDWREIVTYFTYPIISRDFSRWPDKPNEWRSVTEKYSEKLMELACKLLGVLSEAMGLEKEALTKACVDMDQKVVVNFYPKCPQPDLTLGLKRHTDPGTITLLLQDQVGGLQATKDGGKTWITVQPIQGSFVVNLGDHAHFLSNGRFKNADHQAVVNSNSSRLSIATFQNPAPDADVYPLAIREGETPVLDEPIKFTEMYRRKMSRDLELAKLKKLAKVTENAKVEEAVAQPKGLNGIFA

SEQ ID NO: 12546 - protein, 198 aa, Unknown
  Platanus x acerifolia
LGALLEEREGRLSDEEIVDYLVALLVGGYETTSTTMTLAVKFLTDTPLALAQLKKEHDEIMARKQNEALQWSDYKSMPFTQCVINETLRVANIVSGVFRRAIKDVNIKGYTIPKGWKVFASFRAVHMDQHHYKEARTFNPWRWQQEASPTTPAENVFTPFGGGPRLCPGYELAGVEISIFLHHLVTMFSWVPAGEDRL

SEQ ID NO: 12547 - protein, 418 aa, Thermobifida fusca
MTDIERDVRKVAERARDAAADLAPLSRDAKDEALTAVADALRERTEEIVAANAKDVAQARENGISEAMIDRLTLTPARITAIADAVHEIVELPDPVGEVVRGKTLPNGLELRQIRVPLGVIGIIYEGRPNVTVDAAALCLKSGNAVLLRGSSSAYSSNTVLTDVIRQALASTRVPVDAVQMVPGKSRESVKHLMRARGLVDVLIPRGGASLIQTVVNESTIPVIETGTGNCHVYVDEAADLDQALKIVLNSKTQRCSVCNASETLLVHAGIADAFLPRALAELREAGVTIHGDERVRSYDSSVVPATEEDWATEYLSLDLAVRVVDSLDEAVAHIRAYSSAHTEAIITDSQAAARRFVSLVDSAAVMVNASTRFTDGGEFGFGAEIGISTQKLHARGPMGLPELTTTKYVVTGEGHVR

SEQ ID NO: 12548 - protein, 385 aa, Parvularcula bermudensis
MAQDYYDLLGVERSADGAAIKSAFRKLAMKYHPDRNPGDEAAEKKFKEIGEAYEVLSDDQKRAAYDRFGHAAFQNGGGPGGPGGAGFGGGFASGAFSDVFEDIFGEFMGGGGGRGRGRRQSGRGADLKFEVTVELGEAFAGIEKEISVPSSEACDVCEGSGAEPGTSPTTCSTCGGAGRVRMQQGFFAVERACPTCQGQGETIETPCSNCGGQGRVRKNRTLAVEIPAGVEDGTRIRLTGQGEAGLRGAPFGDLYLFVRVRDHQLFERDGADLYCHVHVPMVTAALGGEIEAPTIDGGRVKIKIPEGSQSGRKFRLRSMGMNQLRRPVRGDMFVELMVETPTNLTSRQKELLREFCEEGGGNDCPQSNNFFDRAKEFWDNIRDAS

SEQ ID NO: 12549 - protein, 715 aa, Streptomyces coelicolor
MTRARPNWKGSPVWSGHPYPLGAAYDGQGTNFALFSEVAERVDLVLVDDDGNHSTVPLPDVDGFVWHCYLPGVGPGQRYGYRVHGPWAPAVGHRCNPAKLLLDPYTRAVDGLVDNHASLFERARGKADPGDSAGHTMLGVVTDPFFDWGDDRPPRRPYSESVIYEAHVRGLSRTHPDVPEELRGTYAGLAHPAVVDHLTSLGVTAVELMPVHQFVHDGVLLDRGLSNYWGYNTIGFFAPHNGYAALGTRGQQVSEFKSMVKTLHEAGLEVILDVVYNHTAEGNERGPTLSFRGIDNASYYRLVDGDWQHYYDTTGTGNSLLMRHPYVLQLIMDSLRYWVTEMHVDGFRFDLAATLARQFHEVDRLSAFFDLIQQDPVISRVKLIAEPWDVGEGGYQVGNFPQLWSEWNGKYRDAVRDFWRAEDHSLGEFASRLTGSSDLYQHSRRRPRASVNFVTAHDGFTLRDLVSYNDKHNEANGEDNRDGESHNRSWNCGAEGGTKDPAVRELRGRQQRNFLATLLLSQGIPMICHGDELGRTQRGNNNAYCQDNEISWIDWRLDGEQRALLDFARRLIALRADHPVLRRRRFFHGETLTHADQPLPDLVWLLPDAREMTDDDWQRSDAHTVGVFLNGDAIAEPDPRGRPVVDDSFLLLLNSHWEPADFRLPDAGYGERWTALVDTADPDGVPDEAEHKAGTRLTVEQRSLVLLSRPSRTGR

SEQ ID NO: 12550 - protein, 417 aa, Thiomicrospira crunogena
MDVKAYMQKLGQQAREASRQLMVATTRQKNTALLNIATALEEQAETLKTENAKDLEQGKANGLDAAMLDRLALTDKVINGMATGLRQIAALNDPIGEISDMNYLPSGIQVGKMRVPLGVVGIIYESRPNVTIDAAALCLKSGNAALLRGGSEAAYSNRALAKCIQSALHESGLLPTAVQVVETTDRAAVGEMIAMPEYVDVIIPRGGKGLIERISEGAKVPVIKHLDGICHVYIDDDADADKATRVAFNAKTHRYGVCNAMETLLIADSRAAEILPGLVELYEEKGVELRGCEQTRAICDMKAATEEDWATEYLAPILSIKVVDDVDEAIDHITQYSSGHTESIITENLTTSRQFLARVDSSSVMVNASTRFADGFEYGLGAEIGISTDKFHARGPVGLEGLTSQKYIVLGDGTIRE

SEQ ID NO: 12551 - protein, 425 aa, Thiobacillus denitrificans
MDVKSYMQTLGRQAREASRAIARADTEQKNRALLTMAAAIRRDAARLLAANAQDMEHARAAGYDAALLDRLQLSEKTVAGMAEGLEQIAALPDPVGEIDGLKFRPSGIQVGKMRVPLGVIGIIYEARPNVTADAAALCLKSGNAAILRGGSEALRCNQAVAACVREGLEAAGLPAAVVQVVETTDRAAVGELITMKDYVDVIVPRGGKGLIERITGEARVPVIKHLHGNCHVYVDDRADLAKAVKIVENAKTQRYGTCNTTESLLVARAVAAAALPQIGAMLAGKGVEMRGCPESLAILQAAGVPADKLRPAVESDWYEEYLGPIIAVKVVDDLDAAMIHINTHGSQHTDAIVTEDYGRARRFLREVDSASVVVNASTRFADGFEYGLGAEIGISTDKIHARGPVGLEGLTSQKWVVLGDGHVRA

SEQ ID NO: 12552 - protein, 444 aa, Streptococcus pyogenes
MLFTETSTMQMIKHNYDSSKTYKEMTMIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDADTEMLNYEAILEQAKAVQPKLIVAGASAYSRNIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFNTSGIRIGCAAITSRGMGVKESQTIARLIIKALVNHDQETILEEVRQEVRQLTDAFPLYKK

SEQ ID NO: 12553 - protein, 624 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIDMCAPNNNSSGFLPNQLTEKSVMVEGLSGGASQVQSWQFMDDEISNCVQNSTNSSESISRTSENPGKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRTICKC

SEQ ID NO: 12554 - protein, 214 aa, Ostreococcus tauri
MSAEADDYDYLFKVVLVGDSGVGKSNLLSRFTRNEFCLESKSTIGVEFATRTIEIQNKIIKAQIWDTAGQERYRAITSAYYRGAVGALLVYDVTNKDTFGNVEKWLSELRDHADANIVIMLVGNKCDLAQLRVIQAVKAQQFADTEDLIFIETSALDATNVETAFINALSNVYNVVSKNQAVNAEETSNKQNRSILISAAEDGFRPKSKCCSTQ

SEQ ID NO: 12555 - protein, 624 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRQDNSRKDGLWRPEDDEIGTTDLFSERRRRDKTKERYSVLGSLIPSTSKDDKVSILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRTICKC

SEQ ID NO: 12556 - protein, 532 aa, Daucus carota
MGGCFSKKEYQADGNGYRSAPTAYHTVTDQSYEKSSQRSQPQAQPQPQVQQTGPSLKPRQVHRPESNTILGKPFEDIRGKYTLGKELGRGQFGCVYQCTENSSGQLYACKSILKRKLVSKNDKEDIKREIQILQHLSGQPNIVEFKGVFEDRQSVHLVMELCAGGELFDRIIAQGHYSERAAATICRQIVNVVHVCHFMGVMHRDLKPENFLLSSKDKDAMLKATDFGLSVFIEEGKVYRNIVGSAYYVAPEVLRRSYGKEIDIWSAGVILYILLSGVPPFWAENEKGIFDAILEGVIDFESEPWPSVSNSAKDLVRKMLTQDPRRRITSAQVLDHPWMREGGEASDKPIDSAVLSRMKQFRAMNKLKQLALKVIAESLSEEEIKGLKSMFANMDTDKSGTITYEELKSGLARLGSKLSEVEVQQLMDAADVDGNGTIDYLEFITATMHRHKLESYEHQAFQYFDKDNSGFITKDELESAMKEYGMGDEATIKDIISEVDSDNDGRINYDEFCAMMRRARNRRKLFSVSLTS

SEQ ID NO: 12557 - protein, 197 aa, Leptospira interrogans
MFNLKILIFIYIIFFSPNLMATPKTEKATFAGGCFWCMEGPFESLPGVISVVAGYSGGKEFYPTYQEVSRGKTGHRESVQIEFDSSKIRYEELLTVFWNQIDPTDNGGQFADRGNQYRTGIFYHNQTQKKAAEKSKREISESKKFPGSIVVEIIPFTSFYPAEDYHQNYYKTNSEQYKKYKKYSGREDYLEKMCRQR

SEQ ID NO: 12558 - protein, 624 aa, Cornus unalaschkensis
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIIWKC

SEQ ID NO: 12559 - protein, 316 aa, Haemophilus somnus
MTIYADNSYSIGNTPLVRLKNFGNNGNIIAKIEGRNPSFSVKCRIGANMVWQAEKDGILTKDKEIIDATSGNTGIALAYVAAARGYKITLTMPETMSSERKRLLRGLGVNLVLTEGVNGMKGAIAKAEEIVASNPNHYVMLKQFENPANPAIHQQTTGPEIWSGTEGKIDVLVAGVGTGGTISGISRYIKQDQGKKIITVAVEPEESPVITQTLAGEETKPGPHKIQGIGAGFIPKNLDLSLVDQIEKVSSETAIITARRLMAEEGILGGISSGAALAVADRIAQRPEFSDKLIVVILPSASERYLSTALFDGFEG

SEQ ID NO: 12560 - protein, 374 aa, Carboxydothermus hydrogenoformans
MKIVIVGGGIAGVSAAAAAREVSDTAEITLISAEKYYPYYRLKLSEYLSGELKEESLLLHPPSWYEERKIKVILGKKVTGARLESRELTLHDGTVVPFDRLILTTGSYAFKPPVSGGDLPGVYTLRNLDDLKAIRDRAEKARRAVVIGGGVLGLEVAYYLGKRGVWVGVVEHNDRLLPRQVDEEGSKILSRAAQEAGVELYLARDVDRIEGIEQVEKVVFKDGSSVATDIVVFSTGVRPYLEVANMLTLGINRGIIVDKYMATSRENIYAAGDVAEFEGQMPGIWPVAMEQGKVAGANAAGASKIYTPIPPQNVLKVFGKTVFSIGTVMGEGVTSRREDRGDNFLKYYYKDEKLVGALLIGDVKLVNEVRKLFS

SEQ ID NO: 12561 - protein, 1410 aa, Thiomicrospira crunogena
MLKHSLSALLLLSALLPFSAQALTLNSSEQQWIKDHPQITLGSDYNWPPYDFKDSAGKHNGISADILDRIRQITGLKIKVRSGVWSTILEQAEQGTLDGLACAVKTPDRAEHLYFTAPYTSMPLGIFMQDKSTSTSIKTMDDLTTQTVTINRDSYMHEWLKQNYPHLKLYLVNSNAEALEAVSFGKANVYIGNMAVATYLIKKNYLTNIQAVAKINHFKTDTAIAIHKDKPILFGIIKKALKEISQKERNTILEKWFIKSKTTYIDLSNQEIAWIKAHPVIKVAGEPDWAPFDFVADNTYQGIANDYLNLIAQKTGLNFHIDIHSWEQNLTLLKKQQVDVLPAAYFSAERTSYAKFTTPYYKPLTYFFVRHDLKASSLNDLENTTIAMPKGYLHIDFLKQRFPNITILETDTLNEAINAVIQNKAQVLYENYAVLSYILSQSGINTIKPLAPAKQANQSLHFMIRDSAPELASIMNKALASITPQERKDIEERWLTIAPNKINITLTPAEQNWLNQHAQVSFTGYPDHLPYEGFKSNANQPIQHQGIVSDFIHSLESHLPLQFIPRAYKSWPDTLKAIHQTPVDIISAEIDTPELLAQYRPIIPYLTTPMVIVMKNQDTFVNTLRQLTTETIALVSNDATSEKLLKQYPNQHFKTWPNAKSVLEAVAFNKADAAILSLAKASYLIKQNHYTSLKIVGKTDVQKQFTLFVNKRYPELFSILQKSMPAITEEHGSGILSQWTKIKFASKFDYALFFQMFSFLLVVIGIIFFWNRRLTKEVKQRLQAEKRLKENETQLQGLIDSIPLMIMVTNHQGKILSANRQTLKNYQLNFQELSELNSTTFYSDPDDRQQILNALQAGEQIHQKIISMKDADGIPRKMMLSVLPIHFNQQPANLSIAIDLTERIQFEKELQQAKEQAESASQTKSQFLANMSHEIRTPMNAIIGFTELLNEQVTEPRLKRYIRTIQAAGKTLLTLINDILDLSKIEAGKMDLDKKAVNPHSLFDEIGQIFMINIQRKGLDFLVDIDKTLPEGLLLDGVRLRQILFNLLGNAVKFTEQGYVKLKVSACDVDEHHSKLDILIQVSDTGIGIPEDQQARIFNAFEQRENQDVQKFGGTGLGLAITQRLVNMMGGDIWVESTPGQGTTFNLLIHHVDISATNQSDQPNSDERPVPQLIEFHPTTILVVDDIDDNRALIKQNFVDTDVTVYEAQNGEEAINCFHSEKGISLILMDLRMPIMNGYQAAEIIKQKSPSTPIVALTASVMTETADAPKRQHFDDYLRKPVFKADLFNILKKYLPHEILTPTPEFSETQEVLSDKAKLNAPQFLEAIQEQLSPTQKTILKTNNIEEIQRFAQTCEALADQYDSKTLKTYATQLLEATESFDIKAMQQLLKYYETLEARLDKLLNDAISP

SEQ ID NO: 12562 - protein, 97 aa, Atropa belladonna
ATYKVKLVTPDGPVEFDCPDDVYILDQAEEEGHELPYSCRAGSCSSCAGKVSAGTVDQSDGNFLDDDQMADGFVLTCVAYPQSDVTIETHKEEELTG

SEQ ID NO: 12563 - protein, 291 aa, Mycobacterium smegmatis
MPSDNRQPEEVWLAMAVVTMKQLLDSGAHFGHQTRRWNPKMKRFIFTDRNGIYIIDLQQTLTYIDKAYEFVKETVAHGGTVLFVGTKKQAQESIAEEATRVGMPYVNQRWLGGMLTNFSTVHKRLQRLKELEAMEQTGGFEGRTKKEILMLTREKNKLERSLGGIRDMQKVPSAVWVVDTNKEHIAVGEARKLGIPVIAILDTNCDPDVVDYPIPGNDDAIRSAALLTKVIASAVAEGLQARAGQGSGEKPAEGAEPLAEWEQELLAGATAGAADASAEGAAAPESSTDAS

SEQ ID NO: 12564 - protein, 624 aa, Cornus cf.
MASSGEQNQVGLLENLKNQLAIAVRSIQWSYAIFWSISSRQPGVLEWGDGYYNGDIKTRKTVQAVEFNADQLGLQRSEQLKELYESLVVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILVKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVQSRQDNSKKDGLWRSEDDEIGTTDLFLERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSIRIIDKDVFIEIRCPWRERLLLEIMDAISNFHLDSHSVQSSNIDGILSLSIKSKFKGSTVASTGMIIQALQRIICKC

SEQ ID NO: 12565 - protein, 573 aa, Haemophilus influenzae
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPEYVELRSYNPTVNGHKGQIKKALKALLVAKKPILFVGGGAITAECSEQLIQFAQRLNLPVTSSLMGLGAYPSTDKQFLGMLGMHGTLEANTAMHESDLILGVGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 12566 - protein, 199 aa, Haemophilus parasuis
EAGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYNEMQAIFAEWKKTELDSYLIDITTDILGYKDTNGTPLVEKILDTAGQKGTGKWTGINALDFGIPLTLITESVFARCVS

SEQ ID NO: 12567 - protein, 208 aa, Sordaria macrospora
ITLEVESSDTIDNVKQKIQDKEDIPPDQQRLIFAGKQLEDGRTLSDYNIQKESTLHLVLRLRGGMQIFVKTLTGKTITLEVESSDTIDNVKQKIQDKEGIPPDQQRLIFAGKQLEDGRTLSDYNIQKESTLHLVLRLRGGMQIFVKTLTGKTITLEVESSDTIDNVKQKIQDKEGIPPDQQRLIFAGKQLEDGRTLSDYNIQKESTLH

SEQ ID NO: 12568 - protein, 173 aa, Pisum sativum
MNSDPLILGRVIGDVIDYFTASIKMSVIYNNKEIFTGYEVPFPSTVKTKPRIQIQGGDMRSLFTLIMIDPDVPGPSDPYMKEHLHWMVTDIPGTTDSTFGKELTSYEKPKPNIGIHRYVFVLFKQKRGNKYSITCPFSRDHFNTRNFADQNDLGVPVAAAYFNARRATAPRRR

SEQ ID NO: 12569 - protein, 209 aa, Photobacterium profundum
MSRNKQSASSGRWLKEHFDDKYVQEAQKRGYRSRAIFKIEEIQKKDKLLKPGMTVVDLGAAPGGWSQYAAEVVGDEGQVIACDILSMDSLPGVSFLQGDFREEAVLSALLERIQPDMVDVVLSDMAPNMSGNLASDQPRAMYLVELALEMCKQVLAPNGSFAVKVFQGEGFDQYLAEIRNMFKVVKIRKPDSSRDRSREVYIVATGYKL

SEQ ID NO: 12570 - protein, 246 aa, Brassica napus
  misc_feature (222)..(222): Xaa can be any naturally occurring amino acid
MEETDRSRAFAKDVKRIVVKVGTAVVTGKGGRLALGRLGALCEQLAELNSDGFEVILVTSGAVGLGRQRLRYRQMINSSFADLQKPQSELDGKACAGVGQSSLMAYYETMFDQLDVTAAQLLVNDSSFRDKDFRKQLSETVKSMLDLSVIPIFNENDAISTRRAPYQDSSGIFWDNDSLAALLALELKADLLILLSDVEGLYTGPPSDPDSKLIHTFIKEKXHQDEITFGDKSRLGRGGMTAKVKA

SEQ ID NO: 12571 - protein, 374 aa, Ustilago maydis
MSAREKRSGDAESTPVTVADGVHTHGVLNQHPNASPSAVAGEVANGSSAGSKADLSFRVGISEDSNKRWRRAMEDAHAFVYDFAGVHGQGFFGIFDGHAGKDAAEWCGQNFHKSLLKTLELNPDKPVPDSLNLTFHSVDRELANLASQQGSSSGCTAAIAFLRLEDESGQPLKVGGRASTGPDGHAHEEATRPEHSSERTSGDGLWGKLSKRFDSSDPKNERNSSPSSRRVLYTANVGDARAVLCRGGKAIRLTYDHKGSDAQEAKRITDAGGFVMNARVNGVLAVTRSLGDSAMKEFVVGSPYTTETVLGNEDSFLIIACDGLWDVIEDQEAVDLVRDVQDPQVASQELLKHALNEFSTDNTSVMVVRFASPS

SEQ ID NO: 12572 - protein, 1711 aa, Methanosarcina mazei
MRGLAFAEIDRTEASILCFEKALELMPEYAAAWCAMGTVAGKAERYEEALENFERALEINPKDSEACYAKGLVLAKLEKYDSALECFDSLTRENPRNENALEQKCLLLAKIGKKDLALEALEDFLKKYPANEAALYHKGILLSELSRYEEAEKIFSKVLKLDPENREAWFRKGFALVQLLRLNEAIKAFEEAIKIDPSYFEAWNCRCFALMKLEVYEEALEAFDSMLRIYPDVKDIWYSRALALLKLQNYAEAVQSFARVTELDPENKDAWLQQGLLLARTGKHEEALNALEKLLEYDPDFTEAQKLRGTVLAGLGRFEEALGPLEKSLEKEPENYNLWLQKGLILLDTGKLEPAIDAFENAARLNPDNETCWMNMGFALYSLERYEEALEAFKEGLRLNPYLETGWNRKGIVLGKLGKTGEALEAFEEAIKLRPDFEDAWKNRGLLLFASEECEKAEEAFAEVLKINPEDIDSLYNRGISLLKLGRKETALEYLEKVVSLRPDYPDLSYSLGVALTELGEYEKALETFEKLASENPYDLEIQCRRGKLAMEVGNYETALQAFERILTEKPASREAWYRKGLALLKLENFEEAVKAFDAVATKDADYEDAGVLKGFAQMKLKECASALETFERVLEKKPDSDTAWYYRGMILYTLQRQEEAAKAFESASRLNPGLYTAFEYRAKCLFETGQYEAAFEAFEAVLEKDPENLSALEKRAICLFELKKNKEAVDALSTLLESDPERKDTKLRLEEAKLRLGIEYFELGQYENALELFEGINEKAEGIYEKTRDPQKPNSVLYWKGLVFIRQEAYEKAVEAFKGITDQDPNFAEGWYFTGLSCSKLGRYEEASEAFKKALEINSALRDTHDICYQLGISNFELGKFEEALKAFEKAFKTTPDREQITETTYTDLIYMKSLSLLRLGRYKEAEVGFKEVIFRDSDNAEALAHLSTACFKQEHYEEALEIFEKVLSQTPERKTVLFRKGVALKALGKIQDSLDIFDLVLKLKPDCSYALEQRGYALFELGRYGEAAEAFKEALEYCPNKTYMQYLKGLAFFRIGNFTEALEGFGKALELGCQKPDIPYYTGLSCFETGDYAGALKAFDRLPEEGTQDPDVLQKRALALFELGRQEEAVSAVNFLLELSAENLTIGEKGNEPEGNEPEKSPEENNRICQELLEKFASALIELGKPEEALLPLEKLAREGSASKETLYDRGIALLELGRQEEAFEIFSDLIEIYPDFKKAWYGKGLVLFSQEHYEEALKALKQAVPDGEESKIGEPELEDALTKIGLSQLKTGKYEDACDTFEKVLEKNPMAADIWYLSGLVMRGLDQNEDAVEAFNRALEIKPDLRAAQEQKGLALLSLCRYEEARDAFSSVLEESPENADVLYNRAVASFKTLNFEDAAKDLEKVLLFAPDSPDYTEACYMLGIASIELQDYERALQALDMVLEWEPEHEEALYNMALVLFNLEEYEEAARTFEQLLETSPEDPESLNYLGLCLLELDNLKEALKAFEKAALFNPKNEEALYNAATTLIKLNRAQESLGYFDRILEISPDNLDVLNYKGVIFCMLDQYREALRAFDGVLKRDPENIKAIYNVGVVCFKQKLYETAARAFKEALSINPWHEQSLRYLGISLAKIGEYEEALKAFEKLLRINPQDVQSMNYRGVILGKLERFGEAIRAFDEILRIYPDMADAREKLEVLKSLENDEELY

SEQ ID NO: 12573 - protein, 310 aa, Trichodesmium erythraeum
MANNMVASDLWISEHITPWDIYVHGLTKVLAYKKTAYQEMYIVETGIYGKALVLDGKWQSCTGDEFLYHEPLVHPAMICHGSPRKVLVLGGGEGATIREVFRWQSVEKVAMVDIDGEVVEACRQYLPEMHANAFDDPRLQLVIGDALKFLETFGESWDVVISDLSDPIEEGPSFQLFTKEYFEKILRVLTPGGFFVVQAGPVSPGEMKLHARIVNTMKAVFPFVQSYNSNIPTYGRPWGFALGSRKMVNSRPEPEMIDKLLKEKTIGGFRMLDGTTLLGMLQVPLHLREAIATETKIYTLAEPPKFGRPA

SEQ ID NO: 12574 - protein, 624 aa, Cornus cf.
MASSGEQNQVGLLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 12575 - protein, 485 aa, Oryza sativa
  misc_feature (370)..(370): Xaa can be any naturally occurring amino acid
  misc_feature (405)..(405): Xaa can be any naturally occurring amino acid
MVLELLTMAAHRVGRCMLLQPPRLATCVLFLLLPLLLPCSASSSVITHLPGFHGRLPFHLETGYVGVDEETGTELFYYFVESERSPSTGPVILWLTGGPGCSGFSGVVFEVGPMKYVLEPYNGSLPRLVYNQYSWTQMASILFLDTPVGSGFSYAHDPKGYNVGDISSSLQVVTFLKKWFNDHPRYLSNHFYVGGSSYAGKVIPIIMKFISEGIEQRQQPLVNLKLQGYIVGNPITGSKIDDNFKIPYSHGVGIISDQLYEAAVANCNGDYVTTTNELCAKALNAIDNLMSEVDYGNILDDKCVRATPKPINEVSRSRSLQEDYIRLSEPTVRPTINCFSYRYYLSFLWMNNNLTREALKIKKGTVRRWXLRCKTGLPYVQDVASSIKYHFDLTTGGYRALVFRXKSSEENSFICFLQAWIRSLNFSIVDEWRAWHVDGQAAGFTILYANNLTFATVKGGGHTSIETNPKQGFAMGKRWLDNKPL

SEQ ID NO: 12576 - protein, 199 aa, Ostreococcus tauri
MSRRVELRRTAREKRAYDDFATLYALARALERLERAYVSSSVSANAYERACVDLMQKFKTLRSVLSDAVPDLDRFFETYGAHVPSARKRLASGVPATAEHRGSTARGTDAEQRAEARAVADATHCFIGVMDTVKLDMRAKDQVGRLSRLPSDFEGTKSVPEMFEQDGRDASERGDGRGRGEDFLYEIETAYSKFLAALA

SEQ ID NO: 12577 - protein, 624 aa, Cornus unalaschkensis
MASSGEQNQVGLLENLKNRLAIAVRSIQWSYAIFWSISSRQPGVLEWGDGYYNGDIKTRKTVQAVEFNADQLGLQRSEQLKELYESLAVTESNQQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRRRGTPQKLLKKVLFEVARMHGGCLVESRPDYSRKDGLWRPEDDEIGTTDLFSKRRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTRMIIQALQRIICKC

SEQ ID NO: 12578 - protein, 567 aa, Vibrio cholerae
MTKIVIIGGVAGGASAAARARRLSEDAEIIMFERGPYVSFANCGLPYHIGGDIKERSNLLLQTPESFLARFNVDVRTMNEVLRINRAAKTITVRNLLDQSEYDENYDFLLLSPGAGPVIPPIPGIQNPLTHSLRNIPDMDKIIQTLQMNKPEHATVVGGGFIGLEMMEAFHHLGIKTTLIEMADQVMTPVDREMAGFAHAEIRAKGIDLRLGAALKSVEYRPAATLPSAESGESLEHKHVEGELDLLLSNGDTLTTDILIMAIGVRPETKLAAEAGLQLGELGGIWVNEQMQTSDPAIYAVGDAVEEKDFVTGKQTLVPLAGPANRQGRMAADNMLGRNESYQGTQGTAICKIFDLAVASTGKNEKQLKREGIAYEKVYVHTASHASYYPGAEVVSFKMLFDPQTGKIFGAQAVGKDGIDKRIDVMAVAQRAGMTVEQLQHLELTYAPPFGSAKDVINQAAFVATNLIKGDAKAIHFDEIDNLTDEQVLLDVRNPMELQNMGYLPGAINIPVDQLRQHMNELPKDKEIVIYCQVGLRGNVAYRQLVNNGFKARNLIGGYRTYKFAKA

SEQ ID NO: 12579 - protein, 624 aa, Cornus cf.
MASSGEQNQVELLENLKNRLAIAVRSIQWSYAIFWSISSRQPGVLEWGDGYYNGDIKTRKTVQAVEFNADQLGLQRSEQLKELYESLAVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILAKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRTICKC

SEQ ID NO: 12580 - protein, 624 aa, Cornus suecica
MASSGEQNQVGLLENLKNQLAIAVRSIQWSYAIFWSISSRQPGVLEWGDGYYNGDIKTRKTVQAVEFNADQLGLQRSEQLKELYESLVVTESNPQARKPSAALSPEDLTDTEWYYLVCMSFVFNIGQGLPGRTFANGQPIWLCNAHYADSKIFSRSLLAKSASIQTVVCFPFLGGVVKLGVTELVLEDPNFIQHIKTSFLENPYRTVPKIPSCASENTRTEKDLILVKPSHILLDTDLDAALECGEIDMCAPNNNSSGFLPNQRTEKSVMVEGLSGGASQVQSWQFMDDEINNCVQNSTNSSESISRTSENPEKDCCLTDLPECNLTKLTSLDLPNDDIHYHSVVSSLLKNSHQLILGPYFHKCNRESSFMGWKKTPSGIQERRRGTPQKLLKKVLFEVARMHGGCLVESRQDNSKKDGLWRSEDDEIGTTDLFLERRRRDKTKERYSVLGSLIPSTSKADKISILDGTIEYLKELERRLEDSECLEARTRSKPQDTAERTSDNYENDRIGIGKKPLINKRKACDIVEAELEINLVQLKDSSTDDVSIRIIDKDVFIEIRCPWRERLLLEIMDAISNFHLDSHSVQSSNIDGILSLSIKSKFKGSTVASTGMIIQALQRIICKC

SEQ ID NO: 12581 - protein, 117 aa, Arabidopsis thaliana
MNMTAPVIAQATPGRSVYTVSLYLPKKNQQNPPQADDLHVRSTKPTYVAVRQIGGYVSNNVAKDEAAALMESLRDSNWILPIEKSKGKLPAYFLAVYNPPSHTTARVINEIMVPFNM

SEQ ID NO: 12582 - protein, 624 aa, Cornus suecica
MASSGEQNQVGLLENLKNQLAIAVRSIQWSYAIFWSISSRQPGVLEWGDGYYNGDIKTRKTVQAVEFNADQLGLQRSEQLKELYESLVVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILVKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRPEDDEIGTTDLFLERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 12583 - protein, 475 aa, Leuconostoc mesenteroides
MEQADFGVVGLAVMGRNLALNIESRGYRVAVYNRSRERTDDLVQKHEDKAFIPSYTTEEFVETIKKPRRILLMVKAGKGTDAVIDELLPHLEKGDMLIDGGNTYFEDTIRRSDKLAQEGINFIGMGVSGGELGALQGPSLMPGGQREAYDLVAPILTQIAAKAPEDGKPTVTYIGPNGAGHYVKMVHNGIEYGDMQLIAESYDILKRVLHLNQEQLSQTFSGWNEGELNSYLVEITADILTRKDDLGTDKPIVDVILDRAGNKGTGKWSSQSALEVGAPQSLITESVYARYISAMKDDRVAASKTLQGPDYSFSGDEQSTVEDIRKALYFGKIMSYAQGFDQLRMASEHYDWHLPFGELAQLWRAGAIIRAQFLQRITDAFTTQADLHNLLLDPYFQHIAEEYQNAARRVVALAVTAGVPTPSLSAAVAYYDSYRSAVLPANLTQAQRDYFGAHTYERTDKPAGEMYHYPWYDEA

SEQ ID NO: 12584 - protein, 205 aa, Triticum aestivum
MGKSDFLTPKAIANRIKAKGLQKLRWYCQMCQKQCRDENGFKCHCMSESHQRQMAIFGQAPDRVVEGFSDEFLEEFLTLLRRAHRSSRVAATVIYNEFIADRHHVHMNSTRWATLTEFVKFLGREGHAKVEDTPKGWFITYIDRDSEQAIKARLKRKRVKSDLAEDERQELMIARQIERAQKAQANGEEDDDANADDDLGSEDDE

SEQ ID NO: 12585 - protein, 334 aa, Prochlorococcus marinus
MSQNNKGLVLITGTTSGVGLNSLKPLLRFGWEVIAVNRSNKRAITIAEEFLTKDEIQNVHFIEIDLSNLDDVRKGCDEILERFKKPINSLICNAAVYKPRLKRPERSPQGFENSMAVNHFGHFLMINLLIENILSSEREIVLNGKSTLFKPRITVLGTVTANFSELGGRIPIPAPADLGDLSGFKNGFLSPISMANGKKFKPGKAYKDSKLCNMVTVQELSKRYSAEKIIVNSLYPGCVADTKLFRNTPWLFRFLFPIFQKFITKGYVSQRLAGERVAQVATSKEFAKPSVHWSWGNRQKSGRKAFSQKLSKRIIDAKTSQQTYDLTKQLVGLG

SEQ ID NO: 12586 - protein, 210 aa, Catharanthus roseus
MYQSNAHNSDHLTFLPPLVDYQFLNNDFDFSEIFTDFNYANYNYNTSTSDNFSGFQFNENCEEIISPNYASEDLSDIILTDIFKDQDNYEDEVVAGEQEEELITTPTSRGGGGGGCEQRSNEEWIRYRGVRRRPWGKFAAEIRDPKRKGSRIWLGTYETAEDAALAFDQAAFQLRGSRARLNFPNLIGSANAPVRVSPRRRSSSCHLRPQ

SEQ ID NO: 12587 - protein, 359 aa, Burkholderia vietnamiensis
MFLKNAWYVACTPDEIDGKPLGRKICNESMVFYRAADGRVAALEDFCPHRGAPLSLGFVRDGVLVCGYHGLEMGCNGKTAAMPGQRVGGFPAIRSFPVVERYGFVWVWPGDASRADPAALPALTWADDPVWAHGGGLYHIRCDYRLMIDNLMDLTHETYVHATSIGQKEIDEAPPKTTSHGDEVVTSRFMHNVMPPPFWQMALRGNGLADDVPVDRWQICRFTPPSHVMIEVGVAHAGHGGYDAPAEHKASSIVVDFITPETDGSIWYFWGMARNFRPDDDALTATIREGQGKIFAEDLEMLERQQRNLEQWPERKLLKLNIDAGGVLSRKVIDRLLAAEEAGGAPSATAAVVRIEAAS

SEQ ID NO: 12588 - protein, 248 aa, Picea mariana
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKMLAHPQYPSLLGAYIDCQKIGAPPEVVARLDALTHEYENQQHRTTVSIGMDPELDQFMEAYCEMLTKYHEEL

SEQ ID NO: 12589 - protein, 283 aa, Prochlorococcus marinus
MTHISTWIDEYHKGSRFGLNGEILIKQNSKYQEIIVIENEYYGRALMLDGCWMTSLKDEKYYHECLVHPALSSIDEKSNVLIIGGGDGGTARECVKYPQISKIDLVEIDEEVIKISKKFLKEIGGEAWSDKRLKIHIDDGVQWVKKTRDNFYDVIFIDCSDPSELSNLLFSDSFYRECKRILTKNGILATQSESPESFKNIHISILKTLKKFFRVSETMYSFVPIYPSGIWSWTFASEEVLHLSKRNCNEALRIEKSCEIWNLNFQNAAFKMMPNKIVKELNS

SEQ ID NO: 12590 - protein, 707 aa, Photobacterium profundum
MNPIVKTFQYGNHTVTLETGVMARQATAAVMASMDDTSVFVSVVGKKAAVEGQDFFPLTVNYQERTYAAGKIPGGFFKREGRPSEGETLTARLIDRPIRPLFPSAFKNEVQVIATVVSVNPEVNPDMITMIATSAALAISGLPFNGPIGAARVGFINDQFVLNPSNTELEESRLDLVVSGTKDAVLMVESEADRLSEETMLQAVVYGHDQQQVVINAINEFAAEVATPAWDWTAPVVNAELKARVADKAATRLSDAYQITEKMARYDEVGSIKNDVVASLLAEDETLDERELRGMLSSLEKHVVRGRIIAGHPRIDGREKDMVRALDVRTGVLPRTHGSSLFTRGETQALVTATLGTQRDAQIIDSIMGEKKDHFLLHYNFPPYCVGETGFVGSPKRREIGHGKLAKRGIAAVMPSVEEFPYTVRVVSEITESNGSSSMASVCGTSLALMDAGVPIKASVAGIAMGLVKEGDDFVVLSDILGDEDHLGDMDFKVAGTDDGITALQMDIKIEGITKEIMQIALNQAKGARKHILSVMDDAIGTHRDDISQFAPRIHTMKINSDKIKDVIGKGGAVIRALTEETGTTIEIEDDGTIKIAATEGAAAKEAIRRIEEITADVEVGRIYTGKVMRIVDFGAFVSVIGAKEGLVHISQIAQERVEKVSDHLQMGQEVQVKVLEIDRQGRIRLSMKEAVADQNPATVQDEQPQG

SEQ ID NO: 12591 - protein, 490 aa, Saccharomyces cerevisiae
MFPRASALAKCMATVHRRGLLTSGAQSLVSKPVSEGDPEMFDILQQERHRQKHSITLIPSENFTSKAVMDLLGSELQNKYSEGYPGERYYGGNEIIDKSESLCQARALELYGLDPAKWGVNVQPLSGAPANLYVYSAIMNVGERLMGLDLPDGGHLSHGYQLKSGTPISFISKYFQSMPYHVDHTTGLIDYDNLQVLAKAFRPKVIVAGTSAYSRLIDYARFKEISQGCGAYLMSDMAHISGLVAANVVPSPFEHSDIVTTTTHKSLRGPRGAMIFFRKGIKSVTKKGKEIPYELEKKINFSVFPGHQGGPHNHTIGAMAVALKQAMSPEFKEYQQKIVDNSKWFAQELTKMGYKLVSGGTDNHLIVIDLSGTQVDGARVETILSALNIAANKNTIPGDKSALFPSGLRIGTPAMTTRGFGREEFSQVAKYIDSAVKLAENLKTLEPTTKLDARSRLNEFKKLCNESSEVAALSGEISKWVGQYPVPGDI

SEQ ID NO: 12592 - protein, 246 aa, Burkholderia pseudomallei
MAITMRQMLEAGVHFGHQTRFWNPKMAPFIFGHRNKIHIINLEKTLPMYNDALKYVRQLAANRGTILFVGTKRQSRDTIAQEALRAGMPYVNARWLGGMLTNFKTLKVSIKRLKDMEAAVEAGELEKMSKKEALLFEREIAKLQKSIGGVKDMGGIPDAIFVVDVGYHKIAVTEANKLGVPVIAVVDTNHSPEGVDYVIPGNDDSSKAVALYAQGVADAILEGRANAVNEVVQAVRGDDEYVEENA

SEQ ID NO: 12593 - protein, 276 aa, Salmonella enterica
IPATAISFIAVTICVIGSNYLLFDASELADPAFNASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGGELKNMGRLSRKEWTLIGLVLLSLGLWVFGGKIINATAVGLLAVSLMLALHVVP

SEQ ID NO: 12594 - protein, 237 aa, Pinus tabuliformis
MAREGEKGQVKLLGATLSPFVVRVRIALALKGIDYEFIQEDLETKSELLLQSNPVYKQIPVLVHNGKPVCESMIIVQYIEEAWDNKAPNLMPKDPYDRAIARFWAAFIDDKLFPSTRAVFTGQGEQLQKAVEDSVTNFLLIEEALRTNRCFAGKAYFGGDEIGLIDIALGGMSTFIKALEKATNTILIDPKKMPLLTAWMDRFCKSDGVKEVMPDPVKHAEYLCARRASMISPPTGN

SEQ ID NO: 12595 - protein, 208 aa, Prochlorococcus marinus
MSLQRTGEVHRVTKETNVTVRLGLDGKGKCKISTGVAFLDHMLQQLSSHGLFDLEVIAKGDTHIDDHHTNEDVGIAIGQALSESLGERQGINRFGHFSAPLDEALVQVVLDCSGRPHLSYGLNIPSQRIGSYETELVKEFFIAVVNNSGLTLHIRQLDGTNSHHIVEACFKAFARALRLATELDPRRGDAIPSSKGVLEQAGSKPKQI

SEQ ID NO: 12596 - protein, 118 aa, Unknown
  Erythrobacter sp. NAP1
MKGEDPLSGEAIMATVNVTDESFKSDVLESDKPVLVDFWADWCGPCKMIAPALEEISNELGEQVTIAKMDIMENTGIPAEMGVQSIPLMVLFKNGEAVARKVGAAPKSQLKDWLESEI

SEQ ID NO: 12597 - protein, 624 aa, Cornus cf.
MASSGEQNQVGLLENLKNQLAIAVRSIQWSYAIFWSISSRQPGVLEWGDGYYNGDIKTRKTVQAVEFNADQLGLQRSEQLKELYESLAVTESNPQARKPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSCASENTRTEKDLILVKPSHNLLDTDLDAALECGEIDMCAPNNNSSGFLPNQRTEKSVMVEGLSGGASQVQSWQFMDDEISNCVQNSTNSSESISRTSENPEKDCCLIDLPECNLTKLTSLDLPNDDIHHHSVVSSLLKNSHQLILGPYFHKCNRGSSFMGWKKTPSGIQQRRRGTPQELLKKVLFEVARMHGGCLVESRQDNSRKDGLWRSEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSIRIIDKDVFIEIRCPWRERLLLEIMDAISNFHLDSHSVQSSNIDGILSLSIKSKFKGSTVASTGMIIQALQRIICKC

SEQ ID NO: 12598 - protein, 495 aa, Prochlorococcus marinus
MSENAFPTTKTKASENFERSDWSSAYSNVDKEFSNFELKAAKGAIPKDLFGTLYRNGPGRLERNGQWVHHPFDGDGMITSLRFEEGKANLTNRFVRTKAWQEEEKAGKFIYRGVFGTQKAGGALSNAFDLRLKNIANTNVVLLGNELLALWEAASPYSLDPRSLDTHGISNLNGVLNPGEAFSAHPRFDPGHNNQSRMVTFGVNTGPKSTIRLMEFSTQGDDAGVLISNRKDTFNGFAFLHDFAITPNWAVFLQNAIDFNPLPFIFGQKGAAQCLSSSKNNKGRFLLIPRDSGCYALEPPRIFEAPDGFVFHHLNAWEENSEVVIESIFYNDFPSIQPNENFLEINFDEIPEGILKKCRINLLNKNVTTEVLSNQCCEFAMVNPRMLGMKARYSWMATAQKEHGNGPLQNIKKFDLFNSQKHIWSAAPRGFVSEPIMVPTSSSNEDDGWVLTVVWNGERLASDLVILNANDLSEQAILELPLAIPHGLHGSWVEG

SEQ ID NO: 12599 - protein, 438 aa, Oryza sativa
MAPKAEKKPAAKKPAEEEPAAEKAPAAGKKPKAEKRLPAGKGEKGGAGEGKKAGRKKGKKSVETYKIYIFKVLKQVHPDIGISSKAMSIMNSFINDIFEKLAAEAAKLARYNKKPTITSREIQTSVRLVLPGELAKHAVSEGTKAVTKHIILHISQKFLNKMNGQRCVKKSTVSNISKRREYVLGSCSELASYFTAPWRMVDGVEERGCGPEFFRMVARFLEMSGMKINYQKSEVFGVGLEDGDLQQFADILNCERGNMPIVYLGLPISTEKIGNKDLFFLGQKMEKRLGTWIGGYVSYGGKEILINSCLSSIPLYAMGFYKLPEGVHKKMDSVRGRFYWQGIQKKKKKYHMLSWGAMSRPKDYGGLGFFGNKENECEFTGKVDFQKWSLLQIEEMKGVLKAWIEDMRGRMRSWKPDIQLPEDLLNVSLMTRVFYVTC

SEQ ID NO: 12600 - protein, 343 aa, Kineococcus radiotolerans
MRVGILTGGGDCPGLNAVIRAAVLAGTQRHGMEFVGFLDGWRGVLEGDTVPLDEAAVRPLLTTGGTILGSSRTNPLADGVEEGVARVRERLGALGVDALLVIGGEDTLGVATALHAAGVPVVGAPKTIDDDLSATDATFGFDTAVQTAVDACDRLATTGASHHRVMIVEVMGRHAGWIALHTGMAAGAHVTLLPEEAVDLDAVAGTVRAVLARGGAPLVVVSEGADVHGGPAGEDAPRDAFGHVRLRGAGEALEQELLARVPGVSTRVTVLGHLLRGGTPSAADRILATRFGLSAVEALASGDLGTMASLHGVEVSQVPLSEATGVLRTVPGARRAETAGIRW

SEQ ID NO: 12601 - protein, 624 aa, Cornus suecica
MASSGEQNQVGLLENLKNQLAIAVRSIQWSYAIFWSISSRQPGVLEWGDGYYNGDIKTRKTVQAVEFNADQLGLQRSEQLKELYESLVVTESNPQARRPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILVKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHYHSVVSSLLKNSHQLILGPYFHKCNRESSFMGWKKTPSGIQQRTRGTPQKLLKKVLFEVARMHGGCLVESRQDNSRKDGLWRSEDDEIGTTDLFSERRRRDKTKERYSVLGSLIPSTSKDDKISILDGTIEYLKELERRLEDSECLEARTRSKPQDTAERTSDNYENDRIGIGKKPLINKRKACDIVEAELEINLVQLKDSSTDDVSIRIIDKDVFIEIRCPWRERLLLEIMDAISNFHLDSHSVQSSNIDGILSLSIKSKFKGSTVASTGMIIQALQRIICKC

SEQ ID NO: 12602 - protein, 271 aa, Kineococcus radiotolerans
MPGFPVLYWPIKLLVAEPLVTAVFRPWVRGLEHVPSSGPAILASNHLSAADTVLLPTVVQRRVTFIAKADLFTGRGLRGKLTKGLMHGIGQLPVDRSGGRASTAAIDSAVRVLGEGELLGIYPEGTRSPDGRLYRGRTGVARIALASGAPVVPVAMIGTEDLLPTGRKLPRVRRVGAVFGPPLDFSRYAGRGDDQLVARSITDEVMYAIQKLSRQEYVDAYAERSRLRTELSRSTGVPEPPTTSSGGPGGRAAPPGEAPGPDAPRDGDAHR

SEQ ID NO: 12603 - protein, 385 aa, Gossypium hirsutum
MVHCLPKVSVIQDKPMLPPTAAVAKNKHRPLAFDASILGSEISSQFIWPDDDKPCLDAPELVIPTIDLGAFLLGDSLAVSKAAEAVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFDENDSILRLNHYPPCQKPELTLGTGPHTDPTSLTILHQDQVGGLQVFADEKWHSVAPIPRAFVVNIGDTFMALTNGIYKSCLHRAVVNTETVRKSLVFFLCPKLERPVTPAAGLVNAANSRKYPDFTWAALLEFTQNHYRADMKTLVAFSKWVQEQESNNKLIP

SEQ ID NO: 12604 - protein, 481 aa, Fulvimarina pelagi
MGPLAVLPVFFELKNKRVVMTGGGPGAAWKAELLAATGAFVDIYIPAAEVSDEMADFIGSKAADEKIRHLDRPWSVDIFAGAAVAVGDVESEAEAQAFRCAAKAAGVPVNLVDKPAYCDFTFGSIVNRSPLVVGISTAGAAPILGQAARRRIETLLPPSLQEWAEAAARLRDRVILRLAPGAERRSFWERFSDAAFKTTPPQDEAELDESIRTIAASSSKVGMVTLVGAGPGEAELLTLKAVRALQAADVILFDDLVSSDILELARREAKRMLVGKRAARESCKQEDINRMMVEFAEAGKSVVRLKSGDVSIFGRAGEELAELKRRKIPYAIVPGITAASALASTFGISLTHRDHAQQLRFVTGHSKKGGLPDDVDWTALAGPRATTIFYMGGRMSQKIADRLMQEGLPAETPVAVAANLSRDDETRAVGRIDRLGEIVERIGVDRPILIGVGNVFSEVAANSIDVDHPETAALERRSAAG

SEQ ID NO: 12605 - protein, 178 aa, Porphyromonas gingivalis
MRTIKLKDKEFEIYIPATRIHEAIKRMAAEIKRDLHEDNPLFVCIMNGSFMFAAELMQALDESYQVDFARYSSYCGMQSTFVLKEIMPVTADMRGRTVVIVEDLIDSGYTMSCVKENFYELGAKEVRIAAMLTKPAALKCDIHTDYVGLEIGNDFIVGHGLDYDDLGRMYQDIYKIKE

SEQ ID NO: 12606 - protein, 588 aa, Daucus carota
MATYATWAKPKILTSCPQREVKSQKAYRKNNVNCSLQSPSILHFPKQSPHIYQTPCVPTTIAQPKHQDSSSSNQWNFLQKAASMALDAVENVIAAREKEHPLPKTADPQVQIAGNFAPVPEQPVRHRLPVTGKIPECISGVYVRNGANPHLEPTAGHHFFDGDGMVHAVQFKEGAASYACRFTETERLIQERNLGKPVFPKAIGELHGHSGIARLALFYARGLFGLVDHSQGTGVANAGLVYFNNRLLAMSEDDLPYHVEITSSGDLKTVGRYNFDGQLDTTMIAHPKIDPDTKELIALSYNVIQKPYLKYFRVSPDGVKSDDVDIELADPTMMHDFAITENFVVIPDQQVVFKISEMIQGGSPVVYDKNKVSRFGVLDKYAKDGSGIKWVEVPDCFCFHLWNAWEDEESDEIVVIGSCMTPADSIFNECDEGLQSVLSEIRLNLKTGKSTRKPIMSSEDQVNLEAGMVNKNKLGRKTQFAYLAIAEPWPKVSGFAKVDLFTGQVQKFFYGDHKYGGEPLFLPKNPNSENEDDGYILAFVHDEKAWKSELQIVNAMTLELEATVQLPSRVPYGFHGTFISAKDLESQA

SEQ ID NO: 12607 - protein, 524 aa, Solibacter usitatus
MKILLYNPDNGVTQNFMPHLWMFLLQSLTPSQHEVLLIDGNTQPMTDPELVQYALDQKIGLVGIGAMTRMIAKAYRVADALRAAGIKVVMGGPHVTECPDEALGRDGGGRHADAIALGEADETWPRIVADAAKGELREVYKPVDAFGQEQKPSLKDYPQIPWQKLDIDQFNRIPGFFKRIMRHYGHAWETFHIIPIESGRGCPYGCEFCTVTGFFGDSIRFRTNESIVTEMLALKERAKASSGKIAVFFVDDNFAINVKRTKSLLRDIIAAGAQLSWVGQISANLLRDEELLDLIAESGGKWIFIGMESLDVANLASVNKSFNKPSEYAGVLQKLAQRNVYAITSFIFGLDNDTPGVASRTLEQIRDWPPVLPVFGQITPFPATPLYDRLAKEGRLTRPKHWLEFAPFRMAHTPLKLSIPEVQDEVQYAWTNSYSPEATKLALDSIADEPVPYKISHFVARIFFRGIYFPPKGMWQWLKLIGQNRASVFRIVRESFTQWHGTDGVARHSDFNRGPRYAPVANEE

SEQ ID NO: 12608 - protein, 337 aa, Fulvimarina pelagi
MLEKFERYPLTFGPTPIEHLPRLTEALGGKVEIYAKREDCNSGLAMGGNKLRKLEYIVPDALASGADTLVSIGGVQSNHTRMVAATAAKLGLKCVVIQEKWVPHHDAVYDRVGNILMTRLMGADSRLVDDGFDIGIRKSWEDAIRSVEEAGGKPYPIPAGASVHKFGALGYVGFAEEVAAQEAELGFKFDYVVVCVVTGSTQGGMIVGFAAQDRADRVIGIDASGTLDQTRSQVRSIVDNTAVLVGLGRSVREDEIVINPDYAYPAYGVPSEETNDAIRLAARTEAMMTDPVYEGKSMQGMIDLTKKGFFPEGSKVLYAHLGGAPALNGYSYYYKDG

SEQ ID NO: 12609 - protein, 530 aa, Oryza sativa
MNWLLASQPAACCQSLILILSLSPKMLPGKSFASNEYVWLSNAQSADRKLFHRALIAKPYRLSITHFCLFLIMYDDNGAADLPTSQSASIKTIVCVPFIMHGVLELGTTDPVSEDPALVDRITASLWDTPPRAAFSSEAGVADIVVFEDLDHGNAAVEATTTMVPGEPEPHAVAGGEVAECESNAHNDLEQITMDDIGELYSLCEELDVLDDDSSSWVADPWSSFQLVPTAEATDVDDAVVAALGAIDGSCRPSPSSFVAWKRTPDSDEVQAVPLISGEPPQKLLKKAVAGAGAWMNNADGSAATMTTDQGSSIKNHVMSERRRREKLKEMFLILKSVVPSIHKVDKASILAETIAYLKELEKRVEELESSSQPSPRPMETTRRRCCKSTGKKVSAGARAKRKAPAPEDTDGERRHCVSNVNVTIMDNKELLLELQCQWKELLMTRVFDAIKGVSLDVLSVQASTSDGLLGLKIQAKVVVSAAKSSQQICSIVYLSIYQSLYLRLFGVLILAILLLHACSLPHLLPSNLG

SEQ ID NO: 12610 - protein, 436 aa, Prochlorococcus marinus
MANIFEVPQPGNDLLEKADQVRLASIKISQTENHNRIKALNSMADCLEKSTKEILEANNEDYTRAQKKGISKALLSRLKLSKEKLNSGIEGVRKVGDLADPVNQVQIKRELAKGLILERKTVPIGVLGVIFESRPDAVMQISSLAIRSGNGVMLKGGSEANLTNTAIVKALKKGLYESGLDKNAICLLTSRKDSMSMLNLEKYINLIIPRGSNELVKFIQENTRIPVLGHADGICHLFIDNEANLEMALSVALDSKIQYPAACNAIETLLVHKDIAQVFLEKAIPLFNSNDVKLIGDKRTVELGVKYEASVEDWQTEYLDLILSIKIVDDLEEAINHIQKFSSKHTDGIITENSTSAKKFMNVVDSAGVFHNCSTRFADGFRYGFGAEIGISTQTLPPRGPVGLEGLVTYKYFLNGDGNIVDDFSSGKAIYTHKDL

SEQ ID NO: 12611 - protein, 498 aa, Solanum tuberosum
MKKVTVGAAVVGAAAVCAVAALIVNHRMRKSSKWGRAMAILREFEEKCKTQDAKLKQVADAMTVEMHAGLASEGGQSSRCLSPMSIISQLVMKLGVFYALDLGGTNFRVLRVQLGGKDGGIIHQEFAEASIPPSLMVGTSDALFDYIAAELAKFVAAEEEKFHQPPGKQRELGFHLLIPSNADFNNSGTIMRWTKGFSIDDAVGQDVVGELTKAMKEKVLDMRVSALVNDTVGTLAGGKYTQKDVAVAVILGTGTNAAYVERVQAIPKWHGPVPKSGEMVINMEWGNFRSSHLPLTEYDHALDNESLNPAEQIFEKMTSGMYLGEILRRVLTRVAEEVLAFLAMRSLQSLKDSFVLRTPDMSAMHHDTSPDLKVVGEKLKDILEISNTSLKTRKLVLSLCNIVATRGARLDAAGVLGILKKMGRDTPKQGGSERTVIAMDGGLYEHYTEYRMCLENSLKDLLGEELATSIVFVHSNDGSGIGAALLRASHSMYLEDQA

SEQ ID NO: 12612 - protein, 159 aa, Prochlorococcus marinus
MLINVKETVVETADGEKKNLGDYLGNVLLIVNVASLCGNTPQYKGLEKLFEKYKKNGFCVLAFPCNDFAGQEPGTIEEIKEFCSVKYGTTFEIFNKVHAKGLTTEPYTTLNKVEPKGDVSWNFEKFLVGKDGNVIARFEPSVEPSSEELITAIEVALSS

SEQ ID NO: 12613 - protein, 130 aa, Triticum aestivum
MAKSVFRDCPYPDEKLRKDLSERLGMSAQQVKFWFQNKRTFSKGKMQRWETQNHWVENERLKTEHQAIMLAMQNKTCLKCRGVMVQTQDTSERQCLYTENMRLKEELLHATTYLKEGLRRNGMSLPRARN

SEQ ID NO: 12614 - protein, 752 aa, Unknown
  Shewanella sp. MR-7
MTNPVPVNADGSTAYNLSAGQPFPLGATVDDGGVNFALFSAHATGVELCLFDAQGEVEIQRIALTEQTQQIWHLYVHGLSAGQLYGYRVYGPYEPQLGHRFNPHKLLLDPYARQLVGRYHHHIANFGYEIDNPNEDLSFSTLDNADFVPKCKVVDTRPLFDAAKAHAIRPLSSKREPLPLEQCIIYEMHLKGFTALHPEIDAPLRGTFSGLASNAAIDYLVNLGVNCVELLPVQAFFSEPFLLEKQLSNYWGYNSIGFFAPEPSYLSSEDIGEFRTMVDALHGAGIEVILDVVYNHSAEGSRLGPTFSFRGIDNLSYYRLHPNDKRFYINDTGCGNTLNLNHPRMLQLVLDSLRYWVEVMGVDGFRFDLAACLGREAYGFDPGSGFFDALLQDPVLCRVKLIAEPWDIGPGGYQLGNFPVAFSEWNDRYRDTMRRFWRGDHGMLPEFARRFHGSGDFFEHSGRPPAASINFLTSHDGFTLKDLVSYCERHNWANGEENRDGHHENFSHHYGVEGDTDDATILALRARQQRNLLTTLFLSQGVPMLLSGDETGRTQGGNNNAYCQDNPLNWFDWSSDGMDSSLLSFTSQLIALRKRFPLLCSKRFIHEQLVANAFDWSSESSSSHAASPVLTPTGARLDWFSRQGEPMSKSLWSESMGRSLCVVLSGNLTATQPQTQGDNLQALLLMVNADEHPLAFTLPVFDGLGPWQCLLHTQTDPQFLTPTEPLDAQSSPTRYLLQDRSLMLFHADFIRN

SEQ ID NO: 12615 - protein, 373 aa, Streptomyces hygroscopicus
MDGVRAVLLAGGEGRRMGPLGRGRLKPLVPFGGTSRLIDFSIANVHRSGLRDVLLLSQYEERRLMDDLHLVWNGRHRGFRIDFGPYDAVYRRSPGKLPEQLPERIWPLERGTADALLTKAEYVFRQGDAEASEILVLHADHVYRFDYGDMIREHRASKAALTVSYQRIERRYVHLFGMVEFDGDGLLTAFEEKPDDPTSDLVFAAFCLFDAATLRRYLEQLRGTDWQHDISRDVIPAMLAGGELIRGYEVKSYWEDIGTVDRYHRAHRGLLRADPTLALSDMPLTVAPEVPRHLVPGGPGRRASVVAADVANEGEIVSSVVYPGARIGVDAHVVDCVVLPGARVPDGTHLASAIVLEDGSVQQCEAEREEVAL

SEQ ID NO: 12616 - protein, 222 aa, Solibacter usitatus
MKLSMRTGAVALSGAIACFLTLRALTAGEIPPPFADVPAPTTNQLATAVFAGGCFWGVEGVYEHVKGVKAAVSGYAGGPASMAHYDLVSNGDTGHAESVKVTYDPAQISYGKLLQIFFAVAHDPTELNRQGPDWGTQYRSAIFYSSEEEQRVATAYIEQLNAAKAFSKPIVTQVAPLKAFYPAEDYHQHFLERNPTHPYIVYNDLPKIAQLKRRFPELVTKK

SEQ ID NO: 12617 - protein, 716 aa, Synechococcus elongatus
MPQLSKSLSFDGRDIRLELGLFAPQAGGSVLISSGDTAVLVAATRSTAREGIDFLPLTVDYEERMYAAGRIPGGFLRREGRPPERATLTSRLIDRPLRPLFPSWLRDDLQVVATTLSMDETVPPDVLAVTGASIATLVAKIPFYGPMAAVRVGLVGDDFIINPTYREIEKGDLDLVVAGTPAGVIMVEAGANQLPEADVIEAIDFGYEAVQELIKAQQSLLAELGIEQILPEAPNADNTLENFVRDRASSGVQQVLQHFSFTKSERDAALDEVKASVVEAIAALPEEDPVRSVTAAEPKALGNTFKALTKTLMRQQILRDGVRVDGRKLDQVRPISSQVGLLPPRVHGSGLFQRGLTQVLSIATLGTPGDAQELDDLHPDTQKRYLHHYNMPPYSVGETRPMRSPGRREIGHGALAERALLPVLPSKEEFPYVIRVVSEVLSSNGSTSMGSVCGSTLALMDAGVPIKKPVSGAAMGLIREGDEYRVLTDIQGIEDFLGDMDFKVAGTDQGITALQMDMKIHGLPLEIIADAINQAKPARLHILNKMLEAIATPRADLSTYAPRLFRIQINPEQIGLVIGPGGKTIRSITEQTGAKIDIEDTGAVTISAVDADSALRAKSIIEGMTRTITAGDVYIGKVTRIIPIGAFVEFLPGKEGMIHISQIADYRVARVEDELTVGDEVVVKVREIDQKGRVNLTRKGIDPEEVSAARAAVEAS

SEQ ID NO: 12618 - protein, 267 aa, Prochlorococcus marinus
MPGIVYLVGAGPGDPELLTLKALRLIKNCDALVHDALIPDEITKEAGKNTEIYHVGKRAGKCSVPQIETNALILKLSKEGKNVVRLKGGDPFVFSRGGEEVSFLEKNGVSVEIVPGITSGIAAPTYFGIPLTHRDAASSVTFVTGHEHVDKDKKSVNWRDLAKSSDSLVIFMGIKNIEFIVEELILGGLCKNTKCAVIQEATLKNQKCFIEKLDNLVDKIKDKEFLAPSIIIIGKIVEYKVNNNITKVSDVYLPDINKVQLYNKSQK

SEQ ID NO: 12619 - protein, 443 aa, Triticum aestivum
MAERIAASLLPAASPSPAPSPPPPRPRVSAAAAASFPCCSTSAGGLRLRSRPSRFPQKAATTRSGRAGAPRLRVVRCMAASEAAQLKSAREDIKEILKTTYCHPILVRLGWHDSGTYDKNIEEWPQRGGADGSLRFDPELSHGANAGLTNALKLIQPIKDKYPGITYADLFQLASATAIEEAGGPKLPMKYGRVDIAAPEQCPPEGRLPDAGPRIPAEHLREVFYRMGLDDKEIVALSGAHTLGRSRPDRSGWGKPETKYTKDGPGEPGGQSWTAEWLKFDNSYFKDIKEQRDQELLVLPTDAALFDDPSFKVYAEKYAEDQGAFFKDYAEAHAKLSNLGAKFDPPEGFSLDEDKGAVATEEKVVADPAPTSDTNGAGPQPEPFVAAKYSYKKRELSDTMKQKIRAECEGLGGSPNKPMKSNYFLNIMIVIAGLAFLTSLTGN

SEQ ID NO: 12620 - protein, 230 aa, Triticum aestivum
  misc_feature (196)..(196): Xaa can be any naturally occurring amino acid
  misc_feature (203)..(203): Xaa can be any naturally occurring amino acid
ARGFCGGVTASTTHQWTTLSGSGAEDVRVMTRKSVDDPGRPPGIILNAATSFWLPVPPSRVFGFLRDDSTRSEWDILSNGGVVQEMAHIANGSHHGNAVSLLRVNNANSNQSNMLILQECCTDATGSYVVYAPVDVVAMNVVLNGGDPDYVALLPSGFAILPDGPAGAPDAGGSLLTVAFQILVDSVPTAKLSLGXSVATVNXSLIACNVDRIKGAVVVNPGDNTGAAAR

SEQ ID NO: 12621 - protein, 437 aa, Haemophilus influenzae
MEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 12622 - protein, 485 aa, Unknown
  marine gamma proteobacterium HTCC2080
MNQPIKDPDAPFGHKYGPFVTDVFAPLTEEETYADLPVIGEIPADLNGVYLRNSPNPRFEPKGEYHPFDGDGMLHSAHFENGRLVLRNKWVRTDAWQHEDTTQGAEYWGIRQTLKGREDQPIKDSANTDVIGHAGAALTTWYLAGVPYAVDPITLETLGPRYNYLDKPDSGMSAHCKVDEVTGELMYFDYGDHWPYMWYGVADAQGEITHRVPIELPGNRLPHDMAITEHYSILHDHPVFHDEEARAAGRHKIVFDSTMASRLGVIPRKGDAASIRWFEFSGAFIYHVINAWEEGDEVIMVACRYQPAKNADGSFNDVGTAKMISRLVMDARLWRYRMNLKTGECSEACLDPDFNVEFPSYDSRLTGRKSEFAYLVDHDPKILRWRGICKYNTDTGERLGAWSDDLDHCWYSEPWFAPADHQKAEDHGYVVAFAYNDETRNQELQVFDAQDLSQGPVARIKMPTRIPPGFHACWMKPEQIQSRVG

SEQ ID NO: 12623 - protein, 550 aa, Methanosarcina acetivorans
MPETVIQYLLNRLKQLGIRDIFGVPGDYAFPINNAICDDKELRWIGCCNELNAAYAADGYARINGMSALSTTFGVGELSALCGIAGSYAEHNLVFHIVGMPATPVQERNALVHHTFGNGEFDQFMTMATPAVCAKTMLTPGNCIQEVERVIAAALGYRRPVYIAIPHDYVHENISHVHEKILSSQAPANVPVKSDPEVLEEAVSTIINRLSGAEKACIIPGIFVDRFGLKDLTTEVVNASGLPYVTMPMDKSVIDETNPSYLGLYMGQLVNPEIREFVESCDCVLTIGTILFDVNTGMFTAKLDRDRIISIVPYDVHIGYAGYTNLKMSDVLEELARRLRKRTDIRGPAARQPATPEVDAGSPITADYLYASCTKFFKPDDIIIADSGTSFYGLLPVFLPEGARLHSQTLWGAIGWATPASFGAALAAPDRRVILITGEGAHQMTAQEVSQFYRYGLKPIIFVLNNHGYLIERMLSRKLDYCYNDLAQWQYHKLPEALGCSGWVIRKATTCGDLDKIMAELDNAGTGAYVEITTPEMSAPPIMETVHSNL

SEQ ID NO: 12624 - protein, 329 aa, Onion yellows
MKITIIGSGAWGSTLAQVLTDNNNQVLLYDINLSYVEKINQGKHPIFNAPLVNVKAVSCLKQALDYSDLIVLSVPMKFMRHLLKQIALMLTTPKSFVNVSKGIEPLTFLRVSEIVKQVIPAPLLANFASLMGPSHAEEVILRKLTLLTAASSNPAFALEIQKLFSCPNYLKVYTSSDLVGNEICSAFKNVLAFINGILVAKNFGINSQAALMSRGILEMSVLVTFYQGNPQTVLGLPGLGDLIVTAFSKYSRNFNAGAKIAAGITYQQIIDSSLQTIEGFQTLNAFYQLQLKHNLDLPIIQASYQLIFESKPFETVFATLMQRPFKSEF

SEQ ID NO: 12625 - protein, 521 aa, Nicotiana tabacum
MESGSMEMKVQQPYLAVPVLPPRWKIVMVASIAAGVQFGWALQLSLLTPYLQLLGIPHRYASIIWLCGPISGMIVQPAVGYLSDNLSSTFGRRRPFIAAGSSLVAVAVIFIGFAADIGHAFGDPLDTKTKPLGIITFIVGFWYLDVANNMLQGPCRAFLADLSGGKACRIRTGQSCYAFFMAVGSILGNAAGSYSHLYTIFPFTKTEACGVQCANLKSCFLISVVLLLTLTTLALTAVDEKVLPQKDHFINSEYLGSSGKKGGLLFFGEMFEALKHLPRSVWILLMVTAVNWIAWFPFTLYGTDWMGKEVYGGRVRDGNLYNKGVHAGVFGLLLSSVVLCLMSLGVECVGKWLGGAKRLWGIVNFILAICLAMTVFVTKMADKSRRYDGDGELLPPDQGVKISALLLNAVTGIPLAVLYSIPFAMASIYSSNVGAGQGLSQGVINLAIVVPQTLVSISGRPFDALFGGGNLPAFVAGAVAAAVSGILALTLLPSPTEPCQTYPHFRRCFPMTKYWTSQNKF

SEQ ID NO: 12626 - protein, 112 aa, Psychrobacter arcticus
MKLITAILKPFKLDDVREALSDIGVKGVTVTEVKGFGRQKGHTELYRGAEYVVDFLPKVKVEVAVIDEMVEPAIEAITRIASTGKIGDGKIFVTNLEQVIRIRTGETGPDAI

SEQ ID NO: 12627 - protein, 98 aa, Glycine max
MMGILRLPFMVHANAKQTSSSSFKSNVPKGHVAVYVVGELQKNKRFVVPISYLNHPLFLDLLNRAEEEFGFNHPLGGLTIPCKEDAFINLTSQLVKTI

SEQ ID NO: 12628 - protein, 314 aa, Pyrus pyrifolia
MATFPVVDLSLVNGEERVATLEKINDACENWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSIASFYNPGDDAFISPAPAVLEKKTEDAPTYPKFVFDDYMKLYSGLKFQAKEPRFEAMKAKESTPVATT

SEQ ID NO: 12629 - protein, 414 aa, Staphylococcus aureus
MTENNNLVTSTQGIIKEALHKLGFDEGMYDLIKEPLRMLQVRIPVRMDDGTVKTFTGYRAQHNDAVGPTKGGVRFHPDVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSHGRDRSTALGVVIAIEQAAKRRNMQIEGAKVVIQGFGNAGSFLAKFLYDLGAKIVGISDAYGALHDPNGLDIDYLLDRRDSFGTVTNLFEETISNKELFELDCDILVPAAISNQITEDNAHDIKASIVVEAANGPTTPEATRILTERGILLVPDVLASAGGVTVSYFEWVQNNQGYYWSEEEVNEKLREKLEAAFDTIYELSQNRKIDMRLAAYIIGIKRTAEAARYRGWA

SEQ ID NO: 12630 - protein, 463 aa, Yersinia pestis
MADNAEKKGLHRGLEARHIELIALGGTIGVGLFMGSASTLKWAGPSVLLAYIIAGLFVFFIMRAMGEMLYLEPVAGSFAVYAHKYLSPYFGYLTAWGYWFMWIAVGISEITAIGVYVQFWFPEIPQWLPAIAGVAIVALANLAAVKLYGELEFWFAMIKVTTIIVMILVGLGVIFFGFGNHGQPIGFDNLTAHGGFFAGGWKGFLFALCIVVASYQGVELVGITAGEARNPQVTLRRAINNILWRILIFYVGAIFVIVTIFPWNGIGTEGSPFVLTFAKIGIVAAAGIINFVILTAALSGCNSGMYSGGRMLYALAKNRQLPAGLTKLSASGVPVYCIAITILCLLVGSSLNYIIPNPQQVFVYVYSASVLPGMVPWFVVLVCQLRFRQVHKAALQQHPFKSILFPYVNYLTIAFLICVLVGMGINPDTRLSLLVGAIFLALVTGCYFVLGMHKPKAMEAERL

SEQ ID NO: 12631 - protein, 186 aa, Unknown
  Acinetobacter sp. ADP1
MKTFSCFRFLHMTIEMSVMISTEEIQAKVKQLGEQINAHYANSHKDLVLIGLLRSSFIFMADLCRAIAKPHELDFMTVSSYGAGTVSSRDVKILKDLDGEIRGKDVLVVEDIIDSGNTLSKVLEILQTRGPNSIELCTLVSKPSRREIELEVKFLGFEVEDRFIVGYGLDYNQKYRHLPFIGEIGL

SEQ ID NO: 12632 - protein, 306 aa, Triticum aestivum
MASEGEHAAAAGEQTPLKKAGEAEQGEELQAPSGWTKKLNPTRGGKFEVAFVAPTGEEVKTKRALTTYLKAHPGGPALSEFVWATGNTPRRSSRLSAKPKATESPEDEKPSRRSGKSKATESPEDEKPAKRGRPSSSKKGKKGKQEDAEDAEAESGDHADAEEAKGTEVEMKDAEEAKVTDLDLEMKEADNAQEEKKEEEAGGSVGEKKEADTVAQEEKKEADTVAQEEKKEADPVAQEEKKEADTLAQEEKKEADTVAEEEKEEADTVAQEEMKDAPVADAPEKAEEVEGEPPESEVPPGGDRDA

SEQ ID NO: 12633 - protein, 531 aa, Streptomyces coelicolor
MSDHDKTPRNPSARTWTRLGPGALSGLLAGGAALAVAELAAAVRPRSGPVVAVGGAAIDRTPTAVKDWAIRTFGTNDKLVLQLGILAVLTLFALALGAFAVRHRRAGAAGVLVFGIVGAAAALGRPDSTGVTDAFPSVLGAIAGAVLLYLLAGLLPAPRREAPGERGEGWDRRRFVIAATAAAAASAGTGVLGRALSGAGGREAVASRENITLPPPDSRAPAVPRQAQARVEGVSSFTTPTSDFYRVDTALVVPKVDATAWRLRIHGEGVARERTLTFDDLLRRKLIERDITLTCVSNEVGGPYVGNARWIGVRLADLLAECGVRPPSAGGPADQLVARSVDGMTIGSPVEDVMDGRDAMLAVGMNGEPLPFDHGFPVRMVVPGLYGYVSACKWIEDIELTTFDSYDAYWVKRDWAREAPVKTQSRIDTPRPFARPKAGTVMVAGVAWAQHRGIDKVEVRVDDGPWEEAVLAAEDSRDTWRQWSYAWRATKGGHTLTVRATDRTGEVQTDKRTRTVPDGASGRHSVVVTVD

SEQ ID NO: 12634 - protein, 360 aa, Triticum aestivum
MALASPVDYAGIITSSQRQLSSVMPRCNGLQCTIGYGNKSRATGHLVVRAMSMDRPKLDFSNPNWKNQFQEDFDRRFSLPHLTDIIDVESRPTTFSLKSRTPLENVDGSLEESWNGYVNDDDRALLKVIKFASPTSAGAECIDPDCSWVEQWVHRAGPRKQIYFEPQCVKAGIVTCGGLCPGLNDVIRQIVLTLEKYGVKNIVGIQHGFRGFFEDHLAEVPLNRHVVQNINLAGGGASISDIVDSIQARRLDMLFVLGGNGTHAGADAIHGECRKRKLKVSIIGVPKTIDNDILLMDKTFGFDTAVEAAQRAINSAYIEAHSAFHGIGLVKLMGRSSGFITMHASLSSGQVDICLIPEVP

SEQ ID NO: 12635 - protein, 193 aa, Zea mays
MVSAEVGIDYVLWTEDEVSTRVGEVAAELAADLRALPEPAVIVGVATGAFLFLADLVRRVDVRLVVDLVRVESYGAGTESSGKPRITADLKVDVAGKHVVVVEDIVDTGNTLSYLIAHLEKKGASSISVCTFLDKPARRKVNVHLVGDGKFYRGFECPDYFVVGYGLDYAELYRNLPYVGVLKPEMYKKDSSN

SEQ ID NO: 12636 - protein, 313 aa, Xanthomonas campestris
MELGMVGLGRMGANMAERLVRGGHRVHGFDLGAAARTSAQSKGIQTTDALVTLVSALPSPRVVWLMVPAGKIVDDTLAQLLPLLQAGDIVIDGGNSYYKDSQRRAAQLQSSGIAFVDCGTSGGVWGLQEGYSLMVGGDEAAVTTLHPVLATLAPAPDKGWGRVGPSGAGHFTKMVHNGIEYGMMQAYAEGFALLQHKTDFALDLHQVAEIWRDGSVVRSWLLDLTADALAHNPTMGGIAPYVADSGEGRWTVAEAIDLEVSAPVITLSLMERLRSRDKDSFTDKLLAAMRNQFGGHAVLTTTPTPTPIGSKDA

SEQ ID NO: 12637 - protein, 203 aa, Yarrowia lipolytica
MASHLASIYGTENDKVNCSFYYKIGACRHGEKCSRKHVKPTYSNTVLCSNLYQNPANGESDPLNEDGSKMTKADLDKHFALFYEDIYMEAAKLGRLEEMIVCENGNDHLTGNTYLRFRNQEDAQRACDLFNTRWYAGRPVWCELSPVNDFTESCCRQHDTNECSRGNMCNFMHAKRPPRQLAKDLDASQRKFYNRQRDRKSKR

SEQ ID NO: 12638 - protein, 803 aa, Unknown
  Magnetococcus sp. MC-1
MGASRFVQAINPTGAIPRQPSMRATHPKPKILIVDDKPANLMALRRLLKNTHAELIEAESGNEALGLMLEHELALMLLDVDMPGMDGFEVSRMASGLDRTSNVPIILITAAYKDYSHRIKGYQAGAIDYIEKPIDDRILNAKVAIFLNLYNAHRESEQLRQDLTLNQERLELALEGANEGLWDWNILSNQVYYSPRWITMLGYATNEVNQDFSTWKTLIHPDDFESALACLERHFTTPEEPYRAEFRMRTKQGGWCWILARGKVVARTADGQPHRMVGAHQDISQRKQLEADLLAAKTEAEQANQAKSRFLANMSHEIRTPMNTILGMGEILLNAPNLTPKQHRYLSISQRAGDTLLGLINDILDLSKIEAGELHLEHTLFALHDELKSLITMLRPMARDKGLSMQCVIDPQLPTHVHGDPQRFRQIVLNLLSNALKFTDQGSITLHAKPIETGRLQFTVSDTGIGMPEQVITKIFRPFVQAEANTTRRFGGTGLGLSICRQLVTMMHGEIYANSQVGEGSQFIFEIELPAANSETVKQERLSPPTKQNIPMRLLLVDDMEDNRLLVKAFLEGTPHQIVEAEDGLDALEKSQQSQFDLILMDGMMPKMDGLEATRRIRARESEHNLTPVTIVALTANAMPQDVADSLAAGSDYHMAKPIRRAKLLQLLASIANERRLFSHEEVKQTTTLTSVETIAADILDALANDVGSGYRQSILRFYSTLPARVAQLTAHIGSEADSVLIEAQGLQQDASYFGAHKLAHLCTQIAQMARTKQPREMIASLCPLLQQALQTIERRLTNEGYF

SEQ ID NO: 12639 - protein, 381 aa, Aspergillus nidulans
MKHLLSLVCTLGAATLAASAAAEAGSMPSANGLDFVIDGEASYFAGSNAYWLSFLTNNADVDLALDHFAESGLKILRIWGFSDVTAEPSDNKVYFQLHQNGSSTVNTGPNGLERLDYIISGAEKRGIKLVIPLVNYWDDFGGMNAYISAYGGDKPGWYTNDKIQAAYHAYVKAVVSRYVDSPAIFAWELANEPRCSGCDTSIINQWATKTSSFIKSLDPNHMVAMGDEGMGLPGDSNYPYSYYEGNDFALNLAIPDIDFGTLHLYTTDWGVSNNSWGNKWVQDHAAVCKSAGKPCLFEEYGMKGNHCTYELAWQKTALATPGMAADLFWQFGENLSSGQTHNDKYTVYYGSNEWKCVVSDHVAAVAVRRYRLPVGGGQHGP

SEQ ID NO: 12640 - protein, 293 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETAKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQMVQNRMMIAISTS

SEQ ID NO: 12641 - protein, 112 aa, Solibacter usitatus
MKKIEAIIQPFKMDEVKEALMGIGIEGITISEVRGHGRQKGHKEVYRGQEYNVDLLPKLKMEMVVASDRSDEVIKVLAGAARTGKIGDGKIFIYDVAEAIRIRNGDRGDLAL

SEQ ID NO: 12642 - protein, 237 aa, Unknown
  Frankia sp. EAN1pec
MAYWLIKVLVVGPLLGLLGRPAVTGAEHIPRHGPVILAGNHLAVADSFFLVRLVPRRITFLAKQEYFTGRGMRGRLVRWFFAAAGQVPVDRCGGVAAAGALAVAVRVLDAGGAWGIYPEGTRSPDGRLYRGRTGVARVALATGAPVIPVVMKGTEAVSPRGRRRWRRGRVQIIVGRPLDFSRYRRVLADGPPGCPALTERMVIRSMTDELMRVLADHSGQEYVDAYATDHRGPDPHA

SEQ ID NO: 12643 - protein, 402 aa, Porphyromonas gingivalis
MYQVPQVTDSVYYVGVNDRSKSLFENMWPLPYGVSYNSYLIVDEKVALIDTVDVCYSEIFFKKLDTVLKGRPIDYLIVDHMEPDHSGSIGLLRQRYPNMQIVGNKKTHGMLEGYHHITEGLLEVKEGDKLSLGKNELTFIFAPMVHWPEVMFTYMPTQQVLFSADAFGTFGTLDGHIFDKDMDLSFRWEEMYRYYACIVGKYGSFVQKVLTKFKEANLPVQYICSTHGPVWTPAHFSEAFDLYDRMSRYEAEEGAVILYGTMYGNTEVLADTIAQGIAAGGIRNVVCHNVAFSPASNILRDIFKYKAVIIGSPTYSNEIFSPIKNIMEMIRLREVKDRYLSVFGSFTWAGQAVKKIVPFAEEMGWEMVGEPLEQKMSTTDELYEKGWELGNKIAERLKADRQ

SEQ ID NO: 12644 - protein, 429 aa, Fulvimarina pelagi
MADRTKERGPDSSRRAILKGGFALGGAALTGLAASRTAIAQTSDPKITELQDWNRYLGVGVDAAPYGMPSQFEKDVVRRNVPWLTADATSSVNFTPLHELDGIITPNGLCFERHHGGVAEIPPQDHRLMVHGMVDEPLVFIMEDMKRFPRENRVYFLECAANSGMEWRGAQLNGCQYTHGMVHCVMYTGTPLRNVLNAAGVKTAGKWLLAEGADASAMTRSIPMEKALDDCLVAWKMNGEALRPEQGYPLRLVVPGWEGNMWIKWLRRLEVGDAPWEQREETSKYTDLLANGVARKFTWAMDVKSVITNPSPQAPITHGKGRTVLTGLAWSGNGTISRVDVSLDGGRNWVEARIDGPSFDKAAHRFYYDFDWDGSELLLQSRAVDSEGFVQPTKNDLRAARGENSIYHNNGIQTWLLKSDGGLENVEVS

SEQ ID NO: 12645 - protein, 497 aa, Nicotiana tabacum
MKKATVGAAVIGAATVCAVAALIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVNEEGEKFQQPPGKQRELGFTFSFPVMQTSINSGTIMRWTKGFSIDDAVGQDVVGELAKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEEAGIFGDEVPPKLKSPFVLRTPDMSAMHHDASSDLRVVGDKLKDILEISNTSLKTRRLVIELCNIVATRGARLAAAGVLGILKKMGRDTPRQGGLEKTVVAMDGGLYEHYTEYRMCLENTLKELLGDELATSIVFEHSNDGSGIGAALLAASNSMYLEDKS

SEQ ID NO: 12646 - protein, 498 aa, Spinacia oleracea
MRKAAVGAAVVCTAAVCAAAAVLVRQRMKSSSKWGRVMAILKELDDNCGTPLGKLRQVADAMTVEMHAGLASEGASKLKMLISYVDNLPTGDEHGLFYALDLGGTNFRVLRVKLGGKEKRVVEQEFDEVSIPPELMVGTSEQLFDYIAEALAKFVATESEGLHPEPNKQRELGFTFSFPVKQTSIASGTLIRWTKGFNIEDTVGEDVVAELTKAMLRKGVDMRVTALVNDTVGTLAGGRYYKEDVIAAVILGTGTNAAYVERASAIHKWHGPLPKSGEMVINMEWGNFRSSYLPLTEYDIALDEESLNPGEQIFEKMISGMYLGEIVRRVLYRMADEASLFGDTVPSKLKTPFILRTPDMSAMHHDTSPDLKVVASKLKDVLGIPNSSLKVRKIIVDVCDVIASRGACISAAGILGIIKKLGRDTLKQGENQKSVIALDGGLFEHYAKFRECMEDSLKELLGDEVAETIVIEHSNDGSGIGAALLAASHSQYLEEDES

SEQ ID NO: 12647 - protein, 496 aa, Solanum tuberosum
MKKATVGAVVVGTAAAVAVAALIMRHRMGKSSKWARARAILKEFEEKCATPDGKLKQVADAMTVEMHAGLASEGGSKLKMLISYVDNLPTGDEGGVFYALDLGGTNFRVLRVQLGGKDGGIIHQEFAEASIPPNLMVGTSEALFDYIAAELAKFVAEEGEEFHPPPGRQRELGFTFSFPIMQTSINSGTLIRWTKGFSIDDTVGKDVVAELTKAMQKREIDMRVSALVNDTVGTLAGGRFTNKDVSIAVILGTGTNAAYVERAQAIPKWHGPLPKSGEMVINMEWGNFRSSHLPLTEYDHAMDTNSLNPGEQIFEKICSGMYLGEILRRVLLRMAEEAGIFGEEVPPKLKNSFILRTPEMSAMHHDTSSDLRVVGDKLKDILEISNSSLKTRRLVVELCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 12648 - protein, 373 aa, Medicago truncatula
MCGIIKGSEWMKGKMVGCGSFGSVHLAMNKSTGGLFVVKKAHSEAGRDALENEVNILNTLNSSPSPYIVQCLGTDYDHQDNQLHVFMEYMSGGSLADVSHKFGGSLNEDVVRVYTRQIVHGLYHLHQHGIVHCDLKCKNVLLASSGNVKLADFGCAKRVKKNMNMNKSSSCIIANGGTPLWMAPEVLLMKNNSSINDESRVVDFAAADIWSLGCTVIEMATGRPPWVDDDLISISNPMAAMFKIACGDGIPQFPIHFSQEGFDFLRRCLVRDPKKRSTALELLNHPFLVSTTLTHHKHYSASSPASVLEVHQFEDTYDDDDDDDDSDDNDELISPAGGNHFFITKELLCPQGTTMWQLEDSASGNHWITIRSR

SEQ ID NO: 12649 - protein, 706 aa, Photobacterium profundum
MDNVVPAGEQKSCVTNTNVANRDIFTWIGEASPLGATAKDNGVNFSLYSKDATKVTLHLFHHQHADAPFFSFDLDPILHKRGHYWFMFVGNIGHGQVYAFQVNGPWQPDKGLRFDKDKVLIDPYSHAVCFSQNYSRQRAIDPGSNMDACMKSIVVDHRHFDWQESRTPSHSLTDTVIYEMHVGGFTKHPSSGVTDAKRGTFAGIIEKIPYLKELGITAVELMPVQQFDIHDAPEGRQNYWGYSPITFFSVHAQYSVEQNPIAAIDEFKMLVRELHKADIEVILDVVFNHTAEGDENGPTFCFKGLQSKAYYLTEGDTGKFANYSGCGNTCNANHSVLRRMIIDALHFWVTEMRVDGFRFDLASVLARDGQGHPMKEPPLLWSIDSDPILSGTKIIAEAWDAAGLYQVGSFIGDRWNEWNGKYRDDVRAFWRGDSGSVETFASRILGSPDIYCSHHHSPHRSVNFICAHDGFTLNDLVSYNQKHNYANGEDNRDGDNHNISCNYGVEGPTQIAEIDAIRNRQCKNMLATLFLSLGTPMINMGDEVRRTQQGNNNAYCQDNELSWFDWQLVEQNADLHRFVKQLSLIRRAEPTIDWNMHISLNSVIKSVDINWHGVQPNQPDWSEHSHSLALTVNHPLTNNELYVICNAYWDPLEFTLPNREHSDWHLLINTGQASPFDIYDIDDAPAYNPDSILVLGRSMVVMAAKK

SEQ ID NO: 12650 - protein, 155 aa, Thermotoga maritima
MDKKKRIALIAHDRRKRDLLEWVSFNLGTLSKHELYATGTTGALLQEKLGLKVHRLKSGPLGGDQQIGAMIAEGKIDVLIFFWDPLEPQAHDVDVKALIRIATVYNIPVAITRSTADFLISSPLMNDVYEKIQIDYEEELERRIRKVVEGEEEET

SEQ ID NO: 12651 - protein, 801 aa, Cryptococcus neoformans
MSPPQGKGVPVPNLGLKHESKKKGHVMQSSLELVFSYSRSQQMHYGSRSAPSFLDDSSFRGDQFDVDDYDEDQNYNDIYDGIERTGEEQFEGRDLSGRLEDLKVAGAISEANEDGSTQEELGQDSHITRRSSDEPAFFHSDSVPISPISQLQPSVNQGAKVNTLLPDGIGPIQGLFLAAMPSPRLAPVLPHPGSLDTSYCTEAGPSSNPRTSKRWNSHSRGDSNPMEIRESAALVSSSPQYHGKGKSAENRPLLDGRPTEGYASIQSQKEIRRKSNRRKRSEDGQSTEGQTLFNATAVLVGIGLLSLPLAFAYAGWIGGTIMLLGFGWLTCYTAKLLARLIRADGRMMGYTDIGLRAFGSWAGAGINLLVHFIVSSCNDGILTTGSSVALVLLFGDTLNVLYPSIPSNVWKLVGFFIIVPTVLLPLRLLSLPSLLSSISSFFLIIVLLVDGFLPSPEPSSASTGSLLHPSPTSLSPEWSRGNWLGGIGLILAGFGGHAVMPSLARDMKRPEKFDGIVNWAFAIATGISFTAGAAGYLMFGETVSDEVTKDLMREKYHYPRILNIVALWMIVINPLTKFGLSSRPLNLTIEGILRISPSPPPSLFSPFDGGLESALGSGAPETSQVNFPKRRDRSSFSTRNDPRTSRRPSALTSPSNSRPFPQSQSQIVAFEQYVSKERKKRWLRMVSRVVITALCVGVAVVLPGFGRVMAFLGSFSAFMICIILPLLFYIRLSPTLLPTCPPSPHSLTFPPTARSQPTSKWASEKFTNAIHWVLVIASTALMIAGTIWAFLPGSGHDELET

SEQ ID NO: 12652 - protein, 134 aa, Thermoanaerobacterium thermosaccharolyticum
MVNLNIALIAHDMKKSLMIDFAIAYKDILEKCNIYATGATGQLVEEATGIKVNKFLPGPMGGDQQIGAMIAEDKMDLVIFLRDPLTAQPHEPDILALLRVCDVHSIPLATNLATAEVLIKGLDAGLLEWRNAVK

SEQ ID NO: 12653 - protein, 734 aa, Symbiobacterium thermophilum
MTGGISRRTFLQLSVAATAALGAAGAVAAGDGRSYVSGGFAPGHVEPDTWTYSTCGFCGTGCGIEIGTKDGVPVAIRGTKGYPVNDGLLCAKGIYQWKIITAPDRGKRPLIRKDGKMVPATWDEALTAMTDKLKQLLADYGPESIACYNTGQLCMEEFYTLGKLMRAGFRTPNLDGNTRTCMASAVMGHIRSFGTDGPVGAYADIEAAEVILIAGSNMAECHPILFGRVVKAVEKGARLICVDPRLTQVSRIATINLPIRPGTDVVLLNAMAHVIIREGLIDRAYIDAHTTGYPELEQHLRKYTPQYAAGICGVPAEDIEAAALLYGRAERSLSMWVMGINQSVNGTIANNCFHNLNLIQGKIGKPGCASFSITGQPAAMASREVGGSSSYPGYRAIGNAQHRAEIAALWGVDPATLPDKSPSITEIIDAILEGRIKALWVICTNPLMSLPDQNRVRQALEKLELLVVQDAFETVDTAQYAHIFLPAALWAEKSGIMVNSERRLNLLKPAVKPPGEARTDFEIFLDVADRMGFGHLFPYRTTEECFEEIKRVTRGRPNDYSGATYARIEASKGLQWPIPDERSPGTPRLYADGRFNTPDGRAVLWAVDPIELPEVPDGEYPFNLNSGRVQEHYHTGTKTRKVPELNALVPTAYVELNPRDAEALGVQYGDRVCIESRRGQIEAKVVVTSQVAPGSCFVPMHFGEGPVNRLTVWAVDPFSKEPNYKQQAVRLRRV

SEQ ID NO: 12654 - protein, 207 aa, Unknown
  marine gamma proteobacterium HTCC2143
MAKKGNTSKGWLKEHFDDSYVQRAQREGYRSRACYKLLELNEKDKLIKAGMTVIDLGSAPGGWSQVAAELVGDKGRVIASDILKMDNLAGVDFIQGDFTDQPVFDSIMEMLDGKEVDLVISDMAPNMSGMAAIDQPQSMYLVELALDMARQVLRPGGNFVAKVFQGEGFDQLLQDMRISFNSVQSRKPAASRARSREVYQLGRGFKR

SEQ ID NO: 12655 - protein, 130 aa, Arabidopsis thaliana
  misc_feature (29)..(29): Xaa can be any naturally occurring amino acid
  misc_feature (54)..(54): Xaa can be any naturally occurring amino acid
  misc_feature (68)..(68): Xaa can be any naturally occurring amino acid
  misc_feature (111)..(111): Xaa can be any naturally occurring amino acid
RVQKGSSMHSSATMVASPAHAIMVAHFNXLKSSAAFTSTRIANNNITSIRSNGXRVNCIQVWPPIWKXRTFLTHSYLRDIEESKMDMEFDDLNRLKFIPCVEIYLQHRFLXRDHGKSPRYYHGLYSIMLN

SEQ ID NO: 12656 - protein, 193 aa, Sulfolobus solfataricus
MSRSANITRETKETKIEVLLDIDRKGEVKVSTPIPFFNHMLITLLTYMNSTAIVSATDKLPYDDHHIVEDVAITLGLAIKTALGDKRGIKRFSHQIIPMDDALVLVSLDISNRGMAFVNLNLKRSEIGGLATENVPHFFQSFAYNSGITLHISQLSGYNTHHIIEASFKALGLALYEATRIVDNEIRSTKGII

SEQ ID NO: 12657 - protein, 381 aa, Oryza sativa
MRSSLAVDRPTRPYPLPAQRPNRLPAPPVSGTGIASPRMGMGRGGAVQCTARAGAATTTTTMGEWIVPGPHVNDEEENDNGPGIRGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRKLAVATTTTTTTTGAAAAPGVVADAAELVERPCKRFSPTPDSPSGSGSGSDRSDLSHGGGFGQIFRPVARTGAFEPVDCAISRRQEEDPFTSLSLSLPGTDQRFNHDSAHSHFQELPSSPSPPPPPPPAAAASTTQYPFTPEFAAAMQEMIRAEVHKYMASVGVRAGCGDAGGADLHMPQLVEGVMRAAAERVGRMH

SEQ ID NO: 12658 - protein, 159 aa, Burkholderia pseudomallei
MSKLYSFNAQALSGGEVPLEQYRGKVLLIVNTASECGFTPQYAGLQQLYDRFRERGLVVLGFPCNQFGKQEPGDASQIGAFCEKNYGVTFPMFGKIDVNGANAHPLYRYLTEEAPGILGLKAIKWNFTKFLVNREGEIVKRYAPSTKPEDIAADVEKLL

SEQ ID NO: 12659 - protein, 550 aa, Pseudoalteromonas tunicata
MAILAGCGLIYEYLLSHYAGRILGSVESAIYAMIGTMIVAMGIGAFLARWFKDPFTAFAWLESLIALLGMSSILIIACIIALSYTLPHTFASLYNLPADAVLDGAIFDQFQTFARFLPYVFGLLLGILIGMEIPLIARIRQQVYGRFLENNAGTIYGADYIGAGIGAAIWVTVMLTLPIMQAAAWTALFNIIAGLIFLWRYHQHVKWAKLLLLCHLLLIGLFAVFLLYASAWMKDLSNVLYKDKVIYSDSTKYQHVVITERLSRTQTAPINDLFLNGRLQFSSADEQIYHTMLVYPAMLASNRHDNVLIIGGGDGLALRDVLKWPVKHATLVDLDGQLLSLFGLSNQPYQAPQPLKEKLTALNHNALNDPRANVIVADAFLEVERMLDRGLLFDTIIIDLPDPNHPDLNKLYSDYFYNHVKQLLAPDGALVIQSTSPYHAKKAFISIAKTVKQAGFAHVEQYQQNIPSFGQWGWTIATRSGQPASERIAQIAQFPVATNWLNQKYLQAAFAFPNNFFSNNKDIEVNRLGTGILYDYYRQAWQTESELYKN

SEQ ID NO: 12660 - protein, 247 aa, Unknown
  Polaromonas sp. JS666
MKVNPKNSPKDNLKDSPKVSARGKKVNKAWLHDHINDPYVKLAQKEGYRARAAYKLKEIDETLGLIKPGDCVVDLGSTPGAWSQYVRRKLSPTGAAAGELNGRIIGLDMLPMEPIEGVAFIQGDFREPEVLQKLEQALATDKGQVKVDLVISDMAPNLSGIESADAARIVHLVELAVEFAQNRMKPDGTLVVKLFHGSGYDELVKLFRATFKVVKPMKPKASRSNSSETFLVGKGLKKRAETVPELA

SEQ ID NO: 12661 - protein, 967 aa, Colwellia psychrerythraea
MVDIYDPKAAQNQSTRSQNIIDFGTPEVYSDVQVTLTIDGQEISVPKGTSVLRAAAMLNITIPKLCASDNLESFGSCRLCAVEIEGRRGMPASCTTPVEHDMQVSTQNKKIARLRKNIMELYISDHPLDCLTCPSNGDCELQDMAGAVGLREVRYGFDGENHLDVAKDTSNPYFTFEPSKCIVCSRCVRACEEVQGTFALTIDGRGFDSKVSTGLDNDFLSSDCVSCGACVQACPTSTLMEKSVIDQGQPEHSVTTTCAYCGVGCSFEAHMKGEEVIRMVPAKDGQANHGHSCVKGRFAFGYATHQDRITSPMVRDSIDQPWQEVSWDEAISFAAKRLKEIQKKHGKDSIGGITSSRCTNEETYLVQKLIRAAFGNNNTDTCARVCHSPTGYGLKATLGESAGTQTFDSVMEADTIIVIGANPTDAHPVFGSLLKKRLRQGAHLIIADPRKIDLGNSPHVKLDHHLPLRPGTNVAFINAMAHVIVNEGLEDKAFIAERCETQAYQQWYSFISDVRHSPENTETITGVDADQLRQAARLYAKVDNGAIYYGLGVTEHSQGSSMVMGIANLALLTGNIGREGVGVNPLRGQNNVQGSCDMGSFPHELPGYQHVSNDALRSKFEQHWQVDIDNEPGLRIPNMFDAAIDGSFKGMYCQGEDIAQSDPNTHHVEAALTSLECLIVQDIFLNETAKFAHVFLPGSSFLEKDGTFTNAERRINRVRKVMAPLAEKADWQATMALSNALGYPMNYQHPSEIMDEIAQLTPTFSGVSYQKLDELGSIQWPCNDSNPLGTPTMHIDDFPIGKATFALTEYVATDERASRKFPLLLTTGRILSQYNVGAQTRRTENQVWHDKDQLEIHPHDAQERGIQGGDSLGISSRAGNTVLTAKITERMQPGVVYTTFHHPESGANVVTTDNSDWATNCPEYKVTAVQVEKVSSPSNWQLRNKEFSIKQNEFLPKKRSDEARVKL

SEQ ID NO: 12662 - protein, 630 aa, Dianthus caryophyllus
MESCDCIDTQWQDKVLVQYQYLSDILIAIAYFSIPLELIYFVKKLAFFPYRRVLMLFGAFIVLCGTTHFINLWTSSVHTKTVAIVMTVAKMSTAAVSCVTALWLVYIIPDLLSVKTREMCLRHKAEELDKEKGLILTQEETERHVRMLMHKIRSTLDRHTILKTALVELGRTFNLEECAIWMPSQTGKTMQLTHALNHSMVVGLTVSTNDSFIDEIFNTSSAVRIPYSCSLVRSMSVAGRYGAPEIVVVRVPLLHHSNFQINDWPDISAKNFAAMVLISPSDAVRKFRDHDLELVKVVADEVAVALSHAATVEESVRAQNQLMEHNVALDLARREAEMAIICARNEFLSVMNHEMRTPIHAIIALSSILLGTELTPEQRVMLEIILKSSNLLSTLINDVLDLSRLEDGSLELDTVVFNLHGVFKEVLHLIKPIASVKKLSLTLVLAPEMPVCAVGDEKRLLQTILNVVGNAVKFTKEGYVSVSASVARPESLTNWRGPEVHPVLSDGYFYLKVQVKDSGCGINPQDMPIIFNKFTQFNQNTAGIGLGLAICKRFVNLMGGQIWIESDGHGKGTTTTFMVKLGTCKSSSDKLSFQVAGQVNQGSSEFISNKRLFRGDDSAGSTFQCYERTF

SEQ ID NO: 12663 - protein, 356 aa, Glycine max
MSLLSDLINLNLSDITDKVIAEYIWVGGSGMDMRSKARTLSGLVNDPSKLPKWNYDGSSTGQAPGQDSEVILYPQAIFRDPFRRGNNILVMCDAYTPAGEPIPTNKRNKAAKIFSNPDVAAEEPWYGLEQEYTLLQKDVQWPLGWPLGGFPGPQGPYYCGTGANKAFGRDIVDSHYKACIYAGINISGINGEVMPGQWEFQVGPSVGISAADELWVARYILERITEIAGVVLSFDPKPIQGDWNGAGAHTNYSTKLMRNDGGYEIIKKAIAKLEKRHKEHIAAYGEGNERRLTGRHETADMNTFLWGVANRGASIRVGRDTEKAGKGYFEDRRPASNMDPYVVTSMIAETTILWKP

SEQ ID NO: 12664 - protein, 334 aa, Oryza sativa
MASQGVASMFALALLLGAFASIPQKAEAIGVCYGMSANNLPPASSVVGMYRSNGITSMRLYAPDRRALQSVGGTGISVVVGAPNDVLSNLAASPAAAASWVRNNIQALPSVSFRYVAVGNEVAGGATSSLVPAMENVRGALVSAGLGHIKVTTSVSQALLAVYSPPSAAEFTGESQAFMAPVLSFLARTGAPLLANIYPYFSYTYSQGSDDVSYALFTAAGTVVQDGAYGYQNLFDTTVDAFYAAMAKHGGSGVSLVVSETGWPSAGGMSASPANARIYNQNLVNHIGRGTPRHPGAIETYVFSMFNENQKDAGVEQNWGLFYPNMQHVYPISF

SEQ ID NO: 12665 - protein, 272 aa, Unknown
  Polaromonas sp. JS666
MSIFMSTPTSTPTSTPMSTSNPFRLDGRLALITGSSAGIGFALARALGQAGATLVLNGRDAGRLEQAAGVLRSEGLQVHTRMFDVTQAEAVEAAVQDIESTLGAIEILVNNAGMQRRMPLHEFSTEQWHELMRTNVDSVFFMGRAVARKMIERRRGRIINVCSVQSELGRPNIAPYTASKGAVKMLTKGMAIDWGPHGINVNGLGPGYFRTELNEKLVADEQFNAWLIGRTPSRRWGNVEDLGGAAVFLASDASSFVNGHILYVDGGVTATL

SEQ ID NO: 12666 - protein, 549 aa, Alkaliphilus metalliredigenes
MKNKFAKLGISEEIENVLNKSDITEPTPVQLQAIPPLLAQRDVMAQAQTGTGKTLAFILPILERVNVEKPTIQALIITPTRELAIQITAETKKLAEVKGINILAAYGGQDVEQQLRKLKGSIHIIIGTPGRLLDHLRRKTINLGKLSMLVLDEADQMLHMGFLRDVEDIMTHIPKRRQNMFFSATMPNQVRTLAEQYMKDPVQIQVQSKRVTLDEIRQVVIETTDRGKQDLLCQLFDEYNPFMAIIFCRTKRRAIALNEALINLGYNSDELHGDLTQAKREKVMKAFKKSKIQYLVATDVAARGLDIEGVTHIFNYDIPQDGESYIHRIGRTGRAGETGMAITFMTSRDRDELKIIEKVIKMDLDVQKSKSGKIDLDEEEQDTKKSPKGRGNDKSKDFKKGKYGDKKGKPGDKKGRPGDKRDRPTDKKGRPGDKRDRPSDNKGRPGDKRDRPSDNKGRPGDNKGRPGDNKGRPGDNKGRPGDNKGRPGDNKGRPGDNKGRPGDNKGRPGDNKGRPGDNKGRPGDNKESGYKGNKNTRGNQSSSNNKRSR

SEQ ID NO: 12667 - protein, 416 aa, Prochlorococcus marinus
MTHINSALEDADPNIASLIQEESKRQENHLELIASENFTSKAVMEAQGSVLTNKYAEGLPNKRYYGGCEHIDKIEGLAIERAKQLFKAEWANVQPHSGAQANFSVFLSLLEPGEKIMGMDLSHGGHLTHGSPVNVSGKWFKAIHYGVDKETQRLEMENVREIALKNRPKLIICGYSAYPRNIDFLAFRSIADEVGAYLLADMAHIAGLVATGIHPSPIPHCDVVTTTTHKTLRGPRGGLILCRNAEFGKRFDKAVFPGSQGGPLEHVIAAKAVAFGEALKPGFSSYCEQLVKNSKALAKRMQDRGIAVVSNGTDNHIVLLDLRSIDMTGKEADSLVSAINVTTNKNTVPFDPKSPFVTSGLRLGTAALTTRGFDEPAFLEVADLIADRLLNPTDLILKNKCQQRVLDLCNRFPLYD

SEQ ID NO: 12668 - protein, 208 aa, Oryza sativa
MAVAIEAPFHVLAVDDSLPDRKLIERLLKTSSFQGLAFVCVVTTVDSGSKALEFLGLHDHEDSPISTQSDQQEVAVNLIITDYCMPGMTGYDLLKKIKESSYLRDIPVVIMSSDNIPSRINRCLEEGADEFFLKPVRLSDMSKLKPHILKSRCKEHYQQEQNLQSNSESNNSSNPTSENSSSSTSSNSHKRKAVDEEILPHTIRPRHS

SEQ ID NO: 12669 - protein, 275 aa, Brassica napus
MATTNSLQHHHHSSSSYHRHNLHPQSHVVPSSLSLKHPTSTATFSSLICSSSSSSSSVVSAALTTNASSVTAETSTEFDVLATHLTNQDFRKADEETRRLLIQIAGEAAVKRGYVFFSEVKSISVEDLQAIDNLWTKHSDGRFGYSVQRKIWLKVKKDFTRFFIKVEWMKLLDTEVVQYNYRAFPDEFKWELNDETPLGHLPLTNALRGTQLLKCVLSHPAFEIAGDDDNEEGEEAESRGGGGKAQTKDTRVFRNGLQLLRSLIFIWIMNVGAVI

SEQ ID NO: 12670 - protein, 356 aa, Glycine max
MSLLSDLINLNLSESTEKIIAEYIWVGGSGMDLRSKARTLPGPVSDPAKLPKWNYDGSSTDQAPGDDSEVILYPQAIFKDPFRRGNNILVICDVYTPAGEPLPTNKRYGAAKIFSHPDVAAEEPWYGIEQEYTLLQKDVNWPLGWPLGGFPGPQGPYYCGIGADKAYGRDIVDAHYKACIYAGINISGINGEVMPGQWEFQVGPSVGISAGDEVWAARYILERITEIAGAIVSFDPKPIPGDWNGAGAHSNYSTKSMREEGGYEVIKKAIEKLGLRHKEHIAAYGEGNERRLTGRHETADINTFSWGVANRGSSIRVGRDTEKNGKGYFEDRRPASNMDPYVVTSMIAETTILWKP

SEQ ID NO: 12671 - protein, 368 aa, Deinococcus radiodurans
MVMKIGMIGLGKMGGNMVIRLKNGGQDVVGFDRSQEAIDHLVSQGVAADALTSDMDRFIELLGEPGQRAVWVMVPAGQITQSVIDDLAGRLSAGDVIIDGGNSNFHDTQRRGEALAAKGLHFVDVGTSGGVWGITEGYGMMVGGPDEGVERIRPALEALAPAPDRGWGHMGPTGSGHYVKMVHNGIEYGMMQAYAEGFELMKAHQTFNLDMAQIAEVWRHGTVIRSWLLDLTAEALKNSADFDQLSDYVADSGEGRWTIIDSIELGVPTPVITLATQMRFRSQQDVSYQGQMLSAMRRAFGGHAVKTLEATKQESVVPAVKPGESPKAAAPENIPTAAAQPSISGRSEAQELGETGQQRTTGDQKAGE

SEQ ID NO: 12672 - protein, 420 aa, Pasteurella multocida
MLKRSMNIADYDPVLWQAIQDENRRQEEHIELIASENYASPRVMEAQGSQFTNKYAEGYPGKRYYGGCEYADIVEQLAIDRAKELFHADYVNVQPHSGSQANAAVYGALLQPHDTILGMSLAHGGHLTHGASVSFSGKIYNAVQYGITAEGLIDYEDVRQKALECKPKMIVAGFSAYSQVVDWAKMREIADEVGAYLFVDMAHVAGLIAAGVYPSPLPHAHVVTTTTHKTLGGPRGGLILSAAKDEDLYKKLQSSVFPANQGGPLVHVIAAKAVCFKEALEPEYKVYQQQVVKNAKAMVDVFKQRGYNVVSNGTENHLFLVDLVSHGLTGKAADAALGSANITVNKNAVPNDPQKPFVTSGIRVGTPSITRRGFKEAESAELAGWMCDVLDAMGKDNEAQVIAQTKEKVLAICKRLPVYA

SEQ ID NO: 12673 - protein, 829 aa, Vibrio cholerae
MKMTRRAFVKANAAASAAAVAGITLPASATNLIASSDQTAIHWDKAPCRFCGTGCSVLVGTQDGRVVATQGDPEAPVNKGLNCIKGYFLSKIMYGQDRLKTPLLRMKDGQYHKDGEFTPVSWDTAFDVMAEKWKASLKTKGPTSVGMFGSGQWTVMEGYAAVKLMKAGFRSNNIDPNARHCMASAVVGFMRTFGIDEPMGCYDDFEHADAFVLWGSNMAEMHPVLWTRITDRRLSHPHVKVNVLSTYYHRSFELADHGYIFHPQSDLAIANFIANYIIQNDAVNWDFVNKHTHFKQAVTDIGYGLRDDHPLQKKAKNANSGDVSDISFEEYKKSVAPYTVEKASEISGVSPDKLITLAKQYADPNTKVMSLWTMGMNQHTRGVWMQSLVYNLHLLTGKIATPGNSPFSLTGQPSACGTAREVGTFAHRLPADMVVANPKHRAIAEKVWKLPEGTIPEKPGFHAVQQDRMLKDGVLNCYWVQCNNNMQAGPNINEERLPGYRNPENFIVVSDAYPTVTAQAADLVLPTAMWVEKEGAYGNAERRTQVWYQQVKTVGESHSDSWQVIEFSKRFKVEDVWPEELLAKAPQYRGKTLYDVLFKNGQVDKFPLSEARELNDDAHHFGFYIQKGLFEEYAEFGRGHGHDLAPYDVYHQVRGLRWPVVDGKETKWRFKEGSDPYAKAGSGWDFYGKPDGKAWIISSPYEAPPEMPNEEYDLWLCTGRVLEHWHTGTMTRRVPELYKAVPDALCFMHHEDAQARGLRRGDEVLISNSRGEVRVRVETRGRNKPPKGLVFVPFFDARILVNKLILDATDPLSKQTDFKKCPVKITKVA

SEQ ID NO: 12674 - protein, 193 aa, Zea mays
MIPTIRKEAYLKIEEAVLSRKISNIEYHLKGAKIFDKKAKTLITREAVNGTSTDSKTTITLKYSVIKGKLWDSSKSMKLGVTTTIEAGVPVVLPATIEVQSEFNSTYSWGESIIEKEEYSNAYEVVVPAYSVVTVSVLATQGICQVPFSYTQEDVLTTGERKVFKFDDGIFRGVNSFGFKSEVTERKLSKDDD

SEQ ID NO: 12675 - protein, 107 aa, Synechococcus elongatus
MSAATELNDQQFESAVLKAPGLVLVDFWAPWCGPCRLIAPLMDWAAQTYADQLTVYKLEVDPNPETVARYQVQGIPTLLLFQNGELVERVEGAIGRDRIQTLINAHL

SEQ ID NO: 12676 - protein, 304 aa, Unknown
  Nostoc sp. PCC 7119
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGITPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGPRGMEEGIDAALSAAAAKEGVTWSDYQKDLKKAGRWHVETY

SEQ ID NO: 12677 - protein, 692 aa, Triticum aestivum
MDASAGSSPPRHSQGDAPRRGGPHRGKGPAVEIRQGEDDFMFAHDTFPALPDFPCLSSPSSSTFSSSSSSNSSSAFTRAVGAGGRGGESARGEPSEPAAAGDGMDDLSDIDHLLDFASINEDVPWDDEPLFPDVGMMLEDVISEQQQLQPPAGHGTAGRTASHAAAGGGEDAFMGGGGTGSAADDLPRFFMEWLKNNRDCISAEDLRSIRLRRSTIEAAAARLGGGRQGTMQLLKLILTWVQNHHLQKKRPRVGAMDQEALPAGGQLPSPGANPGYEFPAETGAAAATSWIPYQAFWPTGSYGGEAIYPFQQGCSTSSVGVSSQPFSPPAAPDMHAGAWPLQYAAFVPAGATSAGTQTYPMPPPGAVPQPFAAPGFAGQFPQRMEPAATREARKKRMARQRRLSCLQQQRSQQLNLSQIQTGGFPQEPSPRAAHSAPVTPPSSGWGGLWTQQAVQSQPHGQLMVQVPNPLSTKSNSSRQKQQKPSPDAAARPPSGGAATPQRPGQAAASDKQRQQGARTPAAAPAAGDKNPRFLLQKVLKQSDVGTLGRIVLPKKEAETHLPELKTGDGISIPIEDIGTSQVWSMRYRFWPNNKSRMYLLENTGDFVRSNELQEGDFIVLYSDVKSGKYLIRGVKVRAQQDLAKHKNASPEKGGASDVKAGGEDGGCKEKPPHGVRRSRQEAASMNQMAVSI

SEQ ID NO: 12678 - protein, 134 aa, Nocardia farcinica
MSSGEQTATSFYEAVGGAETFRRLVAAFYREVAADEILRPLYPEEDLGPAERRLRMFLEQYWGGPRTYSDERGHPRLRMRHMPFKVGPLERDAWLRCMRIAVAELEPEVLDDEHRKALLDYLEMAAHSLMNSPI

SEQ ID NO: 12679 - protein, 688 aa, Triticum aestivum
MDASAGSSPPRHSQGDAPRRGGPHRGKGPAVEIRQGEDDFMFAHDTFPALPDFPCLSSPSSSTFSSSSSSNSSSAFAAPAGAGGRGAEGARGEPSEPAAAGDGMDDLSDIDHLLDFASINDDVPWDDEPLFPDVGMMLEDVISEQQLQQPPAGHGTAGRTASHAASGGGEDAFMGGGGTGSAADDLPLFFMEWLKNNRDCISAEDLRSIRLRRSTIEAAAARLGGGRQGTMQLLKLILTWVQNHHLQKKRPRVGAMDQEAPPAGGQLPSPGANPGYEFPAETGAAAATSWMPYQAFSPTGSYGGEAIYPFQQGCSTSSVAVSSQPFSPPAAPDMHAGAWPLQYAAFVPAGATSAGTQTYPMPPPGAVPQPFAAPGFAGQFPQRMEPAATREARKKRMARQRRLSCLQQQRSQQLNLSQIQTGGFPQEQSPRAAHSAPVTPPSSGWGGLWTQQAVQGQLMVQVPNPLSTKSNSSRQKQQKPSPDAAARPPSGGAATPHRPGQASASNKQRQQGARTPAAAPAAGDKNLRFLLQKVLKQSDVGTLGRIVLPKKEAETHLPELKTGDGISIPIEDIGTSQVWSMRYRFWPNNKSRMYLLENTGDFVRSNELQEGDFIVLYSDVKSGKYLIRGVKVRAQQDLAKHKNASPEKGGASDVKAGGEDGGCKEKSPHGVRRSRQEASSMNQMAVSI

SEQ ID NO: 12680 - protein, 531 aa, Nocardia farcinica
MTATPAVPDDPRRSWWRSAVFYQVYPRSFADSDGDGVGDLGGVREKLGYLELLGVNALWICPVMRSPMADGGYDVSDPRDIDPLFGGMAAMDALIAEAHARDIKVTMDLVPNHTSDRHPWFAEALRSAPGSPARARYIFRDGRGPDGSLPPNNWPSIFGGPAWTRVTEPDGTPGQWYLHLFAREQPDLNWENPEVVADFEKTLRFWLDRGVDGFRIDVAHGMAKPADLPDMAAVSTKMLIHDDSDPRFNNPGVHDIHRRIRKVLDEYPHAVSIGEVWVDDNTRFGEYVRPDELHLAFNFRLAETPFRAEAVREAIENSLAAVAEVGAPPTWTLSNHDIEREVTRYGGGARGVARARAMILVELALPGAVFLYNGSELGLPNVDDLPEEVLQDPVWERSGHTERGRDGCRVPLPWEGERPPFGFTRAERSWLPIPPEWADLTVEAQLERLDSTLCLYRMAVDLRGTRPEFAGEGLEWYGSPPGRLAFRRPGGLVCVLNTTEEPIPLPPGEPLLTSTPLDNGHLPPDAAAWLV

SEQ ID NO: 12681 - protein, 692 aa, Triticum aestivum
MDASAGSSPPRHSQGDAPRRGGPRRGKGPAVEIRQGEDDFMFAHDTFPVLPDFPCLSSPSSSTFSSSSSSNSSSAFAAPAGAGGRGGEGARGEPSEPAAAGDGMDDLSDIDHLLDFASINDDVPWDDEPLFPDVGMMLEDVISEQQNQQPPAGHGAGGRMASHAAAGGGDDAFMGGGGGGSAADDLPLFFMEWLKNNRDCISAEDLRSIRLRRSTIEAAAARLGGGRQGTMQLLKLILTWVQNHHLQKKRPRVGAMDQEAPPAGGQLPSPGANPGYEFPAETGAAANTSWMPYQAFSPTGSYGGEAIYPFQQGCSTSSVAVSSQPFSPPAAPDMHAGAWPLQYAAFVPAGATSAGTQTYPMPPPGAVPQPFAAPGFAGQFPQRMEPAATREARKKRMARQRRLSCLQQQRSQQLNLSQIQSGGFPQEPSPRAAHSAPVTPPSSGWGGLWSQHAVQGQPHGQLMVQVPNPLSTKSNSSRQKQQKPSPDAAARPPSGGAATQQRPGQAAASDKQRQQGARTPAAAPAAGDKNLRFLLQKVLKQSDVGTLGRIVLPKKEAETHLPELKTGDGISIPIEDIGTSQVWSMRYRFWPNNKSRMYLLENTGDFVRSNELQEGDFIVLYSDVKSGKYLIRGVKVRAQQDLAKHKNGSPEKGGASDAKAGAEDGGCKEKSPHGVRRSRQEAASMNQMAVSI

SEQ ID NO: 12682 - protein, 356 aa, Triticum aestivum
AYLGDTIEQVCTKKQAGTGPEFPGYRRPTRPDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKGYDLDGNRVNQGLTVYGNKGSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLEQIADRCHCPEDIEMIYKIIQHMAANDRALIAEGSCGSPRSVKVYLGECNVDDL

SEQ ID NO: 12683 - protein, 295 aa, Xylella fastidiosa
MTTHLLPVALIQERNHGTAEANLSIIEARVAEAAAQGAQLVLLHELHNSAYFCQHESVNEFDLAEPIPGPSTERLSALAKQHRVVIIGSLFEKRAAGLYHNTAVVLEKDGRLVGKYRKMHIPDDPGFYEKFYFTPGDIGFKPIDTSVGRLGVLVCWDQWYPEAARLMALAGAELLLYPTAIGWDPNDEHNEQTLQRDAWLLSHRGHAIANSLPVLSCNRTGHEPSPLCTSGIKFWGNSHVLGPQGEFLAEANSNGPEILTCEINLQRSEHVRRIWPFLRDRRIDAYGDLLKRYID

SEQ ID NO: 12684 - protein, 452 aa, Prochlorococcus marinus
MSIENLVIIGSGPAGYTAAIYAARANLQPLLITGFERGGIPGGQLMTTTFVENFPGFPDGIMGPDLMDLLKAQAIRWGTKLLELDAEAIDLKQNPFRVKTANQSIAAQALIIATGARANKLGIPNENKFWTRGISACAICDGATPQFRNEELAVVGGGDSACEEAVYLTKYGSHVHLLIRSNQLKASKAMSDRVMANSQITVHWETELIDVEGKEWIETLKVKRRGTKQEETIKAKGLFYAIGHTPNADLLEGQLLINQNGYISTKSGRPETSIEGVFAAGDVADAEWRQGITAAGSGCKAALAAERWLSRNNLSTLIKRDSIEPAKTDKETEIAISTEQNFDATKTWQKGSYALRKLYHESSKPILVVYTSPNCGPCHVLKPQLKRVIQELKGTVQGIEIDIDIEQEIAKQAGVNGTPTVQLFHQKELKTQWRGVKQRSEFKEAITKVLSK

SEQ ID NO: 12685 - protein, 274 aa, Triticum aestivum
  misc_feature (139)..(139): Xaa can be any naturally occurring amino acid
  misc_feature (216)..(216): Xaa can be any naturally occurring amino acid
  misc_feature (238)..(238): Xaa can be any naturally occurring amino acid
MAAAEPSGSSQPGAPGRWSLHGKTALVTGGTRGIGRAVVEELAALGAAVHTCSRKEAELGERLKEWEARGFRVTTSVCDLSVREQRERLIGDVAERFGGKLNILVNNVGTNIRKPTTEFSAEDYSFLMATNLESAYHLXCQLAHPLLKASGLGSIVFISSVCGLVAVFSGTLYAMTKGAINQLTKNLACEWAKDGIRTNSVAPWYITTSLTEGLLXANKEFEASVVSRTPLGRVGEPXEVSSLVAFLCMPGSTYITGQTISVDGGMSVNGFYPA

SEQ ID NO: 12686 - protein, 1589 aa, Metarhizium anisopliae
DPRTGAHRAATFNNKFPFSKKTRPQRPFDYTDETIGPTDYNDPGHVYHLDTNLNDMEGILTKPPPLTPMDSSFINSIESDRRESTLEGPKGRWDAPDSWAVRRNTEDNTEDVPEVDEIGSPPRPDEKLTSYFIRIFRSDGTFSTHSMALDSTVTDVISQVIKKTYVVDGLENYHIIMKKHDLIRVLAPAERPLLMQKRLLQQVGYEEKDRIEDLGREDNGYLCRFMFLSARESDFHAKTMDLGISRSQKLNYVDLSGRNLVTIPISLYKKAADIISLNLSRNLSLDVPRDFIQSCKQLRDIKYNNNESRKLPLSLGRAGRLTFLDVSNNRLEQLEHAELNSLTGLLKMNLANNRLTHLPPYFGAYQALRSLNISSNFLDKFPPFLCQLHSLVDLDLSFNAIASLPDELGNLKNLEKLLITNNRLADEVPEGFRQLLSLRELDIKYNSITSIDIISELPKLEILTAAHNHISSFVGKFETIRQLKLNSNPLNKFEIVEPVPTLKTLNLSHAQLASIDSAFSNMINLETLVLDKNYFVSLPQQIGTLSRLEHFSIANNSVGELPPQIGCLTELRVLDVRGNNISKLPMEIWWANKLETFNASSNVLDAFPKPASRPPRVPGEEPTGPPTVQNGKPLPPNPIPSTPSSEDLSDERNPSQASSTLLSVGPSPVLATADRKSSVVSVYGKGGRKTSVVSRAASQATNSTTPPPTTARKDSGLSSRLTNTFAGSLRNLYIADNRLDDDVFDQIILLSELRVLNLSYNDEISDMPQRSIKNWPQLVELYLSGNGLTSLPADDLEESSLLQTLYINGNKFTNLPADISRAKKLAVLDCGNNYLKYNISNVPYDWNWNLNPNLRYLNLSGNKRLEIKQTAWGGPDGPGAVNREQYTDFSRLLNLRILGLMDVTLTQPSIPDQSEDRRVRTSGSLAGHLPYGMADTLGKNEHLSTVDLVVPRFNSSETEMLLGLFDGQALSSGGSKIAKYLHENFGHIFAMELKAIKNRPDDTPTDALRRAFLCLNKDLVTVAVQHTEERPKAAHRGSAQPVVLSKEDLNSGGVATVLYLRGTELYVANVGDVQAMVIKTDGKHEILTRKHDPAEPSERSRIREAGGWVSRNGRLNDLLQVSRAFGYVDLMPAVQAAPHVNKMTIKEHDEIILLATSELWEHLAPSLITDIARSERQDLMRAAQKLRDLAMAYGASGKIMVMMISVADLKRRVERSRLHRGTSMSLYPSGIPDDTQVLSTRRRGKAKGDVLDSSLNRLEAEIPAPTGNVSIVFTDIKNSTTLWEMYSSAMRSAIKLHNEVMRRQLRRIGGYEVKTEGDAFMVSFPTATSALLWCFAVQMELLDVSWPSEVLNSMSCQPIFDKDGALIFKGLSVRMGIHFGDCVSETDPVTRRMDYFGPMVNKASRISAVADGGQITVSSDFISEIQRCLENYQDTERNASGGSDEAFEDESFAATIRKDLRSLTSQGFEVKEMGEKKLKGLENPEVVYSLYPHALAGRIDQHQQHERRDEGLDRPAILAPGSELSFDPESIWALWRVSLRLEMLCSTLEEVRGSGLQPPETELLERIKSRGGEVTQKFLLNFMEHQVTR

SEQ ID NO: 12687 - protein, 487 aa, Medicago truncatula
MNSAPQSSSAAAAGGSGGGPAPFLQKTYDMVDDSTTDEIVSWSSDNKSFIVWNPPEFSRVLLPTYFKHNNFSSFIRQLNTYGFRKADPERWEFANEEFIKDQKHLLKNIHRRKPIHSHSHPPGSAVDPERAALEQEIEKLSREKNALQTKLLSYNYLDTEKLQLEDFQRRLDGMEKRQTNLQNFFEKALQDSFIVELLSRKIESMDLAAYNKKRRLPQVDQVQPVAEGSLVDNPSNFRLEFGNVFPHDISNKLRLELSPAVSDMNLISGSTQGSNEDEESLQKNLSEGELTGMQTRTGLAFTPETLDLADTGASFTFNMDSCLSQRATTTECPNLHSLEPSTEEGDSHISCQLNLTLASCTLEFNRNSYSARSPQINCQEIGNLAESRVNADGKESEIGVSSNRNVANEAINLAPPKEASGNVQVKAAARHGVNDVFWENFLTERPGCSDNEEAISNYRAIPNSEQEEGRSVHGISSNIKNMDNLTL

SEQ ID NO: 12688 - protein, 76 aa, Brassica napus
  misc_feature (57)..(57): Xaa can be any naturally occurring amino acid
YAFTYHWRLWSIPEIKDCLEEAGFKWVHVWMREMPNTQSGGNAKEYNANRDVKYEEXQHFNQGDAWNAYVVGVANV

SEQ ID NO: 12689 - protein, 176 aa, Dehalococcoides ethenogenes
MTETAVFGGGCFWCMEAVFSRLSGVLKVEPGYAGGTLPNPTYQQVCAGDTGHAEVVKLEFDPALVSYTDLLDVFFQMHDPTTPNRQGQDIGTQYRSVIFYTTPAQKVQAEETIKKLDESAGFPERIVTGVLPLEKFYPAEDYHRQYYALHSRQPYCRFVIQPKLDKLKEHFGGMQK

SEQ ID NO: 12690 - protein, 120 aa, Brassica napus
  misc_feature (2)..(2): Xaa can be any naturally occurring amino acid
  misc_feature (8)..(8): Xaa can be any naturally occurring amino acid
  misc_feature (15)..(15): Xaa can be any naturally occurring amino acid
  misc_feature (51)..(51): Xaa can be any naturally occurring amino acid
  misc_feature (53)..(53): Xaa can be any naturally occurring amino acid
  misc_feature (61)..(61): Xaa can be any naturally occurring amino acid
  misc_feature (81)..(81): Xaa can be any naturally occurring amino acid
  misc_feature (106)..(106): Xaa can be any naturally occurring amino acid
  misc_feature (112)..(112): Xaa can be any naturally occurring amino acid
SXRRGFVXIAMEHGXPLVPVFCFGQSRVYKWWKPDWNLYLKLSRAIKFTPXCXWGVFGSPXPFRHPLHVVVGKPIEVRKTXQPTDEEIAKVHGQFVEALKDLFERXKARAGXSDLQLNIL

SEQ ID NO: 12691 - protein, 389 aa, Unknown
  Synechococcus sp. WH 8102
MRVSVATAGGTSSSLFTVVASGIQAGSGPSVIRTYRVAMSGLNDLYKRLAASGARILSVSPAGEESPAAPVAASSAPAPQAVTSAPAPKKKSHANVPVNTYKPKTPFLGTVTENYSLVADGGIGRVQHITFDLSGGDPQLEYIEGQSIGIVPEGEDANGKPHKLRLYSIASTRHGDNYQDNTVSLCVRQLEYKNEAGEQIYGVCSTYLCDIEPGSKVKITGPVGKEMLLPDDEDANIIMLATGTGIAPMRTYIRRMFEPREREANGWNFRGKAWLFMGAPKTGNLLYDEDLLHYEKEFPDNFRYTKAISREQQNAKGGRMYIQDRVLEHAEEIFAMIENPKTHVYMCGLRGMEPGIDEAMTAAAAAKGLDWSELRPQLKKADRWHVETY

SEQ ID NO: 12692 - protein, 697 aa, Magnaporthe grisea
MITAQLREALQEAVVMCSERCLYQSAKWAAELLSAIPPDTNDAEPEGDQSRFISPGFARNPDPAEAALEAAEFNKYLLAKSFFDCKEFDRCAAVFLPDSLLAGLVPMTRAEDNIPSANASKDQAKPPPTQTLRPQDLPELSQKSLFLALYAKVISGEKRKDEDAEMVMGPHDLGTIVNKQLLPVSNYLEQWFNRRSNEDGYTPGSQGWLEYLYGMVLAKSKSEAEAMEWFIRSVHLFPMNWGCWLEMTSLISRVADLNAISPQLPQNIVSFMFHLHTSLELYQQGPQLAHSLEELLKLFPTSSFLLTCRALLEYHNKDLTLAEQHFSTLLALHPHRLDSLDHYSNILYVLNYRPKLAFLAHLCSSVDKFRPESCVVVGNYYSLLSMHEKAVQYFRRALTLDRSCLSAWTLMGHEYVELKNTHAAIESYRRAVDVNRRDYRAWYGLGQTYEVLEMHTYALWYYKKAAGLRPWDGKMWMAVGSCLQKMGRERDGIKALKRALLADSSYETGSGSGLGTAGASGSFTAGGLDRTGALHMDPEVLLQIANMYDNLGELDEARMYMELCVSQEDGGEEDDMAGLGNSISIHRDASVGGSDDDEPRPDGSKMNTTPIVAGGGGTGVTPATSKARMWLARHALEYEDYAEAHRLATELCQDGVEVEEAKALIREARAQMDLAQAQGDGAGSGGALSRTPQQARG

SEQ ID NO: 12693 - protein, 1537 aa, Unknown
  Frankia sp. EAN1pec
MRPTAQRLEDVVPGGSQQPVQAPREGLPRLAALHQRQQRPLADDDVPVGGDRGPVQAEIGSEGVALRVAAGRGPLDGLERDMTQPAQDGGEPPGGSRARPPFQTGIQETGPAWLRRPGQGDRGGQGTGHGELQVRAQCRRTCEHRQLARHGEGRRAGRQLTSCRGHCHHAGPPSTRNAFPCVSSRRTPRIPVDRAMTGVRGLDPPPPLVPHVVTPTPAEGLVRGPRGPNVPAGHGRWSGPRRAWSARPAPSVAGRPRTGHVPRIPAVRPRWSCRADWSCRADWSRRADWSRRADWSDRAGRTSRTRWAGCPATDVEQAAWPGQATEGGGELAGDDPQLAGLALCQPREHLQVLVGEELLVRVALVDGAEDGADGLRLALGGEDLGLPVAFRPQDRGLLLALGPQDLARLDTLGGQDRGPPVAFGPHLLLHRVLDGAGRVDGLELHPVDPDAPPAGRVVEHPAQLPVDLVARGERALEVHPADHVAQRGHGELLDGADEVGDLVGGRARVGDLEVDDGVDPDDEVVLGDDRLGREADHLFPQVDPLPDPVDDRQHDRQARRQRAVVAPETLDHHRPGLRHDPHGPRQEDQDHQCRDRGGDDSAHVHSSSSRRAVSPRSTSSCTITWAPSTRSTRTVAPISNSSVAGYDRADQTSPASRTRPVDPSTRSRTTAGVPTRASVPVRSTGPLVRWRRATGRRPNVSPPAATANPTSCTIRSAPRTARPAPTSAASANMTRTRSSVSNSPTTSAPATMIHTTSSAMTITLIRSTILRSTKPQWRQWTNRSGFARPQVTDGARAVGFVRMSQVWPGSPYPLGATFDGSGTNFAIFSEVAERVELCLFDAVGAERRIELRERDAFVWHAYLPTVLPGQRYGYRVHGPHDPARGHRCNPNKLLLDPYAKAVDGEVDWNQAVFGYDFGDPDSVNTTDSAPHMMKSVVISPFFDWNGDRPPRRPYSETVIYEAHVRGLTMRHEGLPEEYRGTYAGVAHPVMIEHYRRLGVTAIELLPVHQFVHDEHLVSRGLRNYWGYNSIAFLAPHNGYSAAGGDGRQVQEFKGMVRNLHEAGIEVILDVVYNHTAEGNHMGPMLCFRGIDNAAYYRLVDDDPQYYMDYTGTGNSMRVRHPHVLQLIMDSLRYWVTEMHVDGFRFDLAATLAREFYDVDRLSSFFDLVQQDPVVSQVKLIAEPWDLGEGGYQVGNFPPLWTEWNGKYRDTVRDFWRGQDHGIAEFASRLTGSSDLYEDSGRRPWASINFVTAHDGFTLHDLVSYNDKHNEANGEENRDGSDDNRSWNCGVEGPTDDVAVNRLRDAQTRNLLATLLLSQGVPMLVAGDEMGRSQQGNNNAYCQDSPISWLDWSDAERNAGLIDFTAQLSHLRRTHPVFRRRRFFQGESIRGSAGGEDNTGSRPDGAAVVDLAAKDIVWLRPDGSEMSDTDWESGTARSLGCFLNGHGIPDPNTLGEAIVDDSFLLFFNAHHEPIQFRVPPVDFGTTWEIIVDTRSSSAEISAVLGGTDLDPVDVDRVVKAEDPLEVDARATLVLRRVN

SEQ ID NO: 12694 - protein, 301 aa, Hordeum vulgare
LDADLESDALGWQYISGSLPDGRELDRIDNPQFEGYKFDPYGEYVRRWLPELARLPTEWIHHPWDAPESVLQAAGIELGSNYPLPIVELDEAKSRLQDALSEMWELEAASRAEIENGMEEGLGDSSDEPPIAFPQELQHMEVDRATSHTPATAGPARRRADQMVPSITSSLVRAETETELSAVFESEVSRPEVPSQVHFQAQPRMESREQVASDGTAARYNQQYTLHRVQGGGIAPSTSEASSSWTGREGGVVPVWSPPAASGHSDPYAADETDISSRSYLDRNPQSHNRLMNWNQLSQSS

SEQ ID NO: 12695 - protein, 304 aa, Hordeum vulgare
DTLLDADLESDALGWQYISGSLPDGRELDRIDNPQFEGYKFDPYGEYVRRWLPELARLPTEWIHHPWDAPESVLQAAGIELGSNYPLPIVELDEAKSRLQDALSEMWELEAASRAEIENGMEEGLGDSSDEPPIAFPQELQHMEVDRATSHTPATAGPARRRADQMVPSITSSLVRAETETELSAVFESEVSRPEVPSQVHFQAQPRMESREQVASDGTAARYNQQYTLHRVQGGGIAPSTSEASSSWTGREGGVVPVWSPPAASGHSDPYAADETDISSRSYLDRNPQSHNRLMNWNQLSQSS

SEQ ID NO: 12696 - protein, 615 aa, Nicotiana tabacum
MMMFEEMGFCGDLDFFPAPLKEVETAASQIEQESEPVMDDDYSDEEIDVDELERRMWRDKMKLKRLKEMTKGGKEGVDAVKQRQSQEQARRKKMSRAQDGILKYMLKMMEVCKAQGFVYGIIPEKGKPVTGASDNLREWWKDKVRFDRNGPAAIAKYQADNAIPGKNEGSNPIGPTPHTLQELQDTTLGSLLSALMQHCDPPQRRFPLEKGVPPPWWPTGQEDWWPQLGLSKDQGPPPYKKPHDLKKAWKVGVLTAVIKHMSPDIAKIRKLVRQSKCLQDKMTAKESATWLAIINQEEVLARELYPDRCPPLSSAGGSGTFTMNYSSEYDVDGVVDEPNFDVQEQKPNHLGLLMYVDRFKERLPMQQQSLPIKDEIMIANLDFTRKRKPADELTFLMDQKIYTCECLQCPHSELRNGFQDRSSRDNHQLTCPFRNSPQFGVSNFHVDEVKPVVFPQQYVQPKPASLPINQAPPSFDLSGIGVPEDGQRMINELMSFYDNNIQGNKSSMAANVVMSKEQPRQQPSIQQNNYLHNQGIILDGNIFGDTNISANHSMFPQGDRFDQSKVLTSPFNAGSNDNFHFMFGSPFNLQSTDYTEALSGITQDNMPKQDVPVWY

SEQ ID NO: 12697 - protein, 406 aa, Nocardia farcinica
MTSDRRFVIVGGGLAAATLAQELRAADFPDSITLIGAEEHLPYERPPLSKEFLFGKKQLADFTVEPAQWYRDHHVELLLGTTVTGLDPRARTVTLPDGSTLPYDKLALATGSTPRRLPVPGADAPGVYTLRTIDDARALAGLFARGRLAIVGAGWIGLEVAAAARAADCAVTVVETAPQPLMGPLGPEMGAVFADLHRAHGVDLRLGARLDAVTTGADGAVTGLALADGGTVAADAVLMAVGAAPNIALAADAGLAVGTGVLVDASLRTSDPDIVAVGDIAEQAHPRLGGRIRVEHWANALNQPAVAAATMLGRAAEYDRLPYFFTDQYDLGMEYTGYATADRTARVVVRGSLADREFVAFWLDAENRVLAGMNVNVWDVTDRIKELITSATPVDPDRLADPTQPM

SEQ ID NO: 12698 - protein, 615 aa, Triticum aestivum
MAALVTSQLATSGTVLSVTDRFRRPGFQGLRPRNPADAALGMRTVGASAAPKQSRKPHRFDRRCLSMVVRATGSGGMNLVFVGAEMAPWSKTGGLGDVLGGLPAAMAANGHRVMVISPRYDQYKDAWDTSVISEIKVVDRYERVRYFHCYKRGVDRVFVDHPCFLEKVRGKTKEKIYGPDAGTDYEDNQQRFSLLCQAALEVPRILDLNNNPHFSGPYAMLCRAVPRRAGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEIVKEEDVQIVLLGTGKKKFERLLKSVEEKFPTKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGIVGEEIAPLALENVAAP

SEQ ID NO: 12699 - protein, 462 aa, Hordeum vulgare
NTSLLSPYLHFGELSVRKVFHLVRMKQLVWSNEGNHAAEESCTLFLRSVGLREYSRYLCFNHPCSHEKPLLAHLRFFPWVVDESTFKFWRQGRTGYPLVDAGMRELWATGWLHDRIRVVVSSFFVKVLQLPWRWGMKYFWDTLLDADLESDALGWQYISGSLPDSRELDHIDNPQLEGYKFDPHGEYVRRWLPELARLPTEWIHHPWDAPASVLQAAGVELGSNYPLPIVELDTAQVRLQEALSEMWQLEAASRAAMDTGMEEGLGDSSEVPPIEFPQDLQMEVHWEPARVAPNVLTTAQRRQDQMVPTMTTSLNRVETEISADLGNSVDSRAEVPFRMHFEPRTEREEIIQSTGNAVGTNGIHHHNNFQQPQHRMRNIFAPSVSEASSSWTGRDGGVVPVWSPPAASGHSETYGADEADVSSRSYLDRHPQSHRIMNWHQLSQSLTTGRDVENSVQPNYIG

SEQ ID NO: 12700 - protein, 345 aa, Vitis vinifera
MAMFDSTVKSSSRMAILLLVFGLLMASLHLTVAQTGVCYGMEGDNLPPPGQVVGLYNQYSIRRMRLYDPNQAALQALRGSNIELMIGVPNDALQNIASIQGNANSWVQNNIKNYGNVRFRYVAVGNEVSPTGPTAQFVLPAMRNIFNAISAAGLGNQIKVSTAIDTGVLGTSYPPSKGAFKPEVTSFLNPIISFLVKNRAPLLVNLYPYFSYIGNTRDIRLDYALFKAPGVVVQDGQLGYKNLFDAILDAVYSALERVGGGSLQVVISESGWPSAGGTATTVGNAKTYNSNLIQHVKGGTPKKPGGPIETYVFAMFNENRKSPEYEKHWGLFLPNKQAKYPINFN

SEQ ID NO: 12701 - protein, 571 aa, Synechococcus elongatus
MVATTPAPRLSLAVEAIGPQTTTIRSLDWDRSRFDIEFGLQNGTTYNSFLIEADRKALVDTSHAKFQATYVDQLRELTDLSTLDYLIISHTEPDHSGLVGDILAIAPNVTVVGSKVALQFLENQVHRPFQKLQVKNGDRLDLGQGHELEFVSAPNLHWPDTIFTYDPASQILFTCDAFGMHFCDERTFDEDLQQIEGDFQYYYECLMAPNARSVLAALKRMKALGEITTIATGHGPLLRRNLQEWVDRYQHWSEQKATAETSVLIGYLSDYGYSDRLSQAIGRGLVKTGVAVEMVDLRAVDPQELIEAVSSARGIVLGTPPSQPSEAVATALSTIFAAAHNKQAIGLFDSYGGDDEPIDALLAQFRNLGLHTAFPPIRVKDQPTEAIYQQCEESGTDLGQWLTRADAIQTMKSLNSDLDKALGRLSGGLYIITARKGEVSGAMLASWVVQASFKPLGFTVAVAKDRAIESLMQVGDRFVLNILGEDNYAPLMKHFLKRFPPGADRFAGVETQTASNGSPILTAALAYLECEVASRMDCSDHWLVYCQVEQGRVSRADVRTAVHHRKVGNHY

SEQ ID NO: 12702 - protein, 584 aa, Synechococcus elongatus
MSEGRHRDIQPSWVAAGLMVLRARSWERLRFEVEYGLGHGTTSNAYLVQGDRTILINPPGASFTEIFLNRLEAQCPIGELDAVLLSHVNPNRVSTLKELMRLNPGLQVIVSNPAAQALEKLWQVEAQEAPIPPLDLKIIRTEESLDLGRGKVLQLLPTPIPRWPDGLCVLDEQTGWLLSDKFFAAHLCQDQIFDQGWTSFREDQRYYFDCVMAPQVRQVQTVLAKFSRLPIQGYAPSHGPLIRYGLHDLTAAYVSWSDRQLQQPQMVALLYASAYGSTATIAEAIAQGITKAGVRVEALNCEVESMDDIRRTLERCDGVVIGSPTLGGHAPTPIQTALGTILATVARDKPVGVFGSFGWSGEAIDLLESKLKDAGFRLAFEPIRVRFKPTTATLKICEESGTDLAQALQRQRRQVSRQSSSKLQDSETEATAQAVGRILGSLCVLTTQKEDVRSGMLASWVSQATFNPPGISVAVARDRAVESLLHQGDRFVLNVLGEDKNLAIQKHFLKPFSPGADRLEGIESSPSDQGHPILAEAIAWLECRVANRMECGDHWLVYAVVESGQVQDPEVRTAIHHRKSGSYY

SEQ ID NO: 12703 - protein, 459 aa, Bacillus cereus
MIQKQHESKLEVGQTFPVTIKRLGINGEGVGYFKRQVVFIPGALPGEEVVAETTKIQRGFAEAKVKKVRKASPHRVKAPCPVYEECGGCQLQHLDYKEQLNQKRDIVVQAFQKYMNNGLEEKIRPTLGMENPWHYRNKSQLQVGRKDEKVITGLYKQNSHQLIDIAHCMIQHKATNEATKVVRRILEKLNVSIYNEKKQKGLVRTIVTRTAVQTGEVQVTLITTKEELPNKEQFIAEVQKQMPAVKSIMQNVNWRKTSVIFGDKTFKLAGKEVIQETLGDLSFELSARAFFQLNPEQTVVLYNEAKKAAALTGNEKIVDAYCGVGTIGLWLANDAAEVRGMDVIPEAIADARKNAKRHGFTNTKYEAGKAEQWLPKWVKEGWRPDVIVVDPPRTGCDDKLLETILKVKPKQVVYVSCNPSSLARDVQALMKSYEVEYVQPVDMFPHTAHVENVVKLVRK

SEQ ID NO: 12704 - protein, 989 aa, Pichia pastoris
MPEPSISDLSFTSFVTNDDNLFEETFNFYTKLGFHATRSYVKDNRSDFELTGISTDSIKEIWLESFPLSEVVEASGGRELRKPLQESVGYESEALLGYSPYQSGGVVIKLRLSNHDLEKNNDLPGEVTFFTASIDKLKAKLIEIGAEIIPSKIDLVEFSTRDPMGDVISFSSYPSLNSKKITSPDFFLHPKKEVRSEESIVEQVKSEEGKKKIAIITSGGDAPGMNAAVRAVTRAGIFYGCKVYACYEGYTGLVKGGDMLKELQWQDVRGLLSIGGTIIGTARCKEFRERWGRLQACYNMVSNGIDALVVCGGDGSLTGADLFRKEWPELIKELLGEDKITKEQYETHRNLTIVGLVGSIDNDMCGTDSTIGAYSSLERIIELVDYIDATAASHSRAFVVEVMGRHCGWLGLMSGIATGADYIFIPERPPSESNWKDDLKKVCLRHREKGRRKTTVIVAEGAIDDQLNPITSEEVKDVLVEIGLDTRITRLGHVQRGGAPCAFDRFLATVQGVDAVRAVLESTPAIPSPVISILENKIVRQPLVESVAQTKTVSAAIEAKDFDKALQLRDQEFATSYENFLSVSKYDDGSYLVPESSRLNIAIIHVGAPTSALNPATRVATLNSLAKGHRVFAIRNGFAGLIRHGAVRELNWIDVEDWHNTGGSEIGTNRSLPSDDMGTVAYYFQQYKFDGLIIIGGFEAFTALYELDAARAQYPIFNIPMCCLPATVSNNVPGTEYSLGSDTCLNTLSGYCDAVKQSASASRRRTFVVEVQGGYSGYLASYAGLITGALAVYTPENPINLQTVQEDIELLTRTYEEDDGKNRSGKIFIHNEKASKVYTTDLIAAIIGEAGKGRFESRTAVPGHVQQGKSPSSIDRVNACRLAIKCCNFIEDANFQVKHNANLSADERHLRFFYDDGVKTSAVSGKSSVIDDNTSVVIGIQGSEVTFTPVKQLWENETHHKWRKGKNVHWEQLNIVSDLLSGRLSIRTT

SEQ ID NO: 12705 - protein, 54 aa, Arabidopsis thaliana
MGPTFGAMMISGQKAGQLALKALGLPNAIDGTLVGNLSPELVLAAADSAETVDA

SEQ ID NO: 12706 - protein, 585 aa, Raphanus sativus
MCGILAVLGCSDDSQAKRVRVLELSRRLRHRGPDWSGIYQNGGNYLAHQRLAIIDPASGDQPLFNEDKSIVVTVNGEIYNHEELRKGLKNHKFHTGSDCDVIAHLYEEHGENFVDMLDGIFSFVLLDTRDNSFMVARDAVGVTSLYIGWGLDGSLWVSSEMKGLHEDCEHFEAFPPGHLYSSKSGGGFKQWYNPPWFNESVPSTPYEPLAIRRAFEDAVIKRLMTDVPFGVLLSGGLDSSLVASITARHLAGTKAAKRWGPQLHSFCVGLEGSPDLKAGKEVAEYLGTVHHEFHFTVQDGIDAIEDVIYHVETYDVTTIRASTPMFLMSRKIKSLGVKMVLSGEGSDEIFGGYLYFHKAPNKQEFHQETCRKIKALHKYDCLRANKATSAFGLEARVPFLDKEFINTAMSLDPESKMIKPEEGRIEKWVLRRAFDDEERPYLPKHILYRQKEQFSDGVGYSWIDGLKAHAAENVNDKMMSNAAYIFPHNTPLTKEAYYYRMIFERFFPQNSARLTVPGGATVACSTAKAVEWDASWSNNMDPSGRAAIGVHLSAYDGSKVALPLPPHKAIDDMPMMMGQEVVIQT

SEQ ID NO: 12707 - protein, 425 aa, Wolbachia endosymbiont
MMSVLKKICGSKNSLKSFDNEVYQSIEKELQRQKSQLQLIASENFASKAVMEAQGSFLTNKYAEGYPGKRYYCGCEHVDKIESLAIERLCKLFGVKFANVQPHSGSQANQAVFASLLTPGDTILGLSLSCGGHLTHGAAPSLSGKWFKSIQYTVNKDTYLLNMDEIEKLALEHKPKLIIAGASAYPRKMDFKRFREIADKVGAYLLADIAHYAGLIAAGEYPSPAEYAHVMTSTTHKTLRGPRGGIVMTNDEALHKKIQSAVFPGLQGGPLMHVIAAKAVAFKEALAPEFKTYSKKVVENAKVLAQELQKHGLDIITGGTDSHIVLVDLRSQKLTGKDVVDSLERAGITCNKNSVPFDTAKPTITSGLRFGTAAETTRGLEAENFKEIAGLINEVIQGLISGNSSSVEKAVKAKVERICSNFPIY

SEQ ID NO: 12708 - protein, 473 aa, Bacillus cereus
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFSKLSKSGVPIYALIVSTIVGCLSLLSGIYAEDTVYLWLLSIAGFGAILVWASIALSNLLARRAYIKQGGDVKDLKFKTPLYPFVPLLALVLNVTVIVAMAFIPEQRMALYCGIPFMIVCLLFYRATRNKGSNLEHIEKTKTTEIESL

SEQ ID NO: 12709 - protein, 77 aa, Psychrobacter arcticus
MIQIMAKDEIIEFEGEVIDTLPNTLFKVRLENGHEIIAHISGKMRKHYIRILTGDKVKVEMTPYDLSKGRITYRGKN

SEQ ID NO: 12710 - protein, 409 aa, Rhodobacter sphaeroides
MPGVHWIGAFDPGLRSFDTLMKTANGTSYNAYTVRGAAGVAVIDTVHADHAETFFARLEAVARYDEITQIVLNHLEPDHSGALPELLRRAPQAEIRLSPRGLPILRALLRDAFETARILPVTTGAEADLGGRRLRFLTTPNVHWPDTQCTYLVEEGILFTCDLLGSHYCDERLFDDRVGDFRFAMDHYFDRLMRPFRSFVTQALDLIEPLDLTVIAPSHGPVLRTDPRAYLRQYRRLAGPRSAPGPDRTLAILYISAHGATARLAQAIRDGAAGEPGVRVSLFDLEGGELHPFLDLIEEVDGIALGTPTINGDAVRAIWELLAMLVDIETRGKLGAVFGSYGWSGEAVRQVEARLQGLKMRLPEPGLKVKLEPTDEDLQEARAFGRRLAAHLTGRAPPREVDLADLASR

SEQ ID NO: 12711 - protein, 328 aa, Magnaporthe grisea
MGKAEFGTTKHLSNQMKAKGLQRLRFYCTPCQRQMRDDNAFKQHCMSESHVRNMLIVGEDPKKYIREYSEAFLKDFVNLLKTGHRDKQVQINHFYQEYIANKEHVHMNSTQWSSLTEFAKYLGKEGICRVEENEKGIHISWIDDSPEALKRQEALKRKEAQDRGDEEREQRLLKEQIKRAQKDAAARAAGENGASTEQDQEDKGLRREEGEKIKLSIGVKPAASKPEPAPVEQPAAATLDEETPATGEAKLAEATTDSKPVSLKFGAKPAAKNVFASKKNAFSSGAKKVKIEQPKKISEAERIMREEMGRKRSREFSGSGGPSKRQRM

SEQ ID NO: 12712 - protein, 414 aa, Alkaliphilus metalliredigenes
MMTNLMEQCKVLQNASKQLSSMNTKDKNEALRQVAISLQKNESFIIQENQKDVENAEAKGMKESLVDRLRLTKDRVEGMIKGIQTIIELKDPVWKSNEVWTLENGLTVSKMTVPIGVIGIIYESRPNVTVDAFCLTLKSGNGVLLRGSSTSIFSNRALVHAIKEGLKNSDVSEAVISLIDDPDRGLVKEMLTLNEYIDLIIPRGGKELIDFVVKNATVPTIETGVGNCHIFVDESANIDEAVDIIENAKVQRPGVCNACETVLIHEKIAKDLLPKVSGRIGKQVEIRGCQHTQSLIGGKLAIEDDWAEEFLDYIVAVKVVPNVDEAIEHINHFGTKHSEAILTENLSHANQFLRQVDAAAVYVNASTRFTDGSEFGLGGEMGISTQKIHARGPMGLNELVTVKYTIVGNGQIRK

SEQ ID NO: 12713 - protein, 585 aa, Hordeum vulgare
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYVGWGIDGSVWISSEMKGLNDDCEHFEIFPPGHLYSSKEGGFKRWYNPPWFSEVIPSVPYDPLALRKAFEKAVTKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHTESNVTDKMMSNAKFIYPHNTPTTKEAYCYRMIFERFFPQNSAILTVPGGPSVACSTAKAVEWDARWSGNLDPSGRAALGVHLSAYEQEHLPATIMAGTSKKPRMIKVAAPGVAIES

SEQ ID NO: 12714 - protein, 340 aa, Streptococcus thermophilus
MRNIPKSVTLKAWRCKYLVKGVLKMSNPNNHVIYLAGGCFWGVEEYFSRVPGVLDAVSGYANGSSETTRYELISQTGHAETVQVTYDAGKVTLREILLHFFRIINPLSKNKQGNDVGTQYRTGVYYTDVNDLPIIEKVFQEMSEQYGQPLAVELLPLQHFIPAEEYHQDYLKKNPNGYCHINVNQAVNPVIDSSSYHKPSQEELKVSLSPAAYAVTQENRTERAFTSPLWNHFEPGIYVDVVTGEPLFSSRDKFYSACGWPSFSRPISPEVANYKEDHSHNMDRIEVRSRVGDSHLGHVFPDGPSDKGGLRYCINGVATRFVPKADMEKEGYAYLLDQVD

SEQ ID NO: 12715 - protein, 153 aa, Oryza sativa
  misc_feature (27)..(27): Xaa can be any naturally occurring amino acid
MAPKAEKKPAAKKPAEEEPAAEKAEKXPAGKKPKAEKRLPAGKGEKGSGEGKKAGRKKGKKSVETYKIYIFKVLKQVHPDIGISSKAMSIMNSFINDIFEKLAAEAAKLARYNKKPTITSREIQTAVRLVLPGELAKHAVSEGTKAVTKFTSS

SEQ ID NO: 12716 - protein, 414 aa, Unknown
  Polaromonas sp. JS666
MYHRNILVEQTDPEIFAAIQAENARQEHHIELIASENYASPAVMAAQGSQLTNKYAEGYPGRRYYGGCEYVDVAEQLAIDRIKQIFGADAANVQPHCGASANEAVFLAFLKPGDTIMGMSLAEGGHLTHGMALNMSGKWFNVVSYGLNDKEEIDYDAMERKAHETRPKLIIAGASAYSLRIDFERFAKVAKAVGAIFMVDIAHYAGLVAAGVYPNPVPHADVVTSTTHKSLRGPRGGIILMKAEHEKAINSAIFPGLQGGPLMHVIAAKAVAFKEALSPEFKTYQQQVLTNARIVAETLTQRGLRIVSGRTESHLMLVDLRAKGITGKEAEAVLGSAHMTINKNAIPNDPEKPMVTSGVRIGTPAMTTRGFKDEEARVTANLIADVLDNPRDAANIEAVRAKVNALTSRFPVYR

SEQ ID NO: 12717 - protein, 440 aa, Gibberella zeae
MPSATGSNWEKYQKNFADDEVEEKKITPLTDEDIQVLKTYGAAPYGTSIKKLEKQIKEKQQSVDEKIGVKESDTGLAPPHLWDIAADRQRMSEEQPFQVARCTKIIADEKGDESKSKYVINVKQIAKFVVQLGERVSPTDIEEGMRVGVDRNKYQIMLPLPPKIDASVTMMTVEEKPDVTYGDVGGCKEQVEKLREVVEMPLLSPERFVNLGIDPPKGALLYGPPGTGKTLCARAVANRTDATFIRVIGSELVQKYVGEGARMVRELFEMARTKKACIIFFDEIDAIGGARFDDGAGGDNEVQRTMLELITQLDGFDARGNIKVMFATNRPSTLDPALMRPGRIDRKIEFSLPDLEGRANILRIHAKSMSVERDIRWELISRLCPNATGAELRSVCTEAGMYAIRARRKVASEKDFLSAVDKVIKGNLKFNSTATYMQYN

SEQ ID NO: 12718 - protein, 450 aa, Alkaliphilus metalliredigenes
MSGIRFDYSKASGYINTHELDYLGKMTETAHQLLHEKTGAGNEFLGWLDLPKNYDQDEFQRVQNCAEKIKNDSDVLIVIGIGGSYLGSRAAIEMLTHTFHNSLPKDKRQGPEVYFAGHNISSTYLKHLLDIIEGKDISLNVISKSGTTTEPALAFRVLKEYMEKKYGKEETTKRIYATTDQAKGALKQLADEEGYESFIIPDDVGGRFSVLTAVGLLPIAAAGINIEEVMQGAKQALQDFNHSNIDKNSCYQYAIVRNALYRKGKTTEIMVNYEPALHYIGEWWKQLFGESEGKDQKGIFPASVSFSTDLHSMGQYIQEGMRNIFETVLHVENTQEKMIIQPTDADLDGLNYLAGKTVDFVNEKAFEGTLLAHTDGGVPNLIIHIPEITPYYFGYLVYFFEKACAISGYLLGVNPFDQPGVEAYKKNMFALLGKPGFEEAQRELQKRLEK

SEQ ID NO: 12719 - protein, 602 aa, Chlorobium tepidum
MAYYKNICFVEAPQAMVTPFPRYISDCIGVCYLAAAVEDIVESMAMPENYYNDGIFESFEKLLKSRPFDLVAISSMTGGFNNAERLARIAKKHGVTVVMGGFHPTALPEQVLDLGCVDLVVIGEGEATFRELVEKGPSRDVKGLCWKENGVFVHTGIRELIKDVDSIRFPLRSLRPKRFGETSENYTIDTIYTSRGCPWTCSFCANDKMHKHWRGRSAENVVDEIAQLHDRKKKKLLKIWDANFLTNIRRVEKICDLMIERGLTNFRIVTETRAKDVIRAERILPKLRKIGLSKVGLGIESPNPKTLELMNKENSLAEVTTAINLLNQYGVGSEGYFIIGHYSESVEDTMPYPKFARALGLRQTLFMAMTPYPGTRIFDEYARENNVTSFDWDLYNNFVPVIRTAHMENRDIMRMMVYGNVAFCDYRSVLKRDDNRGVLLTFLKDLFQLVFLLKVNKTLDRKEASQIVFEAFELWLGTNPALDYTRTPPPPPLKESTGVCLEHAASGKRIDFVVEQAGDRRVLKLRKVAASEPAPFPAVSLDEVVDAAFSLSMDALMRLLYRNELMRNNPRLTPRQVLALFADRDIRQVAMRFWRLYRGCFK

SEQ ID NO: 12720 - protein, 539 aa, Chlorobium tepidum
MHCDQCQESIKGGCNVRGVCGKDELTAKLQDTLIYAAEGIALCAEGFEGKIDRKYGQFISECLFVTVTNTNFDDVAIVEQIRKALAMRDEVRALAGTTPAHDAANWSGSTKEEFLAKAAACSIDSLSADPDLRSLKSLILYGIKGLAAYTDHAAVLGYHDDDIYAFYVKGLSALTKELPADELLGLVMECGATAVKAMALLDKANTETYGNPEITTVKTGVGTRPGILISGHDLRDMEDLLKQTEGTGVDVYTHCEMLPAHYYPAFKKYDHFVGNYGNSWWSQDREFESFNGPILMTTNCIVPVRESYRGRMFTTGMAGYPGLKHIPARPDGGSKDFSEIIELAKTCKPPIEIENGEIVGGFAHTQVLALADKVVDAVKSGAIRRFVVMAGCDGRHNSRQYYTDVAETLPKDTVILTAGCAKYRYNKLELGDIGGIPRVLDAGQCNDSYSLAVIAMKLQEVFGLENINDLPISYDIAWYEQKAVTVLLALLFLGVKGIRLGPTLPEFLTPNIATTLVKLFDLKPIGTVEADVEAMMAGN

SEQ ID NO: 12721 - protein, 429 aa, Debaryomyces hansenii
MSGASDFLSKGIDLVQKAIDADTATRYEEAYKLYYNGLDYLMLALKYEKNQKSKELIKSKFTEYLTRAEQLKDHLEKQAKSNTAEGSSDGSTKAKKSGDGDDDDTKKLRGALAGAILSETPNVKWDDIAGLESAKEALKEAVILPVKFPQLFTGNRKPTSGILLYGPPGTGKSYLAKAVATEAKSTFFSVSSSDLISKWMGESERLVKQLFTMARENKPSIIFIDEVDALCGPRGEGESEALRRIKTELLVQMNGVGNDSNGVLVLGATNIPWQLDAAIRRRFERRIYIALPEAEARTRMFEINIGTVPCECSGQDYKMLADMTEGYSGHDIAVVVRDALMQPIRKIQQATHFKTVMTEDGEEKLTPCSPGDEGAREMGWQEIDTDELKEPELTIKDFIKSIKNNRPTVNQSDIGNHTKFTEDFGQEGN

SEQ ID NO: 12722 - protein, 157 aa, Unknown
  Synechococcus sp. WH 8102
MAISVSNVTVTTPDGSSKSLGDYSGKVLLIVNVASRCGFTKQYAGLQGLNAAYADKGLAVLGFPCNDFGAQEPGSLEEIKSFCSTTYGADFELFEKVHAMGSTTEPYSTLNQMDPTGDVAWNFEKFLVGKDGTVIARYKSGVDPEELKAPIEAALAA

SEQ ID NO: 12723 - protein, 505 aa, Vitis vinifera
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGQPFYSQMMNAFRQLRRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLGGELHPPPIGIKAGALSLFAVMGVPLAITYSIPFALASIFCHSSGAGQGLSLGVLNLAIVVPQMMVSVASGPWDARFGGGNLPAFVVGAFAAALSGVLALTMLPAPPPDVPNTKDERTQPSS

SEQ ID NO: 12724 - protein, 351 aa, Mycobacterium smegmatis
MSDVESSTRIARLTVTEVIDESHDARSLVFAVPDEHRDHFGYRPGQFLTLRIPSERTGSVARCYSLASSPHTDDAHKVTVKRTDGGYGSNWLCDNVSVGSTIESLPPSGVFTPASLDDDFLLWAAGSGITPVMSILKSVLSAGSGRVILCYANRDERSVIFAAELRELAARHAGRLTVLHWLESVQGLPTRAQLCGFAQLFSGYESFICGPEPFMAVVRAALTEAGVPRRRIHLEVFQSLSGDPFAEDVPASGPAGPGTDAGAAEAEIELDGTVHQLRWPRDRNLVDTMLAAGVEVPYSCREGSCGSCAATVLDGEIERGDTPILDAQDIADGLFLACQARPVSDRIRIEF

SEQ ID NO: 12725 - protein, 144 aa, Triticum aestivum
MAASTAAVLSPPTVAGLRLAPSPRAAVSFRGASSSAARRSVAARAALEPSVVISLSTGLSLVMGRFVFFNFQRENVAKQVPEQNGKTHFEAGDERAKEFAGILKSNDPVGFNLVDVLAWGSIGHIVAYYILATTSNGYDPPFFG

SEQ ID NO: 12726 - protein, 361 aa, Dehalococcoides ethenogenes
MKAIILVGGQGTRLRPLSINTPKSMVPVLNVPFLSHVLRYLSSCGIKDIILTQGHLAAPIEQYFGNGQSLGVNLVYSVEHEALGTAGAIKNAERYLDDTFITLNGDIFTHLDLSAMLRAHRDKKALVSIALTPVDDPTKYGLVETADGGRVSRFLEKPSPAQITTNMINAGTYIIEPEVLKYIPAGENHSFERQLFPRLLNECQAVYAYPSSAYWIDIGSPEKYSQLNRDLLCGEGGDFGFSRGNEIVIGRGCQLHPTARISGPVLVGENCIIGANACIAGPVVIGAECRIEDEATLTESVIWQNVTIGAECKVVSSIIANHCHLKAGGKYENVVLGDNVTAECGCAPEPGSKISPGILMI

SEQ ID NO: 12727 - protein, 407 aa, Vibrio cholerae
MQDTLAVILAGGMGSRLSPLTDDRAKPAVPFGGKYRIIDFTLTNCLHSGLRRILVLTQYKSHSLHKHLRNGWSIFNPELGEFITVVPPQMRKGGKWYEGTADALFHNMWLLARSDAKYVVVLSGDHIYRMDYAAMLEEHISKNATLTIACMQVPRHEASAFGVMAIDDDSRITCFVEKPADPPCIPNRPDHSLASMGIYIFNMDVLKKALTEDAEIEQSSHDFGKDVIPKLIATGSVFAYSFCSGKGRVARDCYWRDVGTIDSFYDANMDLLQPVPPMNLYQKNWAIRTYEQQYPPARTVSSATGNEGIFINSIIANGVINSGGSVQHSIISSNVRINDSALIVDSILFDDVEVGEGCKLIHCIIDKHVKIPPYTEIGLNPIEDRKRFHISERGVVVVPESYQFSTE

SEQ ID NO: 12728 - protein, 488 aa, Unknown
  Synechocystis sp. PCC 6803
MGRQLILFPMSDQSDHPLILLWHRRDLRLNDHLALAKARQKTAKIVGVFCLDNKILQAEDMAPARVAYLLGCLQSLQDHYQRLGSELLVFQADPVQLLPKLANTLGAHGVTWTLDTEPYAQKRDLAVAQALRERGLAIATEWDQLMHHPGEVLTQAGSPYTVYTPFWKNWSQLPKTSPVPTPKDLQGLTPAEKEKLAPLEPLAIPQLADLGFIWDQPLPLTPGEEAAEQRLDWFVAHGLEEYQQNRNFPALDGTSQLSAALKFGVISPRTLWQTTLEAWEQSRSEEARASIETWQQELAWREFYQHCLYSFPALAQGPYRSPFQEFPWEENQDHFQAWCEGRTGYPIIDAAMAQLNQTGWMHNRCRMIVASFLIKDLILNWQWGELYFMQTLYDGDLAANNGGWQWSASSGMDPKPLRIFNPHTQAQKFDPEGEYIRTWLPQLARFDTGDLLTGKLTPGSRRSVNYPEPIVDHNQQQREFKRRYQLVK

SEQ ID NO: 12729 - protein, 181 aa, Misopates orontium
MAAKVSSDPLVIGRVIGDVVDHFTSSVKMSVIYNANNSVKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAIMSPPLVTRDGFNTRKFTQENELGLPVAAVFFNCQRETAARRR

SEQ ID NO: 12730 - protein, 246 aa, Herbaspirillum seropedicae
MSVTMREMLEAGVHFGHQTRFWNPKMAPFIFGHRNKIHIVNLEKTLGMYQEAQKYVRQLSANRGTILFVGTKRQAREILAAEAQRAGVPYVDQRWLGGMLTNFKTIKTSIKRLKDMEAAVEDGSVEKLSKKEALLFSREQEKLQKAIGGIKDMGGIPDAIFVIDVGYHKGAITEAAKLGIPVIGVVDTNHSPEGVTYVIPGNDDSAKAIALYARGMADAVLEGRANAVNDVVEAVKGDEFVEVEQA

SEQ ID NO: 12731 - protein, 413 aa, Leuconostoc mesenteroides
MNAVEEIGKRAKLVTSDVANLAVDIRNQILLDMSSALVANWQEIVAANKKDLDAATQLSGPMRNRLTLDQKTIGGIAASLSAVAKLADPLAGPYDNWKNHTGFKIVKKTVPLGVVAMIFEARPNVTVDAAALTFKSGNAVILRGGKEAIESNIILTNILRNVLRKHNLNPDIIQLITDTTHDSVNTLLNLRDYVDVLIPRGSGQFIDFVVKNATVPVIETGAGNTHIFVDESAKQDEAIRVIHNAKTQKPAVCNAAEKLLIHEAIAGEFLPKIVDDLLAAGVELRGDQKARSIDSRVIGASAEDWDTEYNDLIMAIKIVHNNDEAITWINDHTTHHSETIISEDLNHVTDFMNTVDAAVVYQNVSSRFTDGFEFGFGAEIGISTQKLHARGPMGLSALTTIKYEVFGEGQIRE

SEQ ID NO: 12732 - protein, 409 aa, Unknown
  Frankia sp. EAN1pec
MWWLRRDLRLDDNPALLAAAESGRVLALFVLDDALRRPSGPVRLAFLHRCLRDLDAQLGGRLCVRTGSPYAVAPGRLRKADGTSYRVFTPFYRAWKEHGWRGPAIPADPVWLQPADLDGGSEPIPADPELGGTELPPAGEHAAHERLRAFLTESLAGYAAHRDEPAAASESGDAVPGWSGASRAGGAGGAGGAGGADAAGGGGGLAGSAEKFRSELAWREFYADVLAGTPSSARTDLTDTLAALAYEPPGDTFEAWKWGRTGYPIVDAGMRQLLAEGWVHNRVRMIEASFVCKDLNVHRTHGARWYLERLVDGDLASNNHGWQWTAGTGTDAAPYFRVFNPVSQGRKFDPAGEYIRRWVPELRGLPPDAVHEPWKLPAGPPNGYPRPVVDHAVERREALDRHARARHHD

SEQ ID NO: 12733 - protein, 214 aa, Solanum lycopersicum
AAGRKPSLNISIPSVKKTEEPKTGEVKTGEPKTEEPKTGEVKTEYSVKEKMVENSEKKRYRGVRQRPWGKFAAEIRDPTRKGTRVWLGTFDTAMDAAMAYDRAAFRLRGSKAILNFPLEVSNFKQENHEIEKNVVNLNSNTNSCGKRVRREMENDDGIVMKKEVKREQMVATPLTPSNWSSIWDCGNGKGIFEVPPLSPLSPHSNFGYSQLLVS

SEQ ID NO: 12734 - protein, 359 aa, Oryza sativa
MYHLGVPGLQEFGTRVPAPPPDAISRSGGNDPDDDLNLMDPDGNDLKPDDTSAELGTLNDALQELLDGIQEDFYAVVDWAYKIDPLRCISMHGITERYLSGQKADAAGFVRRLLHDLESRISTQFSRFIDEACHQIERNERNVRQTGILAYIPRFAVLASRMEQYIQGQSRDLIDKAYTKLVSTMFTTLDKIAHSDPKTADIVLIENYAAFQNSLYDLANVVPTLAKFYHEASESYEQACTRHISSLIYLQFERLFQFSRKVDELTYTIAAEEIPFQLGLSKTDLRRVIKSSLSGIDKSIGAMYRRLQKTLTSDELFPSLWDKCKKEFLDKYESFVQMVTRIYGNEPIMSVADMKDVPC

SEQ ID NO: 12735 - protein, 1029 aa, Arabidopsis thaliana
MKLDEEFLHDRDHSFLTDDEENQAALACSDDEHDGDDDGRRGGENSDSSSPLSRDRSDNNLSDVSNPPWPQSYRQSMDLLTGMTPPSVSFMPQSSSRRLASSFQKKQQSSFCDSLSSSSSKPLLSQPVPDKEETILPVNPQSQLKLSVTDLPLPEPNLCSFSQSVLNGTNVLCGLGLITMPYAIKESGWLGLPILLFFGVITCYTGVLMKRCLESSPGIQTYPDIGQAAFGITGRFIISILLYVELYAACVEYIIMMSDNLSGLFPNVSLSIASGISLDSPQIFAILTTLLVLPTVWLKDLSLLSYLSVGGVLASILLGICLFWVGAVDGIGFHATGRVFDLSNLPVTIGIFGFGYSGHSVFPNIYSSMKDPSRFPLVLVICFSFCTVLYIAVAVCGYTMFGEAVESQFTLNMPKHFFPSKVAVWTAVITPMTKYALTITPIVMSLEELIPTAKMRSRGVSILFRTMLVTSTLVVALSVPFFAIVAALIGSFLAMLVALIFPCLCYLSILKGKLSNTQIGLCIFIIVFGVTLGVYKWLNLYCPHRPNSHGKSIDETKPQTQFFARNTNLSIQNIVIMFSRFHALFLLLVLSVRTYKCVSSSSSSSSSFSFSSFSSSSSSQTLVLPLKTRITPTDHRPTDKLHFHHNVTLTVTLTVGTPPQNISMVIDTGSELSWLRCNRSSNPNPVNNFDPTRSSSYSPIPCSSPTCRTRTRDFLIPASCDSDKLCHATLSYADASSSEGNLAAEIFHFGNSTNDSNLIFGCMGSVSGSDPEEDTKTTGLLGMNRGSLSFISQMGFPKFSYCISGTDDFPGFLLLGDSNFTWLTPLNYTPLIRISTPLPYFDRVAYTVQLTGIKVNGKLLPIPKSVLVPDHTGAGQTMVDSGTQFTFLLGPVYTALRSHFLNRTNGILTVYEDPDFVFQGTMDLCYRISPVRIRSGILHRLPTVSLVFEGAEIAVSGQPLLYRVPHLTVGNDSVYCFTFGNSDLMGMEAYVIGHHHQQNMWIEFDLQRSRIGLAPVECDVSGQRLGIGS

SEQ ID NO: 12736 - protein, 540 aa, Unknown
  Shewanella sp. MR-7
MSELTWWRGAVIYQIYPRSLLDTNGDGVGDLRGIITKLDYIASLNVDAIWISPFFKSPMADFGYDISDYREVDPLFGSMQDFDELIEKAHQRGIKVIIDQVLSHTSDQHAWFIESRESRTNPKADWYVWADPKEDGTAPNNWLAIFGGCAWEWEPRRQQYYLHNFLRSQPDINFHNPEVRQAVLDNVEFWLKKGVDGFRLDAITFCYHDEQLRDNPAKPKDKRQGRGFSEDNPYAYQYHYYNNDRPQTILFIEELRQLINRYPGAVTLGEVSAEDSLAVMAAYTKGEDRLHMAYSFELLTDDYSAAYIRQTVEALEASIGDGWPCWAIGNHDVQRVASRWGRGKQTHDMVKMLNAMLSSLRGSVCNYQGEELGLTEAPIEYHELQDPFGKTFWPMFKGRDGCRTPMPWEQHADFSGFSQVTPWLPVANAHRALAVDVQEADPASMLQGYRQFLAWRKGYPILIEGEIEFLDAPEPLLVFVRTLGEQKLLVCFNLLDTETQWVLDKLSIQQELTGHGLKTAQRVADTLTFSAYACFYALLN

SEQ ID NO: 12737 - protein, 110 aa, Thermus thermophilus
  misc_feature (1)..(1): Xaa can be any naturally occurring amino acid
  misc_feature (36)..(36): Xaa can be any naturally occurring amino acid
  misc_feature (67)..(67): Xaa can be any naturally occurring amino acid
  misc_feature (72)..(72): Xaa can be any naturally occurring amino acid
XAKPIEVTDQNFDETLGQHPLVLVDFWAEWCAPCRXIAPILEEIAKEYEGKLLVAKLDVDENPKTAXRYRVXSIPTVILFKDGQPVEVLVGAQPKRNYQAKIEKHLPATA

SEQ ID NO: 12738 - protein, 684 aa, Fulvimarina pelagi
MIKITAEYGCPERLGATPTGDGTHFAVVSENADAIELSLFDEFGTREVARLTLPGAEGIVRYGFVRGLNAGTRYGFRAHGPYAPHEGHRFDPSKLLVDPYAVQLDRPFQFHPVLKAPPAHRYDTAPLMPKAIVTDLFRDGEPMAFRAPGFTYEILVRAFSQLHPEIPDQFRGTVSALAEKPLLDHLERIGIETVELMPLAAWIDEEHLVRLGLTNAWGYNPITHMALDPRIVPGGFPELRRVVDALHRRGIRVILDVVLNHSGEGDENGPTLSYRGLDNKLYYAHETDDPGKLVNHTGCGNMFAVWRDPVMKLSIDTLRTFVEAAGIDGFRYDLAPVLGRLPTGFDVNAPFLQEVAIDPVLKDRIHVAESWDIGPGGYQVGQFPSHWFEWQDRFRDGVRRFWRGDAGAVADLATRLAGSADIFNQFGRRPSSSVNFVAAHDGYALADLTAYKLKHNQANGEHNRDGHGDNFSWNSGVEGETEDEAILSARRRDLRALLTTLFVSRGTPMIVAGDEFGRTQRGNNNAYCQDNEITWLDWSKADKNLIALTGQLAQLRREHPALCVDSFLTGENAGGQMEDVIWLREDGQRMYDQDWSDPSRRFLGMSVYEPKAADGHESERAIVYLNASTDDVETTLPSPRPGHLLRLALQSDWPDLEPRILKAGEGLVVKARSVFVLVEEVAAP

SEQ ID NO: 12739 - protein, 436 aa, Prochlorococcus marinus
MANIFEVPQPGNDLLEKANKVRLASIEISQTENQNRIKALNFMADYLEKNSYEILDANNADYSSAQKKGISRALLSRLKLSKLKLNSGIEGVRKVGDLADPVNQVQIKRELSKGLFLERKTVPIGVLGVIFESRPDAVMQISSLAIRSGNGVMLKGGSEANLTNTAIVKALQEGLNASGLDKNAICLLTSRKDSMAMLNLEKYINLIIPRGSNELVKFIQENTRIPVLGHADGICHLFIDIEANLEMALSVALDSKIQYPAACNAIETLLLHKDIAPTFLEKAIPLFKSNDVKLIGDMRSVELGVKYEASLEDWKTEYLDLILSIKIVDDLEEAITHIQKYSSKHTDGIITENSHTANKFMNVIDSAGVFHNCSTRFADGFRYGFGAEVGISTQTLPPRGPVGLEGLVTYKYFLKGDGNIVDDFSSGKAIYTHKDL

SEQ ID NO: 12740 - protein, 430 aa, Gibberella zeae
MGQTLSEPVVEKTSEKGEDERLIYGVSAMQGWRISMEDAHTTVLDLDTAKTHDSKLSFFGVFDGHGGDKVALFTGQNIHNIIFKQDTFKSGDYAQGLKDGFLATDRAILNDPKYEEEVSGCTACVSLIAGNKLYVANAGDSRGVLGIKGRAKPLSQDHKPQLENEKNRITAAGGFVDFGRVNGNLALSRAIGDFEFKKSAELSPENQIVTAYPDVEQHDLTDEDEFLVLACDGIWDCQSSQAVVEFVRRGIAAKQELEKICENMMDNCLASNSETGGVGCDNMTMCIIGFLNGKSKDEWYEEIARRVANGDGPCAPPEYAEFRGPGVHHNFEDSDSGYEMDPENKGRSFGVGGYRGRIIFLGDGTEVLTDSDDTEMFDNADEDKDLASQVSKNPTSAEKDTAPVAAPGAAENASADTKPADSAKTEVKKE

SEQ ID NO: 12741 - protein, 396 aa, Arabidopsis thaliana
MFAQGSLPFLSLTGVSPNTHSRRGARFTVRADTDFYSVLGVSKNATKAEIKSAYRKLARSYHPDVNKDAGAEDKFKEISNAYEILSDDEKRSLYDRYGEAGVKGAGMGGMGDYSNPFDLFESLFEGMGGMGGMGGGMGSRGSRSRAIDGEDEYYSLILNFKEAVFGIEKEIEISRLESCGTCNGSGAKAGTKPTKCKTCGGQGQVVASTRTPLGVFQQVMTCSPCNGTGEISKPCGACSGDGRVRRTKRISLKVPAGVDSGSRLRVRGEGNAGKRGGSPGDLFAVIEVIPDPVLKRDDTNILYTCKISYVDAILGTTLKVPTVDGEVDLKVPAGTQPSTTLVMAKKGVPVLNKSKMRGDQLVRVQVEIPKRLSKEEKMLVEELADMSKNKVANSRR

SEQ ID NO: 12742 - protein, 156 aa, Glycine max
  misc_feature (69)..(69): Xaa can be any naturally occurring amino acid
VPSLVKFLTPASGLQGYWDPYPIDMEFRPPCMVLSTIGISKPGKLEGQSTSQCATHLHQLHVCLPSSKXKQTRLLYRMSLDFAPVLKHIPFMQHLWRYFAEQVLNEDLRLVLGQQERMNNGANVWNFPVSYDKLGIRYRLWRNALERGNKQPPFSK

SEQ ID NO: 12743 - protein, 189 aa, Mycobacterium smegmatis
MTTHTAVLAGGCFWGLEDLIRALPGVISTRVGYTGGDNDHPTYRNHPGHAEAVEITYDPQQTDYRALLEFFFQIHDPTTKNRQGNDVGSSYRSAIFYLDDDQKRVAFDIVAEIDASGRWPGPVATEVTPAGVFWEAEPEHQDYLQRNPGGYTCHWVRPEWILDPEADPETASDSGSDVSAASATASHHD

SEQ ID NO: 12744 - protein, 223 aa, Zea mays
MVDFVRRLASALLKCCDLDIPNRPKGLEDPERLARETVFNVNEIEALYELFKKISSAVVDDGLINKDEFQLALFKTNRKDSMFADRVFDLFDTKHNGILEFEEFARALSVFHPSAPIDDKIDFAFKLYDLKQQGFIEKQEVKQMVVATLAESGMNLSDDIIEGIIDKTFEEADTKHDGKIDKEEWRSLVLRHPSLLKNMTLPYLRDITTTFPSFVFNSQVEDA

SEQ ID NO: 12745 - protein, 461 aa, Burkholderia thailandensis
MTSRDERLHRGLEERHINLMALGATIGVGLFLGSATAIRAAGPAILLTYMLGGIAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAHGGFLPNGLAGVVDALPIVMFAYLGVEMLGLTAGEARNPEKSLAKAVNSVFWRVVIFYVGALFVIMSIYPWSQIGTQGSPFVMTFSRLGIPAAAGIINFVVLTAALSSCNSGIFSTARMLFNLAEQGQAPERLASVNRRGVPVHGVLISVALLFVGVALNYYAPQKVFVWLTSVSTFGAIWTWCVILIAQLRFRRRVSAERLARLPLRVPLYPMSSFVALAFLAFVVVLMAFSPDTRVALVIGPLWIAALTVYYHLSQAGRRAPLGAPTDG

SEQ ID NO: 12746 - protein, 507 aa, Oryza sativa
MGKAAAVGTAVVVAAAVGVAVVLARRRRRRDLELVEGAAAERKRKVAAVIEDVEHALSTPTALLRGISDAMVTEMERGLRGDSHAMVKMLITYVDNLPTGNEQGLFYALDLGGTNFRVLRVQLGGKEKRVVQQQYEEVSIPPHLMVGTSMELFDFIASALSKFVDTEGDDFHLPEGRQRELGFTFSFPVSQTSISSGTLIKWTKGFSINDAVGEDVVSELGKAMERQGLDMKIAALVNDTVGTLAGGRYADNSVVAAIILGTGTNAAYVENANAIPKWTGLLPRSGNMVINTEWGSFKSDKLPLSEFDKAMDFESLNPGEQIYEKLISGMYLGEIVRRILLKLAHDAALFGDVVPSKLEQPFVLRTPDMSAMHHDSSHDLKTVGAKLKDIVGVPDTSLEVRYITSHICDIVAERAARLAAAGIYGVLKKLGRDKMPKDGSKMPRTVIALDGGLYEHYKKFSSCLESTLTDLLGDDVSSSVVTKLANDGSGIGAALLAASHSQYAEID

SEQ ID NO: 12747 - protein, 183 aa, Parvularcula bermudensis
MTDRPFDSIPLRTIAGDPLSLADFAGKVILIVNVASKCGLTPQYAALQALYEAKKDQGLVILGVPANDFAGQEPGTDEEIQTFCATTYDVDFPLLSKAVVTGPSKHPLYAALTDAQPVKTGDADGFRAKLRSFGSEPTEDPEVLWNFEKFLIGKEGKVIGRFVPTTAPDDPALISAIDAALAA

SEQ ID NO: 12748 - protein, 290 aa, Campylobacter coli
MKIALIQQKFHSTKEKTIEKTCEFIEQAAKQGAELVCLGELHQSEYFCQSENVDFFDLANDYEKDVQFWSSVVKKHGVVLLTSLFEKRSAGLYHNTAVVFEKDGSIAGKYRKMHIPDDPCFYEKFYFTPGDLGFEPINTSLGKLGVLVCWDQWYPEAARLMALKGAQILIYPTAIGWFDKDEKEEKQRQLGAWLGVQKGHAIANGLYTIAVNRVGFEEDKSGVEEGIRFWGNSFVFGPQGEEICILDSENECIKLVDIDLQRSENVRRWWPFLRDRRIEYFGDLSKRFID

SEQ ID NO: 12749 - protein, 95 aa, Glycine max
  misc_feature (46)..(46): Xaa can be any naturally occurring amino acid
  misc_feature (65)..(65): Xaa can be any naturally occurring amino acid
MHAAQGSIYQALGLRDNARLFCMPGRKVHERKISPGIMMSSYAKAXDMSALNIRSIADGPILKSXAHLLHRNKKVEFIEQINQIATLKERKRDPP

SEQ ID NO: 12750 - protein, 308 aa, Tropheryma whipplei
MLILRWLFFCWYTFPRVFCGFVFWRGGLPLVTIRNLLDNGVHFGHTTQRWNPKMKGFILTERCGSYILDMRETIRGIVTAVDFIRDTVARGGEVLFIGTKRQAQQVIFKQASRVGQHYIAHRWLGGLLTNFSTVSKSLVRMKELEEARLDDSVSTKKEQLIRGRELQKLRRSLGGIRNMTKLPALLWVVDTNREGIAVEEARKLGIPVVAILDSNCDPDLVQFPIPGNDDSIRSIELLTGIVADAVAQGLVERHKAPQDDIEPMAEWEKQLLQSGDSSGETRPISGTDRPLDGDLSKGPAPQDEELSD

SEQ ID NO: 12751 - protein, 790 aa, Mesembryanthemum crystallinum
MKTEIKDAELHGDDIQGFDALYQHHHQQQQPKEEIWFQDDNNNHHHHQNDAAATNLLDVGDMDVSDPSSLFYAADDFPALPDFPCMSSSSSSSSAPAPKKPFASTATSSSASTATSSSWVADHEPSSSTAVSMDLVAPPPPQQSGGGGAGGEMGSMSVDDVDQCMDMMENFGCIDLLESGDICWDPSPLFGDGDGDESRQLLEEQQLERERERVEEEERAFEEFMLQGGESDSVVNVDDVVAGGNSNLDNTSNNNSKQQEHEQQHEQQGLVSSDDLAMVFFEWLKTNKEAISAEDLRNIKIKKSTIEAAAKRLGGGKEGMKQLLKLILQWVQNHHLHNKRESSTVSNNTCGAPVALVDQDHTNSTNNNNDNNNSIIADPNPNPNPNPTPPPLEQQASTTSSCFTTPPPATWLPAPQPQPFVGDPAAMVPAPPPMVGYMGSDPYSAGMAAYPPADYHQMMDTAPHSWAQTPSMQFGMGPQYGSFPDPSHAAQFGGYPAPYPGFYYHPGPGEGLMRLGSSATKEARKKRMARQRRFFTHHHRNHNHHQNQNQNNQMNNNLMVEQHGGVGNGNCGVAPHPSPAGNWVYWSHPPPLPPQVSHPVGGPPPMVGQMQGLERAAPSGNGFQRQGGVEKKQGWKSEKNLRFLLQKVLKQSDVGNLGRIVLPKKEAETHLPELEARDGIPIAMEDIGTSRVWNMRYRFWPNNKSRMYLLENTGDFVRSNGLQEGDFIVIYSDVKCGKYMIRGVKVRPQQQGAKAETTNKKSCKTQKTQGCSSPAGNGLSPSPSSMQKLI

SEQ ID NO: 12752 - protein, 411 aa, Fulvimarina pelagi
MAYVLAGGRGSRLKELTDTRAKPAVYFGGKTRIIDFALSNAINSGIRRIGVATQYKAHSLIRHLQNGWNFFRPGRNESFDILPASQRVSEDQWYAGTADAVYQNIEIIEDHAPKHMVILAGDHIYKMDYEIMLQSHVDSGADVTVGCLEVPRMEATGFGVMHVDESFKITDFVEKPKDPPAMPGRPDTALASMGIYVFETKFLIDALREDAKDPSSSRDFGKDIVPKIVKNGGAYAHRFNRSVIRSDNEPTHEAYWRDVGTIDAYWQANIDLTDVVPPLDIYDRNWPIWTYAEIVPPAKFVHDVDGRRGVATSSLVSGDCIISGGSLNRSLLFTGVRQRSYSQLDHAVVLPKCRIGRHARIKNAILDRGVEIPDGLVIGEDPLLDAKRFRRTDQGICLVTRPMIDKLRLEQ

SEQ ID NO: 12753 - protein, 151 aa, Vibrio cholerae
MKKTTRTMAAHKHVALVAHDNCKGELLRWVTENKEKLQRHFLYATGTTGHMLSKETGLAIKSMISGPMGGDQQLGALISEGKIDVLIFFWDPLNAVPHDPDVKALLRIASVWNIPVATNRASAKFLFSSSLMEQEVQIEIPDYQAYLAERT

SEQ ID NO: 12754 - protein, 168 aa, Campylobacter lari
MTNKEIILGAGCFWCTQAVFDKIKGVVYTEVGYSGGKPNPSYESVINGDENIEVAKIIYDEKQISLEKILEIFLKMHDPTSLDKQGADEGMQYRSVIFYQTNDELKIISDFLQKVQKYYAKAIVTQVLKLEKFYKAEDYHQKYFKNNPNQAYCRFVITPKLEKLVNHS

SEQ ID NO: 12755 - protein, 53 aa, Moorella thermoacetica
MEKYSCTVCDYVYDPAEGDPDNGIAPGTPFADLPEDWVCPLCSAGKEAFEPET

SEQ ID NO: 12756 - protein, 296 aa, Mycobacterium avium
MTIPWTPDRLGDLTGKRVIVTGATNGVGLGTARALAKAGAEVILAVRNTELGKQRAAQMGGSTAVEKLDLADLSSVRAFADRIEAPVDILINNAGALTDRRTETVDGFEMTLGTNLLGPFALTNLLLPKVRSQIINVGSDAHRSATLHLDDLHLRRHKWTRLGAYAQSKLAVMLWGLELDRRLRAAGSPIVTQLTHPGWVASNLSNLGDAPLKAAAHKAVKMVADRLANDIDEGAAPTLYCISEPIPPGSYVGVSGRFGLRGGPVLIGRTPLACDYDTAARLVAFAERETGTELRV

SEQ ID NO: 12757 - protein, 145 aa, Glycine max
  misc_feature (24)..(24): Xaa can be any naturally occurring amino acid
MGRRPARCYRQIKGKPYPKSRYCXGVPDPKIRIYDVGMKKKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDAHG

SEQ ID NO: 12758 - protein, 450 aa, Leuconostoc mesenteroides
MVDKKKGQGLPNLPLSTIWMLSFGFLGVQMAFSLQSSQMGRIFQTLGADPTKLGFFFILPPLAGLFVQPLVGYFSDRTWTKRFGRRMPYLLVGALVSVIVMFLLPNSGSFGFSTTAGLWFGAITILFMDLSSNVAMQPFKMVVGDMVNEDQKSYAYSIQSFLSNTGSVLATIFPFLLTAIGVANTAPKGQVPASVIISFYVGALVLVVFSLIAVFNVKEYDDATYELYHGYALNTPNDGEGGFLTLLKRAPKTFWMVTLTQFFCWMAFQYLWTYGTGAVADNIFHATDPTTAGYQNGGNWFGIMSAVYAIAAVVWSLVLSKIPANKNKTGYALSLFLGAIGFTSVFFIHSQYLLIGSFILIGISWAGMMAYPFIMVTNALPGDHMGTYLGLFNGSICLPQIVASVASFALFPALGSHFPSMILVSGILMLIGAVSVGFINEIHSNPVDAQ

SEQ ID NO: 12759 - protein, 575 aa, Cryptococcus neoformans
MSSAIEKEGSIRGRTSQEVVSAGYDPKKGGDGVDTVVTPAHAEKGSYEGEGIHVGEGTVHRQLKQRHMAMIALGGAIGTGLFVGSGSALASGGPVGVWLGYIFMASMVYAMMVALGEMAALYPVSGAFTHYASRFVDPSLGFALGFNYWYSYAITIPTEVVAASIVISYWDTTTNVAVYITVCLVLIWFINFWGARAYGEAEFWFSSIKVITIVGLIILGIVLMCGGGPNHDAIGFRYWRNPGPFAQITINNGDGVIPGRWGQFLAFWNVFVQAAFSFIGTEIIATTLGEAENPRKTVPRAIKRVFFRLLFFYVFGIFIISVLVPYTEPNLLNGTGTAAASPFVIAIENAGIKALPSIVNAVLLISAWSAGNSDLYASSRTLYALALERQMPRFFRRCTKRGLPIWCVVITGLFGFLSYMNTGGETAEKAFDWLYNLSAITGIITWWAILLSYLRFYYGLKKQGLSRDDFPYRAPFQPWLSWYGFIFFTLIILFNGFTVFLKGNWDASSFVAAYITLPIFAVCWIGWKLVKKTRVVPLAEIDFHSGRRELDELEALDAERFKAETKYQKIISILF

SEQ ID NO: 12760 - protein, 563 aa, Xylella fastidiosa
MCSIFGIFNLQPSDNLQRLRHQALECSQRQRHRGPDWSGVYVDVGAILVHERLAIVDPAGGAQPLLSEDGTLALAVNGEIYNHAVLKGTLQQPYVFQTHSDCEVINALYREETPTSFLNRLNGIFAFALWDKTTGRGLIARDPMGVVPLYWGHDQDGRLRVASEMKALIEHCPDVAQFPPGHWYDTTTGTLVKYYERSWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHGFEYTLQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSDGPQQMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 12761 - protein, 54 aa, Glycine max
GGHFFAVLFSISNFVKLLCLQPAKLYKLKHLSKVEVVANDPCGCTFTLGFDNLK

SEQ ID NO: 12762 - protein, 250 aa, Pseudomonas fluorescens
MNAKVWLVGAGPGDPELLTLKAVRALREAEVVLIDDLVNEAVLEHCPAARIIAVGKRGGCRSTPQAFIHRLMLRYARQGKCVVRLKGGDPCIFGRGGEEAQWLRERGVEVELVNGITAGLAGATQCDIPLTLRGVARGVTLVTAHTQDDSHLNWRALAQGGTTLVIYMGVAKLGEIREQLLAGGMAADTPVAMIENASLPEQRECRSDLTAMEDDALGFQLKSPAILVIGAVAAAATQVGSIGWAADRLA

SEQ ID NO: 12763 - protein, 771 aa, Unknown
  Piromyces sp. E2
SAVAALVAPMAVGAKSQDYARHIELSLLFYEAQRSGKLPENNRIYWRHDSMLDAGADNKVDLTGGYYDAGDNVKFNFPQAAALTLLAWSGWYYADGYKEAGQWEYILDAVRWGADYFVKCHTGKNELYVQVGKGATDHGFWYPPEYIQYDHPSYKITASAPGSEVAGDTASFLAAASILFKEEDPSYSANLLKHAIEIYDFADAYRGEYIKAVPDAQGFYSNWSGYNDELAFGALWLYRATGESKYMDKFSKIADASYGEQDTKAYGTCTGPISWDDKRPGAYILAAIVTGDEKRKQQAYWYCDNVLTQPRTPGGLWYDSNLSKWASNRYASNAAAMLAMFANYLPKTDSKRSKYVDFVKKQTDYILGDNPMKINYVVGAEANSPKAVHHRAASGTYDSQDTNARPTDYNIFTLWGALAGGPGPKDEYTDSRKNYEMNEVALDYNAAFQTNLAFLVKEGYNKPDPDSVKVHDRSFPKKADTPDITVEVTDKTIEVSTGSNMMCSSWCVEFTTDYKIEAVHDCIMYQSGPDYIICNRRESNFLDGKGTPQVIKYQGSNGQGPLTIDESVVMCDGWHAPQSSHKPMYKPENGRKYKVVGSGGVGNTTPLFEQSECWPAFLCGGSTSPKTTTIKKTTTTTKKSDPTNSNSCFSVAQGYPCCGAGIPVSYEDDSGQWGIENGNWCGIAPIKESCGDYPCCTGCDVQYTDDKKWGVENNNWCLIKEDKCQGSSGTVTCTGQNLGYPCCDTCEAIYTDESGKWGIKNGDWCGLKSSC

SEQ ID NO: 12764 - protein, 904 aa, Pseudomonas fluorescens
MNRQTTASTCCYCGVGCGVLIEHDGERILGVSGDPAHPANFGKLCSKGSTLHLTGDLAARALYPELRLGKGLARSRCDWDTALDHATNVFADTIAEHGPDSVAFYISGQLLTEDYYAFNKLARALVGTNNIDSNSRLCMSSAVVGYKRSLGADAPPCSYEDLELSDCVVIVGSNMAYAHPVLFRRLEEAKSRRPQMKVVVIDPRRTDTCDLADLHLAILPGTDVALFHGILHLLLWEDWIDRDFIKAHTDGLAELKSLVRDYTPAMVSQLCGISVEQLQQCAEWIGTAPSFLSLWCMGLNQSTAGSAKNSALINLHLATGQIGRPGAGPFSLTGQPNAMGGRETGSLSNLLPGHREVANPEHRAEVAAYWGVDKLPENTGLSAIELFEQVRGGKIKALWIACTNPAQSMPDQTAVRAALETCPFVVLQEAFRTTETAAFADLLLPAASWGEKEGSVTNSERRISHVRQAIAAPGEARPDWAITVDFAQRLEKRLRPQQPGLFAFEQPAQLFDEYKQLTRGRDLDLSGISHGLIDELGPQQWPFPAGARQGTARLYGDGIFPTANGRARFVADPYRAAKEQRDARFPLTLITGRLRDQWHGMSRTGTAAQLFGHVSEAVLSLHPDELRRHRLQPGDLVNLKSRRGAVIVAVASDDSVRPGQAFLPMHWGDRFLKGGVNSLTLPAFDPLSKQPELKHSGVRLEPVDLPWQLFALIEGDVQRHFEALRPLCEAFSYASLSLVGRERPALLIRAASAVAPEPRLLREIDQCLALIDGPVLAYDDPRRAIGKRVRIENGRITAIRLAGETLAQHWLQGLWLEGRADEQLRRWLLAPMSAPPGNAGAQVVADKTLCNCKNVSHSAVCAGIREGLDLQGLKNKLGCGTQCGSCVPEIKRLLAAEVRPVAVI

SEQ ID NO: 12765 - protein, 254 aa, Methanococcus maripaludis
MKKMIIVGAGPGDKELITIKGKNAIESADILIYAGSLVNPEVLEYNKKGAKIYNSATMTLDEVIEVAVNGINSGLTVVRVHTGDPALYGAIKEQIDELKKYEIDVEIIPGVTSLFAAAATLKSELTLPDVSQTVIITRPEGRTPKPAKESLISLAKHNATMAIYLGTGMIEKVCNELIEGGYPENTAVSVVYHASWPDEKKITGTLKDISEKVKGEGITKTALIIVGNVTNPESYDYSKLYDKDFEHEFRKPKN

SEQ ID NO: 12766 - protein, 778 aa, Unknown
  Piromyces sp. E2
MKFQSIISAVAALVAPMAVGAKSQDYARHIELSLLFYEAQRSGKLPENNRIYWRHDSMLDAGADNKVDLTGGYYDAGDNVKFNFPQAAALTLLAWSGWYYADGYKEAGQWEYILDAVRWGADYFVKCHTGKNELYVQVGKGATDHGFWYPPEYIQYDHPSYKITASAPGSEVAGDTASFLAAASILFKEEDPSYSANLLKHAIEIYDFADAYRGEYIKAVPDAQGFYSNWSGYNDELAFGALWLYRATGESKYMDKFSKIADASYGEQDTKAYGTCTGPISWDDKRPGAYILAAIVTGDEKRKQQAYWYCDNVLTQPRTPGGLWYDSNLSKWASNRYASNAAAMLAMFANYLPKTDSKRSKYVDFVKKQTDYILGDNPMKINYVVGAEANSPKAVHHRAASGTYDSQDTNARPTDYNIFTLWGALAGGPGPKDEYTDSRKNYEMNEVALDYNAAFQTNLAFLVKEGYNKPDPDSVKVHDRSFPKKADTPDITVEVTDKTIEVSTGSNMMCSSWCVEFTTDYKIEAVHDCIMYQSGPDYIICNRRESNFLDGKGTPQVIKYQGSNGQGPLTIDESVVMCDGWHAPQSSHKPMYKPENGRKYKVVGSGGVGNTTPLFEQSECWPAFLCGGSTSPKTTTIKKTTTTTKKSDPTNSNSCFSVAQGYPCCGAGIPVSYEDDSGQWGIENGNWCGIAPIKESCGDYPCCTGCDVQYTDDKKWGVENNNWCLIKEDKCQGSSGTVTCTGQNLGYPCCDTCEAIYTDESGKWGIKNGDWCGLKSSC

SEQ ID NO: 12767 - protein, 823 aa, Pseudomonas fluorescens
MLPENLMKKLKLVMIGNGMAGVRTLEELLKLSNELYDITVFGAEPHTNYNRILLSPVLAGEQTFEEIVLNDLDWYLENNIKLLLNRKVVEIDRVKRRVIAEDGTEAEYDRLLIATGSTPFILPIPGNTLQGVIGYRDIADTQAMIDTAKTHKHAVVIGGGLLGLEAANGLMLRGMHVTVVHLGEWLLERQLDKTSGQLLQTALESRGLHFRLCEQTQALHDAGNGRVGSVQFKNGDIIPADLVVMAAGIRPNTELAEKAGIPCNRGILVNDTLQTYDPRIYAIGECASHRGIAYGLVAPLFEQAKVCANHLAQLGFARYQGSVTSTKLKVTGIDLFSAGDFMGGEGTETITLSDPIGGVYKKLVIKDDVLVGACLYGDTADGGWYFRQIRENHAIGEIRDHLMFGENALGDVGHQGQDKAMSMADNAEVCGCNGVCKGTIVKAIQEHGLFSVDEVKKHTKAASSCGSCAGLVEQILINTVGGAADVKPKSEKAICGCSDLNHGQIRQAIREQHLLTIAGTMSYLNWRTPNGCATCRPALNYYLISTWPGEAKDDPQSRLINERAHANIQKDGTYSVVPRMWGGVTNPSELRRIADVADKYQVPMVKVTGGQRIDLLGIKKQDLPGVWKDLDMPSGHAYGKSIRTVKTCVGSEFCRFGTQNSTQLGIDLEHDLFNMWSPHKVKLAVSGCPRNCSEAGIKDVGIIGVDSGWEMYIGGNGGIKTEVAEFFVKLKTAEEVREYNGAFLQLYREEAFYLERTVHYLQRVGMEHIKKAVLEDPERRKALNERLQFSLSFEQDPWKERLAQPQLKKEFDVLPVKNLEVPA

SEQ ID NO: 12768 - protein, 259 aa, Brassica oleracea
LDRTIQFYTECFGLKVLRKRDVPEEKYSNAFLGFGPETSNFVVELTYNYGVSSYDIGTGFGHFAISTQDVSKMVEAVRAKGGNVTREPGPVKGGGSVIAFVKDPDGYTFELIQRGPTPEPLCQVMLRVGDLDRAIKFYEKALGMRLLRRIERPEYKYTIGMMGYAEEYESIVLELTYNYGVTEYTKGNAYAQIAIGTDDVYKSAEVVKIANQELGGKITREAGPLPGLGTKIVSFLDPDGWKTVLVDNEDFLKELNEEE

SEQ ID NO: 12769 - protein, 375 aa, Unknown
  Verbena x hybrida
MAPTKTCLTTLAEENSVHQKFIRDEDERPKVPYNQFSDQIPVISLAGIVDETGGGGDRAEACKKIVAACEEWGIFQVVDHGIDAKLIKDMTRLAREFFALPAEEKLRFDMSGGKKGGFIVSSHLQGEVVQDWREIVIYFSYPINGRDYSRWPDKPEGWRSVTEMYSEQLMKLNCKLLEVLSEAMGLENDALAKACVEMDQKLVINFYPKCPQPDLTLGLKRHTDPGTITLLLQDDVGGLQATRDGGKTWITVQPVEGAIVVNLGDHGHYLSNGRFKNADHQAVVNSNYSRLSIATFQNPAPDAIVYPLKINEGEKAVMEEPITYSEMYKRKMNKDLEIARLKKLATEKKLQEAELEKLANQVEVKPCKGLEEILA

SEQ ID NO: 12770 - protein, 357 aa, Unknown
  Verbena x hybrida
MFSTVAPSPRVEILAGSGIKTIPKEYVRPDEELESIRDVFAEERSIDGPQVPTIDLAEINSENEEIRKKCHDELKKASMEWGVMHLTNHGIPDELINRVRKAGQGFFDLPVEEKEKHANNQEAGNVQGYGSKLANNASGQLEWEDYFFHCVFPEDKRDLSIWPKNPADYIPATSEYARQLRSLATKILSVLSIGLGLEQDRLENEVGGMEELILQKKINYYPKCPQPELALGVEAHTDVSALTFIIHNMVPGLQVFYEGKWVTAKCVPNSIIMHIGDTIEILSNGKYKSILHRGLVNKDKVRISWAVFCEPPKEKIILKPLPEMVSEAEPPLFPPRTFAQHLKHKLFRKTDDEEIDE

SEQ ID NO: 12771 - protein, 491 aa, Bacteroides fragilis
MATQNKTDIGLIGLAVMGENLALNMESRGWNVSVYNRTVPGVEEGVVERFINGRAKGKHIEGFTDIEAFVESIALPRKIMMMVRAGSPVDELMEQLFPYLSPGDILIDGGNSNYEDTNRRVKLAESKGFLFVGAGVSGGEEGALNGASIMPGGSEKAWEEVKPILQSIAAQAPDGTPCCQWVGPAGSGHFVKMIHNGIEYGDMQLIAEAYWVMKELLDMTNEEMASVFTRWNEGKLRSYLIEITGNILRHKDKTGAYLIDKILDAAGQKGTGKWSVINAMELGMPLGLIATAVFERSLSARKELREAAARQYQCRHSMAVYNKQDTEKEIFSALYASKLVSYAQGFAVLQRASDTFGWNLDLASIARMWRGGCIIRSVFLNDIAAAFEAKEKPKHLLLAPYFEEEIKGLLSGWKNLVAQAMREELPVPAFSSALNYFYSLVSADLPANLVQAQRDYFGAHTFERKDELRGVFFHENWTGHGGDTKSGTYNV

SEQ ID NO: 12772 - protein, 525 aa, Parvularcula bermudensis
MDGSAFPSPQEPGGGRPEGDEGQYDVVIVGAGISGINAAYRLTESDPTLTYKIFEGRERLGGTWDLFKYPGIRCDSEMSTLAFPFRPWEEKSLIGSGYEIRDYLEDTARENGIYPRIEFQTYVKSAAWSSEENLWTVKIVNAAGTERTVKGRYIYLGTGYYDYGSGYTPDFPGLESFGGQMIHPQHWPEDLPLKDKKAVIIGSGATAITLVPAMADEGAEVTMLQRSPTYVIAMPSSAAPARALRAVFGRNLGNKIERWRSHFLGDTFYKASKAFPGLIRNILQRRAQSLLGKNVSVDPHFTPKYNPWDQRLCLDPDAKLFKTLRKGKAKVVTDHIERFDETGIQLKSGDHLDADIVVSATGLNVKMFGDIDLSVDGRPIDPADHFVYRGMMLDGVPNFFLAIGYVNASWTLKVDLTAQLAASVIGRAKAGGHQRVAAIPLSDMGKESPLLDLTSGYVQRALERLPRQGAEEPWVVHQDFKKDIKSTREGMKGDEAVKFDPSPDQLKPFQPRTPSATAPELQAAE

SEQ ID NO: 12773 - protein, 581 aa, Gibberella zeae
MERSKPQAFLSSYAPRLRAYNNSLLTPVLPSSAPAGPVSRTTKRGTTIINYAEDGYDDLEDDSDDPRRRPTGLRSLRKEDSASRLDLADKVGKDTKEPVEVQGIWRDWIAKHRLLRSDQQNAIQATLPLTLIPIRIDLDVPAFIPPAPYPTPNPNTVDTSLPQYRQQEATVPYKLRDIFCWNLHETLISTDQFAQTLVQDLDLPNRQAAIAEISKQIRTQLEEYSGVALHPLFHSDQQAASAPQPTTTALTPRPSFALKSRDDSPASAIRGPSRPDTPAQTGGAATPSQTQAPDVTAEATPILPDSDDYNPDDTYRCIINLSLNLASMLYTDKFEWSLLHPPGTAEAFAKVTCTDLGLTGEWIPAMTHAIYEAVLRLKKEACEAGGLVAGWGGLQQELPNDAAHGSEAGWRYEPEHLGDDWEPKVEFLSKEEIEKREGDREREVRRLRRETARFSSTTGMLGGTPFGAPMEVEEERMGRGERSKKKRRFRSLSPLGRGGTPGGRGTPDVGGYGGGGGALTDQERFQWRCMHCRIWGTSVWAVRDGPAGPRTLCANCGYLYERDQRLPRQNKNLHLPDVRVV

SEQ ID NO: 12774 - protein, 121 aa, Staphylococcus aureus
MTTTPYDIIGKEALYDMIDYFYTLVEKDERLNHLFPGDFAETSRKQKQFLTQFLGGPNIYTEEHGHPMLRKRHMDFTITEFERDAWLENMQTAINRAAFPQGVGDYLFERLRLTANHMVNS

SEQ ID NO: 12775 - protein, 218 aa, Zea mays
MARRASLLLAAALLVAVAAAAVPPTCERIECPAYEVVDSANGFEIRRYTDAMWITTAPIEDISFVAATRTGFLQLFDYIQGKNAYNQTIEMTAPVLTRVSPSDGPFCASAFAVSFYVPAKNQADPPPAEGLRVDRWAGARYAAVRRFGGFVADADVGEQAARLEASLQGTRWAAAVNDARRADPASPYTVAQYNSPFEFTGRVNEIWMLFDADDDASM

SEQ ID NO: 12776 - protein, 500 aa, Parvularcula bermudensis
MSVTPIHKKQIYDVLIFGAGVSGIGCAATLRQKSPEKTWTILEMRHDLGGTWDLFKYPGIRSDSDLYTFSYEFKPWDRKRSIARGDEIKDYLDDTAKEFDVKDHIQFHTKILSCSWDSQQALWTVRVENTKTGEQSDVFGRWIFSGTGYYDYDKGYRPSFPNEDAYKGEIIHPQHWPEDLDYSGKRIAVIGSGATAVTLLPSLAEKAAHVIQVQRTPTYVLPVPQVDPWQYLFRPFVSKNTLHRLMRAKNILRQKLLWGASRRFPRMMRQFIRLVNKVYLPSHYPVDTHFNPPYDPWDQRLCAVPDGDLYKSLRKGECSIVTGTIARFTEKGIEMSSGETVEADIIVTATGLNIKLLGGVTYTVDGEEIDWSQRVVFKGMMYNGIPNFVMALGYTQSSWTLKVGLLCEYLCRLFAEMDRRGMAVCTPELPDRPMELRPLLDFGAGYVRRAIDKMPRQGDAFPWEMTFNYSEDAEMMKEGEVVAPELRLSPLPEALAYAAE

SEQ ID NO: 12777 - protein, 166 aa, Tripsacum dactyloides
RKIPVLLLPDGRAICESAVIVQYVEDVARESGDAEAGSLLLPDDPYERAMHRFWTAFIDDKFWPALDAVSLAPTPDARAQAVEDARAALSLLEEALKDRSNGGAFFSGGDAAPGLLDLALGCFLPALRACERLHGLSLIDASATPLLDGWSQRFAAHPAAKRVCRT

SEQ ID NO: 12778 - protein, 601 aa, Bradyrhizobium japonicum
MLDRTKDISVAAQAWLDEFAGALGNPEPAAALDLLFLPDSFWRDVLALSWNLQTLAGRRAIAQALAALASRAAPTHFEIAPNRAPPRWVTRAGTSNIEAIFNFETALGRGSGILRLVPDSTDGDRLKAWTLLTALDELKGFEEQLGTSRPRGQAYSRDFRGPNWLDQRNTSRDYADRDPAVLVVGGGQAGLAIAARLKQLKVDTLIVDREARIGDNWRKRYHALTLHNQVQVNHLPYMPFPANWPVYIPKDKLANWFEAYVDAMELNFWTGTEFEDGAYDEAKGRWTVTLRRADGDKRTMHPRHVVMATGVSGIANVPDIPTLDNFRGTLVHSSRYEDGENWTGKRAIVIGTGNSGHDIAQDLYSSGAEVTLVQRSPTLVTNIEPSAQLAYATYNEGTLEDNDLIATSMPTPLAKKTHVMLTEQSKELDRELLDGLSRVGFKLDFGEAGTGWQFKYLTRGGGYYFNVGCSNLIAEGAIKLRQFSDIESFVAEGVRMKDGTTIPADLIVLSTGYKPQEYLVRKLFGDGVADRVGPVWGLAKASSCATCMRARSSPACGSSPAASPSAGSTRNISRSRSRPSRKGFWGVRWIQGNTHVIPGRA

SEQ ID NO: 12779 - protein, 175 aa, Ashbya gossypii
MGSAPSKILEDLLDDTNFDREEIERLRKRFMKLDRDSSGSIDKNEFMSIPGVSSNPLAGRIMEVFDADNSGDVDFQEFISGLSVFSGRSDKEEKLRFAFKIYDIDKDGYISNGELFIVLKIMVGNNLEDEQLQQVVDRTIMENDVDGDGKLSFEEFKSAVETTEVANSLTLQCDI

SEQ ID NO: 12780 - protein, 630 aa, Unknown
  Magnetococcus sp. MC-1
MCGLSAILDLTGQRLPEAEQLTAMTRALAHRGPDGEGMHREPGVGLGHRRLSIIDLAGGAQPLWNEDRSVAVVFNGEIYNFPDLMQRLQGLGHQFHSRSDTEVIVHAWEQWGEQCVEALQGMFAFALWDRCQGVLFVARDRLGIKPLYYGFSEDGWLLVGSELKALTAHPGLSRSLDPKGVMDYFAYGYIPDPHSIYRQVKKLEPGYCARFTLGSGDWRLRCYWDLSFAAQPLTEAAALQQLQELLGQTVQSHTLADVPLGAFLSGGVDSSLITALLAKQSQTPLQALTVAFTGSREDEAPHARAVAQHLGVQQQLLTVDPLDFERLERLPGLYDEPFADSSAWPTFLLCEAAASRMKVVLSGDGGDELCAGYSRYRLFMAEQQVRQRVPSWLRRGLFGPMGMLYPKLDNAPRWLRAKSTLQALGEGPLEGLFRGASMMDPAMGQGLLAPDLMLLDYHPIEHFYRLNARLPEQVAFHDRMLYLDFKTFLAGRVLTKVDRASMAVGLEVRVPLLDHRLVEWAGRLPWCLKMQGGQGKYLLKKLAAQQVPATAVYRSKQGFIPPLAAWLRGPLQERLQDRLSSRVITESGLFHPRWIHWMLEQHRKKKQDLSMPLWSLLMFEGMLRKAQNKG

SEQ ID NO: 12781 - protein, 415 aa, Burkholderia pseudomallei
MFDRAQSTIANVDPEIWQAIQQENVRQEEHIELIASENYTSPAVMAAQGSQLTNKYAEGYPGKRYYGGCEYVDIVEQLAIDRVKALFGAEAANVQPNSGSQANQGVFFAMLKPGDTIMGMSLAHGGHLTHGSPVNMSGKWFNVVSYGLNEAEDIDYEAAEQLAHEHKPKLIVAGASAFALKIDFERLAKIAKAVGAYLMVDMAHYAGLIAAGVYPNPVPHADFVTTTTHKSLRGPRGGVILMKAEYEKQINSAIFPGIQGGPLMHVIAAKAVAFKEALSPEFKEYQQKVVENARVLAQTLVKRGLRIVSGRTESHVMLVDLRAKNITGKAAEAALGNAHITVNKNAIPNDPEKPFVTSGVRLGSPAMTTRGFGPQEAELVGNLIADVLEHPEDAATIERVRAQVAELTKRFPVYR

SEQ ID NO: 12782 - protein, 126 aa, Methanosarcina acetivorans
MKEIIAIIRPKKVEPTKEALVELGIPSVTVVPVFGRGKQRGIAEELNIDIRPGLLDQGLLAGMKYMEFIPKRLLYLIVSDEDVDTAVDTIIKVNQTAQIGDGRVFICPVDNAIRVRTDDQGDSALL

SEQ ID NO: 12783 - protein, 517 aa, Campylobacter lari
MSEVNKKVQNRLEDIIIEEDFEQMLEESFKSDEEATTQGIIVAIKGDEVFVNVGQKSEGILAIEEIQNDKGEFIFKEGDTLEVAIVGSRGGRSLLSHKKALRKQKVKEFIDNYKDDESMFDVKIIGKNRGGFVAVDENGVEFFLPKSQSSFKDSNNIINKTFKVKIIKIDKEAQSIVVSRKKIVDEERKKRKEIISNVLNQEEIIEGIVKKITTYGMFVDVGGVDGLVHYSEISYKGPVNPSSLYNEGDKVPVKVIKYDKDKKHLSLSIKLAMPDPWDEIKDGLEVGDTIKVTVSNIEPYGAFVDLGNDIEGFLHISEISWDKNAKNPKDYISEGQELDVEVIEINAKERRLRVSLKNLLAKPFDEFLKSHKVGDVVKGSVTSVTNFGAFVKIANLEGLLHNEDASWNRNDKCKDMYKVGDVIEVKIIKLDKENQKISLSTKELQKSPVQVYAQKHQVNDIISGKIRDIKDFGVFVELEEGVDALIHKEDLGNVDFSSLKVGDIIEALIVFIDEKKN

SEQ ID NO: 12784 - protein, 548 aa, Ustilago maydis
MAPTATQDPVAVAVPASKAAKHGYVHPTDMLPSGWPTATDLSGGAQPRRFEGTIFDVMVRGTIPKELYGTFYRIMPDYAEAPTYYKGGELNAPIDGDGTVAAFRFKDGKVDYRQRFVETDRFKVERRARKSMYGLYRNPYTHHPCVRQTVDSTANTNVVMHAGRFLAMKENGNAYELDPHTLQTLGYNPFKLPSKTMTAHPKQCSVTGNLVGFGYEAKGLATKDVYYFEVDPSGKVVHELWLEAPWCAFIHDCALTPNYLVLMLWPFEANLDRMKAGGHHWAYDYDKPITWITIPRGAKSKDQVKCWYWKNGMPIHTASGFEDDQGRIIIDSSLVHGNAFPFFPPDSAEQRQKQQSDGTPKAQFVRWTIDPRNDSNERLPDPEVILDTPSEFPQIDNRFMGVEYSSAFINVFVPDRSDGNKNVFQGLNGLAHYRRKQGTTEWYYAGDNCLIQEPVFSPRSADAPEGDGFVLAIVDRLDLNRSEVVIIDTRDFTTAIAAVQLPFAIRSGIHGQWIPGQVTPDFDSRGLIDLPKQQHWAPPSQSAFDPNM

SEQ ID NO: 12785 - protein, 585 aa, Herbaspirillum seropedicae
MHHTDTGQSFLLSFMSTTTVIAAGVDTSSEFAALFEESLSRQDMRSGEVISAEVVRLDHNFVIVNAGLKSEAFIPVEEFKNDNGEVEVNVGDFISVAIESLENGFGDTILSRDKAKRLASWLSLEKAMESGEIVTGTVNGKVKGGLTVLTNGIRAFLPGSLVDTRPVKDTTPFEGKTLEFKVIKLDRKRNNVVLSRRAVIEASMGEERAKLMETLKEGTVVTGIVKNITDYGAFVDLGGIDGLLHITDLAWRRVRHPSEVLSVGQEITAKVLKYDQEKNRVSLGVKQLGDDPWTGLSRRYPQGTRLFGKVTNLTDYGAFVEVEQGIEGLVHVSEMDWTNKNVAPNKVVQLGDEVEVMVLEIDEERRRISLGMKQCKPNPWDDFAMSHKKGDKVKGSIKSITDFGVFIGLPGNIDGLVHLSDLSWTEAGEEAVRKFKKGDELEAVVLAIDVERERVSLGVKQLEGDPFNNFAALNDKGAIVTGTVKSVEPKGAVIQLTDEVEGYLRASEISRDRVEDAGTHLKVGDSVEALVINIDRKARSIQLSIKAKDNAETQEAMQKMSADSNAASGTTSLGALLKAKLDNKN

SEQ ID NO: 12786 - protein, 123 aa, Methanosarcina acetivorans
MKEVTAVVRPNKMSTTKDALDKIGFPAMTAIPVLGKGKQRGISGELNFYIQPRLLAKRYSTGMKYIPKRLLSIVVNDEDVDLVVKTIIEVNQTAQIGDGRIFVEPIDDVIRIRTGEKGELSLK

SEQ ID NO: 12787 - protein, 522 aa, Unknown
  Marinobacter sp. ELB17
MLDANLKGQLKGYLDNVKQPIELVAALDDSAKANELYELLQEIDALSDMITLREDGDSEVRRPSFAINRVGTDVGVRFAGIPMGHEFTSLVLALLQVGGHPSKATPELIQKVQELDGNFEFETYFSLSCQNCPDVVQALNLMSVLNPSVKHTAIDGALFQAEVEEREIMAVPSVYLNGKLFGQGRMKLEEIVAKLDTNTGAREADKIRQKGTFEVLVIGGGPAGSAAAVYAARKGISTGIAAERFGGQVADTMGIENLISVPYTEGPKLVAAMEQNVIEYGVDIMNMQRAEKLIPATKPGMPHEIRMANGASLKARTLVLSTGARWRQLGVPGEDKYRNKGVAYCPHCDGPLFKGKRVAVIGGGNSGVEAAIDLAGIVGHVTLLEFGAELRADEVLQRKLRSLKNVDVAVSAQTTEVTGANGKVNGLDYTDRNSGKNVHVELEGVFIQIGLLPNTEWLKGDIELSKHGEVVINERNETSIPGVFAAGDATTVPYKQIVISMGEGSKAALSAFDFLIRNSADE

SEQ ID NO: 12788 - protein, 1000 aa, Blastopirellula marina
MISPDPQTIVVVGNGMVGHRFVENMIEMDIAQRYRIVTFCEEPRAAYDRVGLTSFFAHRDAEKLMLARLDWYKQHEVELHIGDRANRIDRAAQIVYSDRGAAIHYDHLVMATGSYPFVPDLPGVKHHGVFVYRTIEDLERIIEYGKKSKRCAVIGGGLLGLEAAKAAHDLDLETFVIEYNGRVMPRQLDEAGSKMLIEKITSLGLKVLLNKGTKEIRGDGHVQQILFTDGTTLDVDMIIISAGIRPRDELAKDSQLELGKRGGVVVNERLQSSDPNIYAIGEIASYAGMIYGLVAPGYDMAEIAAANFCGQERTFNGADMSTKLKLMGCDVASFGQYNLPAEEARPLVWEDPFKGIYKKLLFTPDGSRLLGGMLVGDASDYGTLLILSKSDAPLPCDPATLIGAGGSGDKSAIGGVADMPDSAQICSCNNVTKGRICEAIRDEGIDNVGDLKMCTKAGTGCGGCMPLVTDLLAAELKAAGKAANTDLCEHFAHTRQELYEIVQLKEIKSFNDLIAQHGRGHGCEICKPAVASILASLWNDQILEPEHQTLQDSNDRFLANIQRGGSYSVVPRVPGGEITPEKLIVLGEVAKKYKLYTKITGGQRVDLFGAQAYELPEIWEELVNAGFESGHAYGKSVRTVKSCVGSTWCRYGIGDSVGFAIAIEERYRGLRSPHKLKFAVSGCVRECAEAQCKDVGLIATENGYNLYVCGNGGTKPRHADLLIADIDEATAITYIDRFLIYYIRTADKLMRTATWMEKLEGGLEHLKAVVIDDKLGVAEELEKQMQYLVDTYKCEWKEVVNNPEKRKWFRQFANTDEHQLDIELIEQRDQARPADWPKENVALVELKGLNGETIDHNGQANLRSWVRVGAVADFPLDGGSAIKYGQTQIAVFNFASQGNWYACQNMCPHKNAFVLSRGMIGTAGETPKVACPLHKKTFSLESGECLTGEEYAVKTFPVKIEADGVYLELPPETVLDAELATDKHCIRGCDAVKALQLAEA

SEQ ID NO: 12789 - protein, 395 aa, Unknown
  delta proteobacterium MLMS-1
MKQQATATAANATGHTEAVADRRPYLERARRLVVKIGSAVLTTADGLDFTVLDHLVEQIEQLRARGCEVLVVSSGAVAAGRRKLALGDRGLTLREKQAAAAIGQSSLMRAYEKSFEAHGSKVAQVLLTHDVFSRRDRYLNARNTLFTLLQWQLVPIINENDAVAVEELRFGDNDTLGGMVANLVEADLLICLSDVDALYTADPGREPTARPLRTVKRINAEIEAMAGGAGSKVGTGGMLSKLKAAKMVTSRGGAALIGPGREADVLPRLLAGAELGSFFPPAAHRLPSRKHWIAHTLRPKGFLVLDAGACRAIERGGRSLLPSGVVEVRGHFGIGDAVHCLDDAGRAVAAGLVSYEAQALQRIKGVKSSAIADILGYKDADEVIHRDNLVLIGQQ

SEQ ID NO: 12790 - protein, 418 aa, Unknown
  delta proteobacterium MLMS-1
MNMEAEIKSLAVATRAASRQVANLSTTVKNRLLLAMAEALRAKKEYIQAENEKDLAAGREKGLSAAMLDRLALSDKVIEAMVGGLQEVAALADPVGEVAEMVRRPSGILVGRMRIPLGVIGMIYESRPNVTVDAAALCLKAGNAVVLRGGSEAHNSNLALAKVLQACLAAEQLDPAAIQVIPVTERAAITAMLACEEEIDLIIPRGGEGLIRFVAENSRIPVLKHYKGVCHVFVDESADLEMAAAIVSNGKIQRPGVCNALETLLVHRQVAAEFIPAVAGQLTAAGVELRGCPQTVALAPAAKPAAADDWGREFLDLILAVRVVDDLDAALAHIVEYGSQHTEAIVTSNHPRAQRFIREVDASSVMVNASTRFSDGGQYGLGAEIGISTTKLHAYGPMGLRELTTRKFIVYGEGEIRQ

SEQ ID NO: 12791 - protein, 131 aa, Mycobacterium smegmatis
MTQVQRSFYDEVGGHDTFHAIVSRFYQLVREDEILHPLYPEDDFEGAEERLRMFLEQYWGGPRTYSDQRGHPRLRMRHAPFRIGFLERDAWLRCMHTAVAEIDSQTLDDAHRRALLDYLQMAADSMVNSAF

SEQ ID NO: 12792 - protein, 294 aa, Gibberella zeae
MSNEEITHPTIVDGWFREISDMWPGHAMTLRVEKVLVHEKSKYQDVLIFKSTDFGNVLVLDNVIQCTERDEFSYQEMIAHLALNSHPNPKKVLVIGGGDGGVLREIVKHDCVEEATLCDIDEAVIRLSKEHLPSMACGFDHPKSKTHVGDGFKFLNDYKNEFDVIITDSSDPDGPAEALFQKSYFQLLHDALREGGVITTQGSESPWLHLPLIARLKKDCGAIFPVAEYAYTTIPTYPSGQIGFMVCSKDPKADVKNPIRSWTKEEEDEKLRYYSSEIHKASFVLPKFAAKALE

SEQ ID NO: 12793 - protein, 997 aa, Unknown
  Bacillus sp. BP-23
MKGSWWRRVAIVTLSAGLLAGSFSMNTGLRQADAAAGDHNYAEALQKAIYFYEAQRSGPLPANNRVEWRGDSGMQDGADVGVDLTGGWYDAGDHVKFGFPMAASATMLAWSVVEYADGYEQAGQLEEIKDNIRWATDYFMKAHTKPNELWGQVGAGNTDHAWWGPAEVMQMNRPSFKIDASCPGSDLAAETAAALAASSIVFADSDPVYSAKLLQHAKELYNFADTYRGKYTDCITDAAAFYNSWTGYEDELAWGGAWLYLATNDNAYLSKALSAADRWSTSGGSANWPYTWTQGWDSKHYGAQILLARITSNLNMPEATKFIQSTERNLDYWTVGTNGGRVKYTPGGLAWLDQWGSLRYAANAAFISFVYSDWVSDPVKKSRYQNFATSQINYILGDNPRQSSYVVGYGQNSPQHPHHRTAHSSWMNNEDIPANHRHILYGAMVGGPNASDQYTDDIGDYVSNEVATDYNAGFTGALAKMNLLYGQNHQPLANFPAPEVKGDEYFVEAAVRSSGSNYTEIRALLNNRSGWPARMGDQLSFKYFLDLSEVYAAGRTVSDVQVTVSSSEGATVSQPVVVDAAKRIYAITANFSNTKIYPGGEGNYRKEVQFRITGPQGAWNPANDPSYQNLTTGNPVKSNYIPVYDAGVKVSGQEPGVTPVAVPAAPAGVQAVAGNSQVALNWSASAGAVSYTVKRAEVSGGPYTTVAAGVNGLTYTNTGLTNGKTYYYVVTAVNSAGESPASVQVSGMPQAATTVPGAVTLSGTAGNNQNMLSWTAASGASSYTVQRAVAGGTYTDVATGLAVLNYNDTTALNGTSYSYRVAAVNASGQTLSNVVMLTPSGPPVSTGTLEVQYRSGGSGNSSNAVTPQFNLKNTGTQAIDLSTVKIRYYFTKDGTEELSFWCDYAQVGSANVQGMFVAVNPAKGTADTYVEISFTSGAGSLAAGAETGVIQTRFSKNNWSAFDQSNDYSYDASKTAFAAWNKVTAYQGNTQVWGLEP

SEQ ID NO: 12794 - protein, 301 aa, Gibberella zeae
MSSATAPVLKQRVKLSLIQLASGSDKKANLDSAASHVARVASSGAKIVVLPECFNSPYGTDHFPQYAETLLPSPPSKDDAPSYHALSSMAVDNKVYLIGGSIPEYSPDTKKYYNTTLIFGPDGSLLGTHRKVHLFDIDIPGKITFRESDILSPGNKVTLVDLPEYGKIAVAICYDVRFPELATIAARKGAFALIYPGAFNTTTGPLHWQLLGRARAADNQLYVALCSPARAETGYPAYGHSLVADPMAQVQVEADEKETTVDWELDPEKITEARKAIPLNTQRRFDVYPDVSEGKVQFEES

SEQ ID NO: 12795 - protein, 418 aa, Unknown
  marine gamma proteobacterium HTCC2143
MDVKQYMTTVGQSARQASRAMAAAKTGTKNNALIATADAIERARGKLLAANQQDMEGGRSNGLDAALLDRLELTEARIDDMVEGLHQVAALADPVGEITDLKYRPSGIQVGNMRVPLGVIGIIYESRPNVTVEAASLCIKAGNATILRGGSEAIHSNQAIAACIIEGLAAAGLPKNAVQVVETTDRAAVGELITMPDFVDVVVPRGGKGLIERISRDATVAVIKHLDGICHVYIDDHADLEKAFNVAINSKTQRYGTCNTMETLLVAERIAADILPRLAAAYRQAGVELRVCERIKAIISDGKLATEEDWKTEYLAPILSIKMVDGLEQAMDHINHYSSQHTDTIVTENYTNGRRFLREVDSSSVMINASTRFADGFEYGLGAEIGISTDKIHARGPVGLEGLTSQKYIVLGDGEIRE

SEQ ID NO: 12796 - protein, 479 aa, Escherichia coli
MSIVVKNNIHWVGQRDWEVRDFHGTEYKTLRGSSYNSYLIREEKNVLIDTVDHKFSREFVQNLRNEIDLADIDYIVINHAEEDHAGALTELMAQIPDTPIYCTANAIDSINGHHHHPEWNFNVVKTGDTLDIGNGKQLIFVETPMLHWPDSMMTYLTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIFYDTMSNNTRMMADAIAQGIAETDPRVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDQDALELCREHGREIARQWALAPLPQSTVNTVVKEETSAATTADLGPRMQCSVCQWIYDPAKGEPMQDVAPGTPWSEVPDNFLCPECSLGKDVFDELASEAK

SEQ ID NO: 12797 - protein, 381 aa, Mycobacterium smegmatis
MARDYYGLLGVSKGASDSEIKRAYRRLARELHPDVNPDEEAQHRFTEIQQAYEVLSDPEKRRIVDMGGDPMESVGGAPNGFGGFGGLGDVFEAFFGGGTTSRGPIGRVRPGSDSLLRMRLDLEECATGVTKEVTVETAVLCDLCHGKGTNGNSSPATCDTCGGRGEIQTVQRSLLGQVMTSRPCPVCGGVGEVIPDPCHRCGGDGRVRARRDISVKIPAGVGDGMRVRLAAQGEVGPGGGPAGDLYVEVHEKPHDVFVRDGDDLHCTISVPMVDAALGCTVTVDAILDGPTELTIPPGTQPGSVTTLRGHGMPHLRSGVRGDLHAHIDVVVPTRLENSDIELLRKFKENRTRDTASVRTAQGSAGSGGGLFSRLRETFTGR

SEQ ID NO: 12798 - protein, 960 aa, Agrobacterium tumefaciens
MALVTEFDYGTPKSNATDMVTLTIDGRQVTVPTGTSIMRASREAGIDVPKLCATDMVDAFGSCRLCLIEVEGRNGTPASCTTPVAAGLVVHTQTERLKQIRKGVMELYISDHPLDCLTCAANGDCELQDMAGAVGLRDVRYGYEGDNHVKSRTGGGDINARWMPKDESNPYFTYDPSKCIVCSRCVRACEEVQGTFALTIEGRGFESRVSPGAHEAFLDSDCVSCGACVQACPTATLTEKSVIEIGQPEHSMVTTCAYCGVGCSFKAEMRGEELVRMVPWKDGQANRGHSCVKGRFAYGYATHRDRILNPMIRENIGDPWREVSWDAAFAYVASEFRRIQGKYGRESIGGITSSRCTNEETFLVQKLVRAGFGNNNVDTCARVCHSPTGYGLGQAFGTSAGTQNFDSVEQSDVVLVIGANPTDGHPVFGSRLKKRLRQGAKLIVIDPRRIDLVRTPHVEAAFHLPLLPGTNVAVLTALAHVIVTEGLFNEAFIRERCDWSEFEDWAAFVAEPQHSPEETERFTGVPAEDLRGAARLYATGGNGAIYYGLGVTEHSQGSTTVMAIANLAMVTGNIGRPGVGVNPLRGQNNVQGSCDMGSFPHELPGYRHISDDATRDVFEKLWGVKLNNEPGLRIPNMLDAAVDGSFKGIYIQGEDILQSDPDTKHVSAGLAAMECVVVHDLFLNETANYAHVFLPGSTFLEKDGTFTNAERRINRVRKVMSPKNGYADWEVTQKLAQAMGLTWNYTHPSEIMDEIAATTPSFASVSYAYLEEKGSVQWPCNEKFPEGSPIMHVDGFVRGKGKFIRTEYVATDERTGPRFPLLLTTGRILSQYNVGAQTRRTENVVWHEEDRLEIHPHDAEQRGVKDGDWIKLVSRSGDTTLRALITDRVAPGVVYTTFHHPGTQANVITTDFSDWATNCPEYKVTAVQVSPSNGPTEWQEEYDALARQSRRIAGKLEAAE

SEQ ID NO: 12799 - protein, 245 aa, Arabidopsis thaliana
MTESSIISVKQSSPVPEEEDHHHHQQDSHRTNTKKRVRSDPGYRGVRMRTWGKWVSEIREPRKKSRIWLGTFSTPEMAARAHDAAALTIKGTSAVLNFPELATYLPRPASSSPRDVQAAAAVAAAMDFSPSSSSLVVSDPTTVIAPAETQLSSSSYSTCTSSSLSPSSEEAASTAEELSEIVELPSLETSYDESLSEFVYVDSAYPPSSPWYINNCYSFYYHSDENGISMAEPFDSSNFGPLFPG

SEQ ID NO: 12800 - protein, 307 aa, Pseudoalteromonas tunicata
MLQNIAQSIFKLRNLINVQPFSFLIVTNPFQNALKRRLMAWLVNELANKNIRYQLYYTSTSFSENSRFFEQNLHLHQQVVVLGGDGTLHLVVNCMAHQLKPIALLPCGTGNDFARSLGFTMTQFKDAIFSSHQLQVDLGKVGERYFINVAGIGFDGQVVAHSIGKQKIGSWAKLAYLVLTLKHLFCYQAEPIALKHGGEPYHYQHFMTLFANGRYFGGGMKVAPKANIADGELECVMIRDCSLLTKLVQLIRMTFAMPLSPKVVKQMAIKEMSVLSVGLPIEADGEYIGLTPTIIKLVPNAILIKAP

SEQ ID NO: 12801 - protein, 604 aa, Eucommia ulmoides
MDAVTIRVPYRNLKQEVELVGIEEQPPRRVQIDQSSSGNSNGNVSNHSPNSSPSDLAPKQNTLFSLILCCTVAAGVQFGWALQLSLLTPYIQTLGIGHAFSSFIWLCGPITGLVVQPCVGIWSDKCTSKYGRRRPFILVGSLMISIAVIVIGFSADIGYLIGDTEEHCRTFKGTRTRAAFVFIVGFWMLDLANNTVQGPARALLADLAGPDQRNSANAVFCSWMAVGNILGFSAGASGQWHRWFPFLMSRACCEACGNLKAAFLVAVVFLTFCTLVTLHFAKEVPLTTPKQPQRLSDSAPLLGNPRQLSFDFSKQKTEMPLVNSETENKSESDSKTESNGKTEDQKVEKDQFESFNDKPGAVLVNLLTSLRHLPPAMHSVLLVMALTWVSWFPFFLFDTDWMGREVYHGDPKGDAAEVRAYDQGVREGAFGLLLNSVVLGVSSFLIEPMCQRLGSRLVWAMSNFIVFACMAGTAVISLVSDIEFGNEHVVGGKETIKTASLVVFAILGLPLAITYSVPFSVTAELTADAGGGQGLAIGVLNLAIVVPQMIVSLGAGPWDALFGGGNIPAFVLASLSALAAGVIATLKLPDLANSSYSSTGFHFG

SEQ ID NO: 12802 - protein, 567 aa, Oryza sativa
MASSHIILPPDDDDEEQRRLEEEEDEDPWARSGPPPAAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGFIAMYATLASRDVDCCLIPESPFYMDGEGGLLQYVERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 12803 - protein, 343 aa, Arabidopsis thaliana
MKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGYKGVGVAYNPRIDKWEAIGEVNYLDLGWIGCWMKLKGLEGLPEFASYSYVRLADYGGKMAVLWDKLPTTGNNNMVIWCAVITLEKRHNENIWGRVEWFDAVLTVPEPYEFVCARSANV

SEQ ID NO: 12804 - protein, 567 aa, Unknown
  Vibrio sp. Ex25
MTKILIVGGVAGGASAAARARRLSEDAEIIMFERGPFVSFANCGLPYHIGGDIQERSKLLLQTPESFLARFNVDVRVMNEVVSINRQDKTVTIKNLLDESEYVESYDFLLLSPGAGPIVPPIPGLDNPLTHSLRNIPDMDRIIETIQMNKPEHATVVGGGFIGLEMMEAFHQLGIKTSLIEMADQVMTPVDREMAGFVHAEIRDKGVDLKLGVALESVKFVPNEHVASFDSGESDKHQHLEGELELTLNNGEKLTTDILIMAIGVRPETKLAQEAGLQIGALGGIYTNEYMQTSDPSIYAVGDAIEEKDFVTGEQTLVPLAGPANRQGRMAADNMLGRKETYQGTQGTAICKIFGLAVASTGKNEKQLKCAGIEYDKVYVHTASHASYYPGAEVVSFKMLFDPKSGKILGAQAVGKDGIDKRIDVMAVAQRAGMTVEQLQHLELTYAPPYGSAKDVINQAAFVANNIIKGDAAAIHYDEIDNLTEDQILLDVRNPGELESVGYLEGAINIPVDQLRHRMGELPKDKEIVIYCQVGLRGNVAYRQLVNNGYKARNLIGGYRTLKFSRL

SEQ ID NO: 12805 - protein, 264 aa, Pseudomonas fluorescens
MRVALYQCPPRPLDVAGNLQRLHQVAMEATDADLLVLPEMFLSGYNIGLEAVGALAEAQDGPSAQRIAAIAQAAGTAILYGYPERSVDGQIYNAVQLIDAQGQRLCNYRKTHLFGDLDHSMFSAGEDDFPLVELDGWKLGFLICYDIEFPENARRLALAGAELILVPTANMIPYDFVADVTIRARAFENQCYVAYANYCGHEEQIRYCGQSSIAAPDGSRIALAGLDEALIIGTLDRQLMGESRALNRYLSDRRPELYDDLSKR

SEQ ID NO: 12806 - protein, 627 aa, Triticum aestivum
  misc_feature (322)..(322): Xaa can be any naturally occurring amino acid
  misc_feature (521)..(521): Xaa can be any naturally occurring amino acid
  misc_feature (532)..(532): Xaa can be any naturally occurring amino acid
  misc_feature (535)..(535): Xaa can be any naturally occurring amino acid
  misc_feature (545)..(546): Xaa can be any naturally occurring amino acid
  misc_feature (558)..(558): Xaa can be any naturally occurring amino acid
  misc_feature (569)..(569): Xaa can be any naturally occurring amino acid
  misc_feature (582)..(582): Xaa can be any naturally occurring amino acid
MGAAFLSSWPWDNLGIFKYVLYGPLVGKALASRAWEPASPDRWLCLLLALFALRAFTYQLWSSYSNMLFLTRRRRIVRDGVDFEQIDKEWDWDNFLILQIMMAATALYAFPSLRHLPGWNTGGLAVAALLHVAATEPLFYAAHRAFHGAHLFARYHALHHSNKVPTPFTAGFATPLEHLVLGLLMALPLAGACAAGLGSVGLAFAYVLSFDFLRAMGHCNVELFPGGLFRSLPFLRYLIYTPTYHTIHHTGKKANFCLFMPLFDRLGGTLDPESWELQRKNRAGMDEAPDFVFLAHVVDVMQSMHVPFVMRTFASTPFAVRXFLVPLWPIALLFMFMVWAWSKTFIISYYHLRGKLHQIWAVPRYGFHYFLPFAKDGINDQIELAILRAERMGVKVVSLAALNKNEALNGGGALFVNKHPDLRVRVVHGNTLTAAVILNEIPKGTTEVFMTGATSKLGRAIALYLCRKKIRVMMMTLSTERFQKIQKEAAAEDQQYLVQVTKFQSAEQCKTWIVGKWLSPXREQRWASPGTXFQXFLVPPILGFXXGDCTYGKLAAMXPPKGPPGGLRXLAKCEFSLEARGXVHACHRRRGRATSSEGGGPDAEGAIDVDRIDVVWEAARKAWSRPR

SEQ ID NO: 12807 - protein, 399 aa, Arabidopsis thaliana
MSSTSRSSAANNRKDPPRKKNKETPSPVTREPTSIDSLPNDLLLNCFARVSRMYYPALSRVSKRFRSIVTSPEIYNTRSLLNRTEKCLYLCLRFPFDNNTHWFTLYQNPNRTVSDKVFLQIPSPQYPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKTQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 12808 - protein, 160 aa, Pseudoalteromonas tunicata
MVPFYQFEAISLQGKPISFEEYQGKVVLVVNTASQCKLTPQFKALEALYQKYQSQGLVILGFPCNQFRQQEPGNAEDITQVCSLNYGVTFAMFDKIAVNGKHSSPIFQYLKQQLPGIFGSIIKWNFTKFLIGRDGQPIKRYAPITNPANIEQAIINALKN

SEQ ID NO: 12809 - protein, 257 aa, Acidobacteria bacterium
MGKVYLVGAGPGDPELLTVKAVRLLANADVVLHDALVSPAILALVNPKATVFDIGKRCGAKLLTQAEINALLIAYVQTSGTVIRLKGGDPSIFGRSGEELSALNEAGVEFEIVPGITTAIAAAASAQISLTDRRYASAITLMTAHRGRDEDAVEWDRLVTSGATIVIYMPGKDYRDISVQLQRAGLASDTPCVVVSHASQQDEQKLYTSLDALSRATALPAPSLLIVGRCASALERVEPQFLSLGTHRINGFEKEIF

SEQ ID NO: 12810 - protein, 357 aa, Unknown
  Synechococcus sp. CC9605
MTLWVVKIGTSLLRGETATTIDGYARCFAGAMDRGDQVVLVTSGAVGLGCQKLALTNRPDTVVALQAAAAIGQGALMGLYERAMARHGRSVAQVLLTRSDLADRRRYQNASGTLRQLLSWGVLPVINENDALSPAELRFGDNDTLSALVAAAVEAQQLILLTDVDRLYSSDPRVDANAEPISDIRHPRELDSLEQGAGDGGRWGTGGMTTKLAAARIATASGITVQLADGRDPARLEALLQGQRGGTVFHPHPEPLGNRRSWLAHVLRPEGELQLDAGACAALQHRGASLLLVGVTAVRGDFAANQPIQLLDPDGEDLGRGLCSMDSDQLRAAMNDPSPGESSPVVVHRDGLVLRSR

SEQ ID NO: 12811 - protein, 576 aa, Unknown
  Photobacterium sp. SKA34
MVQPNQKQETLVWWKEATAYQIYPRSFYDSNADGIGDIPGIITKLDYLADLGVDLVWICPFYQSPNDDNGYDISDYQAIHPDFGCLDDVDRLIREAHKRGIKIIIDLVINHTSDEHPWFIESRQNRNSAKRDWYIWRDGSEATTEKPTNEPNNWESIFHGSAWQYDAETAQYYLHLFSSKQPDLNWENPEVKAALFSMIHWWLERGIDGFRVDAISHIKKQANLPSLPNPNGDNYVSSFKYHMNVKEIEEHLHELRDKAFSPFDIVTVGEANGVAAEEALTWVAEETATNKAGVFNMIFQFEHMNLWSEDTNQSSFNLVEFKQILTRWQNALEGMGWNALYLENHDQARSINTFGNPNYRYASATALATCYFLMKGTPFIYQGQELGLVNYHFTSLDQFDDISARNLINKLKHQGKSEQYILSLLNRVSRDHSRLPMPWNSEENGGFSTVTPWITVNPNYELINVSEQLNNQNSVLQFYKQLIGLRKQHKSLIIGRYKLILADDPNIYAYQRISDDCTWTIITNLSDNVAKVDIDRSALGDLILDNQTGNNESAMTNFEKTGLASAYGAYVFMTKH

SEQ ID NO: 12812 - protein, 221 aa, Unknown
  Frankia sp. EAN1pec
MFFGRHKTTLPTADQALPGRGTPIFTGPDRHTVLGASLLGPFPEGLRTAVFGMGCFWGAERKFWQVPGVYSTAVGYAGGITPNPTYEEACSGLTGHTEAVLVVFDPAKVSFAELLRVFWEAHDPTQGMRQGNDVGTQYRSAVYTTGEDQAAAALASRDAFQRVLTAAGYPEITTEIAPAGPFYYAEEYHQQYLSDAKNPHGYCGLGGTGVSCPVGLASAES

SEQ ID NO: 12813 - protein, 206 aa, Unknown
  Marinobacter sp. ELB17
MARSKSSNRWLEEHVNDPFVKKAQMDGYRSRSSYKLLEINAKDKLIQPTMTVMDLGSAPGGWSQVATDLVGHKGRVIASDILPMDAVAGVEFIQGDFTENAVFEEIMAVLRDAKVDVVISDMAPNISGVNAADQAASMYLIELALDMASQVLKPKGSFVAKVFHGGGYDGYVKAVREQFDKVVVRKPDSSRARSREVYLVGKGFRG

SEQ ID NO: 12814 - protein, 156 aa, Acidobacteria bacterium
MSDTQYTSLPIPAQKRIALVAHDHKKRELLEWATAHRELLVRHDLYATGTTGGVLETLGLKIHKLLSGPLGGDQQIGAKIAQNEIDLVIFFWDPLEAQPHDPDVRALLRISAVWNIPVAYNRSSADFMISSPFMTTEYSRQIPDYSDYRHRLKPNL

SEQ ID NO: 12815 - protein, 553 aa, Desulfovibrio vulgaris
MFCFQCQETAKNTGCTVKGMCGKPEETANLQDLLIFVLRGIAIYGEKLKELGQPDRSNDDFVLQGLFATITNANWDDARFEAMISEGLARRDKLRNAFLAVYKAKNGKDFSEPLPEAATWTGDSTAFAEKAKSVGILATENEDVRSLRELLIIGLKGVAAYAEHAAVLGFRKTEIDEFMLEALASTTKDLSVDEMVALVMKGRRMAVTTMALLDEANTTTYGNPEITQVNIGVGKNPGILISGHDLKDMAELLKQTEGTGVDVYTHGEMLPANYYPAFKKYPHFVGNYGGSWWQQNPEFESFNGPILLTTNCLVPLKKENTYLDRLYTTGVVGYEGAKHIADRPAGGAKDFSALIAQAKKCPPPVEIETGSIVGGFAHHQVLALADKVVEAVKSGAIKRFVVMAGCDGRQKSRSYYTEVAENLPKDTVILTAGCAKYRYNKLNLGDIGGIPRVLDAGQCNDSYSLAVIALKLKEVFGLDDINDLPVSYDIAWYEQKAVAVLLALLFLGVKGIRLGPTLPAFLSPNVAKVLVENFNIKPIGTVQDDIAAMMAGK

SEQ ID NO: 12816 - protein, 137 aa, Glycine max
  misc_feature (71)..(71): Xaa can be any naturally occurring amino acid
  misc_feature (110)..(110): Xaa can be any naturally occurring amino acid
  misc_feature (131)..(131): Xaa can be any naturally occurring amino acid
KNKLLRTNNEKLTAGSMISCAAVTTVNRAGGDMVATFTGLMSMAGLPTTKTNDDISSIASNGGRVQCMQAXPPVGKKKFETLCYLPDLDDAQLAKEVEYLLRKGWIACWXFELDHRFWYREHNTSAEYYYXRYWTMW

SEQ ID NO: 12817 - protein, 511 aa, Mesorhizobium loti
MKIVLINPPHTAIGSRVPDDHLPPLGLLAIGGPLIDAGHDVRLVDAEFGPMPLDIVVRDALDDFPDFVLIGHSGSTSAHPTALLIAEMIKQREPATIIIYGGVFPTYHWRDILTDTDVFDFIVRGEGEATVVALVEALEMHQPPASVAGIAFRDDLHRPFATQAAMTIAELDAYRVGWELIDHRRYSYWGGKRAVVMQFSRGCPHLCNYCGQRGFWTRWRHRDPKKFAQEIAWLHREHGVELINLADENPTVSKKAWRAFLDALIAENVPVLIVGSTRADDIVRDADILHLYRKAGVIRWLLGMENTDEQTLQLIRKGGSTSSDREAIRLLRKHGILSMATWVAGFEDEGFRDLWRGFRQLIAYDPDQIQALYVTPHRWTPFFRIARDRKVIQKDARLWDYKHQVLQMTRLKPWMLFFSVKLIELAVQSRPKALARILFHPDPEQRHSMRWYTKMGRRVWFREVWGFLARDGRVKDGPTLAEFWGTPQDAEEESMSVARPPRKPAEAAVSI

SEQ ID NO: 12818 - protein, 469 aa, Vibrio cholerae
MRLVWFRRDLRSFDNTALTAALNSGDPVAAMYIATPEQWHQHHLAPIQADLIWRRLAELQQELAALNVPLFYQQVADFQAAAVAVSQLAKTLNATQVLANRDYELDEQQRDQLAQQLLSEQGIIWSAFDDKCVLPPGSVRTKQGEFFKVFTPFKRAWLTLFQPPVIGKNRPVALWNVPSALAELVWHPEQAFDYPRIDSTPWAADFETVRAQLRDFCRERVQDYHQARDFPAREGTSSLSPYLAIGVLSARQCVARLYHESSMGELSEGAQVWLSELIWREFYQHLVAIEPNLSKSRDFVEWGARLEWWNDNEKFQLWCEGKTGYPIVDAAMRQLNQTGWMHNRLRMIVASFLTKDLHIDWRWGERYFMSRLIDGDYAANNGGWQWCASTGCDGQPYFRIFNPVSQGEKFDPNGDFIRRWVPELRSVSSAYIHQPWTYPAVNSVLYPARLVDHKQEREVTLRLYKTAKG

SEQ ID NO: 12819 - protein, 471 aa, Vibrio parahaemolyticus
MILVWFRRDLRTLDHTALKAALDTGQPVVACFIATPEQWQEHHMAPMQADLIARRLEHVHQELTELNIPLLYKEVPRFDDCTQVICDWADKLNATAAMVNINYEVNEVELDRKVSQALDNRGVEFHAFHDKCVHAPTTVLNKQGEYFKVFTPFKRAWLQKFSLPTVSKPQRQNELPSAQLAAVKQDGFDADFTFSYPRESSEAWCVSTNDILKQLRTFARERSDGYQMKRDFPAIDGTSQLSPYLAIGALSPRQCIARLYAENPQPDLSEGKATWLSEIIWREFYQHLLVFEPKLVKGRGFIDWEDKIQWSYDEQAFECWKTGTTGYPIVDAAMRQLNQTGWMHNRLRMIVASFLTKDLHIDWRWGEEYFMSKLVDGDFAANNGGWQWSASTGCDGQPYFRIFNPISQGEKFDSDGQFVRHWVPEIKSVPNKFVHKPWTWEGFSLLEYHKPMVDHKVEREITLRLFKSAKE

SEQ ID NO: 12820 - protein, 105 aa, Haemophilus ducreyi
MTHQVTDATFEQEVLKSDLPVLLDFWAPWCGPCRTIAPWLDELAQEFAGRAKVAKVNVDENQQIAAQFGIRSIPTLLLFKNGEVVAIQVGVLPKSQLVTFIEQAL

SEQ ID NO: 12821 - protein, 374 aa, Prochlorococcus marinus
MADFYQILGVSRDADADTLKKAYRKLARQYHPDVNKEPGAEDKFKEIGKAYEALADPETRARYDQFGEAGLGGAAGMPDMGDMGGFADLFETFFNGFGGQNPQGGRTQRRGPQQGDDLRYDLNVEFKDAIFGQQREIKIPHLETCEVCRGTGAKQGTGPKTCSTCGGSGQVRRATRTPFGNFTQVAECPSCNGAGQIIADPCVNCGGNGVKQVRKKLRINIPAGVDTGTKLRVSGEGNVGLKGGPPGDLYVFIKVKNDSKLKRDGVTIYSEIAVSYLQAILGDTVKITTVDGEVNLKIPSGTQPNTTLSLENKGVPRLGNPVARGNHEVLVKVKLPTRITDGERELLEGLASQYSDKNINSTSGLFSKLFGKDS

SEQ ID NO: 12822 - protein, 546 aa, Zea mays
MGLGLGALLKSGGLSVSDHDAIVSINIFIALLCSCIVIGHLLEGNRWVNESITALVMGLITGGVILLVTNGTNSRILVFSEDLFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSVVLFNAIENLDIDNFDAIVLLNFVGKFLYLFFTSTILGVATGLLSAYIIKKLCFARHSTDREVSIMILMAYLSYMISMLLDLSGILTVFFCGIVMSHYTWHNVTESSRVTTKHTFATLSFIAEIFLFLYVGMDALDIEKWKLASSSPKKPIALSAIILGLVMVGRAAFVFPLSFLSNLSKKEARPKISFKQQVIIWWAGLMRGAVSIALAYNKFTASGHTEVRVNAIMITSTVIVVLFSTMVFGLLTKPLLSLLIPPRTGLNTSSLLSSQSMLDPLLTSMMGSDFDVGQINSPQYNLQFILTAPARSVHRLWRKFDDRFMRPVFGGRGFVPFVPGSPVERSVPESHLGTVTEAEGS

SEQ ID NO: 12823 - protein, 427 aa, Pyrobaculum aerophilum
MAHISGVYINSAFLENTLYTIKRGIELSGLPVEFYEIITKPKRIHIVYIPVKMDSGRIEVFEGYRVQHNDALGPFKGGIRFHPEVTLADDVALAILMTLKNSLAGLPYGGAKGAVRVDPKRLSQRELEELSRGYARAIAPLIGDLVDIPAPDVGTNSQIMAWMVDEYSKIAGRNAPAVFTSKPPELWGNPVREYATGFGVAVVAREMAKRLWDGIEGKTVAVQGLGNVGRWTAYWLAKLGAKVVAVSDINGVAYKKEGLNVDIIANNRGLGGPALLEAFVSKDGAQYVKDPDAILAVDVDIFIPAAIENVIRSDNAGRVKARLVVEGANGPTTPEAERVLYQRGVVVVPDILANAGGVIMSYLEWVENLQWLSWDEEETRKRLEAIMVNNVARVYQRWQKEKWTMRDAAIVTALERIYKAMKLRGWI

SEQ ID NO: 12824 - protein, 394 aa, Pichia jadinii
MTDIGESESDISTDVSALPMLSHSVSYTSIQKPPFVVSVIGSGNWGTTVAKIIAENTRENPLLFEQKVRMWVYEEEFEGSNLSDIINTEHVNKKYLPGIKLPDNLVAVPDLLEAVQYSNILIFNIPHQHLEKILSQLRGNIDPRARAISCLKGLRVNLDGVELLPDIIQDALGIHCGVLAGANLAQEVAEQRFSETTVGYPLPADYKPGDVDHTVLYTLFHRPYFHVHVIEDIAGISCAGALKNIIAISVGFVEGLEWGDNAKAAMLRRGLLEMIKFGRKFFPGCLVSSFTEESAGVADLFTTCTGGRNFKLAKIMAQTGKSAHEVEKEILNGQSAQGLITAKEIHELIKNKGCEEEFPLFETTYQILFHGVRIGILPYMLENKWSISKPNYSS

SEQ ID NO: 12825 - protein, 290 aa, Vigna radiata
MATATATAAATSSFMGTRLLDAHSGSGRIQARFGFGSKKKAAPKKVSKGPSTDRPLWYPGAKAPEWLDGSLVGDYGFDPFGLGKPAEYLQFELDSLDQNLAKNEAGIIIGTRTEVADVKSTPFQPYSEVFGLQRFRECELIHGRWAMLATLGALSVEWLTGVTWQDAGKVELVEGSSYLGQPLPFSITTLIWIEVLVIGYIEFQRNAELDPEKRLYPGGSYFDPLGLASDPEKKATLQLAEIKHARLAMVGFLGFAVQAAATGKGPLNNWATHLSDPLHTTIIDTFSSSS

SEQ ID NO: 12826 - protein, 420 aa, Unknown
  Burkholderia sp. 383
MPIPSGPTANPPMTPSLSLDTIVVGAGIGGLAAALALRRAGHRVTVLEQSRAFREVGAGLQVVPNATRALRALGVLDRQRLAAVAPTATIRRRWQDGSLLGSFPLGNEVEAAFNAPYWNAHRADLHAALLDAVRDPYTAGPPVAVLGGIAVRGLDACGPDGATLVDAAGTRWRADLVVAADGIHSTLRHALLGDDAPHYSGDDAYRALIDVDAIDPQSPVFEIVKEPQVTIWLGPGRHAIHYWVRDRRLLNLVVIVPGDGSTRESWSSKGDRATLEAELDGWDPRLVGLIRCASDLSRWSLHDRQPLTRWVWDSVCLLGDACHPMLPYQSQGAAQALEDAVVLGRCVTGLASKEALGAALVEYQRLRIDRSARIQLASAGNGGVFHLPDGPEQQARDAELKSRRADFKSYHWTWADAYQL

SEQ ID NO: 12827 - protein, 309 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 12828 - protein, 220 aa, Brassica napus
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDNHGAHAQEALRRAKFKFPGRQKIIVSRKWGFTKFNRADYTRMRQSKRIVPDGVNAKFLSNHGPLAKRQPGSAFISATE

SEQ ID NO: 12829 - protein, 1009 aa, Zea mays
MLSLHQQHGGAVAAGGDARHHAPQPSVLGGGADWLVFGGRADLEEPARNAPSPALFLLPPAGLDDRAAQPEPNPKPAQLAGAVDEERHLALAHQNYRSGKYREALEHGNVVYEKNPRRTDNLLLLGAIYYQIRNYDMCIAKNEEALAIDPHFAECYGNMANAWKEKGDIDLAIRYYLTAIQLRPNFCDAWSNLASAYTRKGRLNEAAQCCRQALAINPRLVDAHSNLGNLMKAQGFIQEAYSCYIEALRIDPHFAIAWSNLAGLFMEAGDLDKALMYYKEAVKLKPSFADAYLNQGNVYKALGMPQDAIMCYQRALQARPDYAMAYGNLATIYYEQGQLDMAIRCYNQAIVYDPQFIEAYNNMGNALKDAGRVEEAINCYRSCLALQANHPQALTNLGNIYMEWNMISAATSFYKAAISVTSGLSSPLNNLAVIYKQQGNYADAITCYTEVLRIDPTAADALVNRGNTFKEIGRVNEAIQDYVQAATIRPNMPEAHANLASAYKDSGHVETAIISYKQALRLRPDFPEATCNLLHTLQCVCDWENRDGMFRDVEEIIRRQIKMSVLPSVQPFHAIAYPIDPLLALEISRKYAAHCSLIASRFGLPPFVHPPPVPVKAEGKHCRLKVGYVSSDFGNHPLSHLMGSVFGMHDRANIEVFCYALSQNDGTEWRQRIQSEAEHFVDVSAMTSDNIAKLINQDKIQILINLNGYTKGARNEIFAMQPAPIQVSYMGFPGTTGAAYIDYLVTDEFVSPSSYAHIYSEKLVHLPHCYFVNDYKQKNRDCLTPVCPHKRSDYGLPEDKFIFACFNQLYKMDPEIFDTWCNILKRVPNSALWLLRFPAAGETRVRAYAAARGVRSDQIVFTDVAMKNEHIRRSALADLFLDTPLCNAHTTGTDILWAGLPMITLPLEKMATRVAGSLCVATGLGEEMIVSSMKKYEDRAVELALNPVKLQALTNKLKEVRMTCPLFDTARWVRNLERAYYKMWNLYCSSRHPEPFKVVEDDNESPFDR

SEQ ID NO: 12830 - protein, 181 aa, Vigna radiata
MASSMISSPAVTTVNRAGAAGMVAPFTGLKSLGGFPTRKTNNDITSVANNGGRVQCMQVWPTIGKKKFETLSYLPDLTEEQLGKEVDYLLRSGWIPCLEFELSHKDAFPHRENNRSPGYYDGRYWTMWKLPMYGCTDSSQVLKELREARTLYPDGFVRIVGFDSVRQVQCISFIAYKPPGY

SEQ ID NO: 12831 - protein, 138 aa, Coprinopsis cinerea
MARTKQTARKSTGGKAPRKQLAAKSSARKTAAAAAGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 12832 - protein, 242 aa, Unknown
  Synechococcus sp. CC9605
MRLMLSGSTPATKLSVDQLLDRFAKGTPRQRRPLINQIETRSEELAAVGSDLLSGFDPAGDDWAAGWILQVLQRHQPDAVTALIPSSDQGWWTTDSGVGLDYGPLQQELLEENFEEADRVTSQCLRELAGDAAVKRGYVYFTEVAPMSGVDLVSLDRLWTVYSQGRFGFTAQSQLLSALDGRYERLWPRIGWKCDGVWTRYPGAFTWSIEAPEGHMPLINQLRGVRLMDSLLNHPALVARRS

SEQ ID NO: 12833 - protein, 226 aa, Phanerochaete chrysosporium
MRARQYSISSSPLCDPTRASLTIRVFEAPTSPGRKDPLLGVASTYLGGLHPGDRVQLAVRPCKTAFRLPADPAVPLVLVCAGAGLAPMRGFLQERALQKEGGRDVGKSLLFFGCRHPEEDYLYRDEDLKKWVELGIVDVRVAFSRAQDQSLGCKHVQDRLWHDRTDVMDACDKGAKLYLCGSAKMAAGVKDKLVLVVQDAMQFEHAAAVEQFNTMMTGRFATDVFE

SEQ ID NO: 12834 - protein, 403 aa, Zea mays
LLSSDQKISETTSRLPPVACLSSGSETMAVLQVAAAAPPPVSVIGFEGFEKRLEISFSEAPVLADPSGRGLRALSRAQIDSVLDLARCTIVSELSNEDFDSYVLSESSLFVYPYKIVIKTCGTTKLLLAIPRILELAEELLLPLAAVKYSRGTFIFPEAQPSPHKNFAEEVAFLNRFFGGLKSGGNAYVRGDSAKLGQKWHVYYAAEHPEEPVVTLEMCMTGLDKKKASVFFKTTADGYSLCAKEMTKLSGISDIIPEMEICDFDFEPCGYSMNAVHGPALSTIHVTPEDGFSYASYEVMGFNPGSFSYGDLVKRVLRCFGPTEFSVAVTIFGDRANAKTWGTKLDAEAYACSNMVEQVLPFGGLLIYQSFTVMGETTHGSPRSVLHDFAGDIVKNRSESDAP

SEQ ID NO: 12835 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 12836 - protein, 285 aa, Xylella fastidiosa
MTTNDSWFTEHFQATGSAIGFRITGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMTDCPTNSVDVIIVDSTDPVGPAKGLFNRTFYESCFRALKNDGLLVQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 12837 - protein, 981 aa, Thermoplasma volcanium
MEVGEVIEFYAGSKSLKGEKNQTILQALLLNGIDIPHICYHPSLGPINTCDTCLVDMNGKIVRSCSTYLEQGAKIDYNSNRVLELQREAVQRMLHNHDLYCTVCDNNNGDCPLHNAVHDLEIDNQKYPYEPKPYPVDDSNPFYVYDPNQCILCGRCVEACQDVQVNETLSIDWSRERPRVVWDNDVPINESSCVSCGHCVTVCPVNALMEKTMLGKAGFLTGLEKNTKQKMIDVVKSIEPEITMSPIMAISNIESKMRSSRIKKTKTVCTYCGVGCSFEMWTMGREILKVQPQPESPANGISTCIKGKFGWDFVNSKERLTSPLIRDGERFRRATWEEALDLVAKKLREIKDKYGGDAIEFIASSKGTNEEAYLMQKLARQVFGTNNVDNSSRFCQAPATTGLWRTVGYGGDSGSIQDIYMADLVIAIGTNTAESHPVLATRVKRAHKLNGQKLIVSDLRMHEMARRADLFLHPKPGTDIVWLSAVTKYILDKGWEDKSFIRERVSGFEDYVKSLEPFTMEFAEEATGISKETLMKVANMIHEAKNMVILWAMGVTQHQAGSDTSTAISNLLLITGNYGRHGTGAYPLRGHNNVQGASDFGAMNAYLPGYQPVSDPTVRKKFEDAWHCTIPEKPGLDNNTCLEGIMNGKIRAMYVVGEELVETGSDSNFIRDQLEKLDFLVVEDLFLSETAKYADVVLPASASLEKEGTFVNTERRIQRIYEVMAPLPGTRPDWQIIQDIANRLGARWNYGHPSEIMEEAASLSPIFAGVRYELLEGFKSLQWPVRSDGKDSPLLYEKEFNFPDGKARLYPLKYNPPLSSGLEFDLHLNNGRLLEHFHEGNETYKSPGIRSKVPGTFVEVSPDLAKERGLETGDLVRITSEYGSIKVSVLVSDRVSGKELYMPMNASGDSAVNLLTGRLMDPTAHTPAYKEVSVRLEKITGKRGPPPLPSTNPRNAIPHPQIGVQVEKKWARKDYVKLTTE

SEQ ID NO: 12838 - protein, 359 aa, Unknown
  Dehalococcoides sp. BAV1
MVNKRDYYEVLGLERSASDEDIKKAFRKMAMKHHPDRNHEEGAADKFKEVNEAYEVLSNPEKRAAYDRFGFSAGADSFGQGGFENFDFGGLGSIFETFFGGATQGAKRGPRRGPDMSYDIKISLEEAATGVEKDITTERLEYCTECSGTGAKAGTSPVKCTSCNGTGQVYQVQKSVFGRFTSVTPCPKCRGEGTIIGEPCTKCRGTGKEYVKRTVQVKIPAGVADGNQIRLNGYGGVGDKGASAGDVYINVGIAEHADFKRDEDDVIYELEINFAQAALGTEVNVPGLNTEHKLKIPSGSQNGKYFVLKGKGIPHLNRFGSGDEMVHLNVVTPEKLSRKQKQLFEELEKSFAEDKKQAT

SEQ ID NO: 12839 - protein, 300 aa, Campylobacter lari
MKIAVVGAGKWGSALYDALSVKNECAITSFHEKDLSYFVSTKEALGYEYLVFALYAQGIHEWLVNNFKDLNQKILVASKGIDCKSLKFMDEVFGEFISSDRLCFLSGPSFASEVLEKKPCALVISGKNQNLCSKFASFFPNYIKTYTSLDVKGAEICGAYKNVLAIASGVCDGLNLGNNARASLVSRGLVEMHRFGQFFNAKEETFLGLSGAGDLFLTASSNLSRNYRVGSSLASGKNIKDVLIELGEVAEGVQTAYAIHALSKQFQIYTPIVNEVVLMLEGKNAWESLKDLMSSKEEIS

SEQ ID NO: 12840 - protein, 320 aa, Dehalococcoides ethenogenes
MDNITPEHNKHTNQNIAPDITKLIGNTPLVRLNRIGSGLKAEIVLKLESFNPTHSAKDRPALHMIEKAEQEGKLRPGSIIIESTSGNTGIALAAVCAARGYRLMLTMPESFSLERRRLLRLLGAELVLTPKELGMQGALEKAAELKNKLPETFIPGQFVNPANPESHCQTTAAEIWRDTNGKVDILIAGVGTGGTLSGTAKGLKAVKPSVQIIAVEPVESPVLSGGEPHPHLIQGIGAGFIPRILSVELIDKVIQVPGEEAVKMALRLAREEGIMAGISSGAALWAALETAKQGENCGKLIVAIMPDSGERYLSSLPLGD

SEQ ID NO: 12841 - protein, 197 aa, Zea mays
  misc_feature (99)..(99): Xaa can be any naturally occurring amino acid
MASPARRLLQTNSVQYPTLPAADPPSALAVDSDVVVILAALLCALICVVGLASVARCARSRAAPAAAARRGLRKKALRALPSLAYEDAVAARARGRGRXPGTGRRRSWPNCAICLSEFAPREEVRVLPQCGHAFHVACIDTWLAAHSSCPSCRRVLVVGDDASKRPPHQPKRCRKCDAAMDEPSSSSGSAGATPAGS

SEQ ID NO: 12842 - protein, 214 aa, Zea mays
MAQDLRSQDIKNPIDVAEYLFRRLQQVGVESVHGVPGDYNLVALDYIPKVGLKWVGNCNELNAGYAADGYARVKGISALVTTFGVGELSAVNAIAGAYSEYVPIVHIVGYPSTASQKNGALLHHTLGNGDFTVFSRMSKEISCAVSMLNSQHEAAMLIDNAIRECYLKSRPVYISLPSDMVTKKVDGDRLNTPLDLEYPQNDQEAEDYVCRCGL

SEQ ID NO: 12843 - protein, 330 aa, Oryza sativa
MVPEEPNVVNRITTAFWEFQLLACSDEPISSGTPSSPSSPLTKETGDANTVLIDDLFLAHSDAILAGGDQEDHQLGNDLGQQQAATAMEIDDDMIYSLIRNWDNDSSSSWIELLDHVVVSPASCFVPWKRTELDKQAVAGGGEAAQRLLKKAVGGGGAWMNRAAGSSIKNHVMSERRRWEKLNEMFLTLKSLVPSIDKVDKASSLAETIAYLKELERRVQELESGKKVSRPAKRKPCSERIIGGGDAGAVKEHHHWVLSESQEGTPSNVRVIVMDKDELHLEVHCRWKELMMTRLFDAIKSLRLDVLSVQASAPNGLLGLKIRAKVVSLT

SEQ ID NO: 12844 - protein, 386 aa, Unknown
  Candidatus Protochlamydia amoebophila UWE25
MADYYEILEVARGATPEEIKKAYRKKAVQYHPDKNPGDADAEKRFKEISEAYEVLSDEKKRQVYDRYGKEALQGAAGGGQGFSSMDEALRTFMGAFGMGGGGESIFDFFGGGNGAEFGGREGGRGARQGASKRVNINVSFEEAVKGVDKELVISNYANCNVCNGKGSSSSQGIKTCSECKGRGQVFEQRGFFSMTMACPKCHGEGKVITDPCKNCKGQGAVKEKQHIKVHIPAGVDSGMRLKMSGYGDVGQHGGPAGDLYVFINVEPHEIFEREGNDILLDLPISFAEAALGCKKEVPSLTNRACRITIPEGTQNGKIFRVKGEGFPNVHGHGKGDLLVRIFVETPTRLSERQKELLQEFSELEGPNNLPKRKGFLDKIKEFFSPN

SEQ ID NO: 12845 - protein, 420 aa, Unknown
  Frankia sp. EAN1pec
MHEPAMTNLSAADPEIGGLVEAEARRQYEKIRLIASENYVSTAVLEASGSVLTNKYSEGYPGKRYYEGQQVIDPVETLAINRAKSLFGVEHANVQPYSGSPANLAVYLAFLQPGDPVMGMGLPSGGHLTHGWTVSATGRWFRGVRYGVRQDTGRVDLDEVRDLALENRPKVIFCGGTAIPRTIDFPGFAAIAREIDAVLVADISHIAGLIAGGAHPSPVGHAPVITTTTHKTLRGPRGAMIMSDDTHAAALDKAVFPGLQGGPHNHTTAAVAVALREAATPDFREYAHRVVANAKALAEALSGRGFDLITGGTDNHLILIDLTSRGVAGKPAAKALDRAGIELNYNTVPFDPRKPFDPSGVRLGTAAITTRGLRPEQMPTLAAWIDEAVKAAGDADEATIERIAGEVRDLMSAYPMPGWV

SEQ ID NO: 12846 - protein, 569 aa, Campylobacter lari
MKELNGSQMICEALKEENVKVVFGYPGGAALNIYDEIYKQTHFKHILVRHEQAALHSADAYARMSGEVGVAVVTSGPGFTNTVTGLATAYSDSIPLVLISAQVANSLIGTDAFQEIDAIGISRPCVKHNYLVKNIEELPKILKEAFYIATTGRKGPVHIDIPKDITAAIGKWHYPKEISMKTYKPTYKGNIKQIKKLVSLIKNAQKPLFYLGGGCVASNASDELRELIHFCQIPAVETLMALGTLRSDDELNLKMAGMHGSYCANIALSECDLLIAVGARFDDRITGKTSEFAKGAKIVHIDIDPSSISKIIEAHFPIVGDIKSVILDTLEELKKESFDNTKYQEWFKTLQRYQQLYPLIYEDSDEVLKPQWVIEECARLAPDARIITDVGQHQMWVAQFYPFNYARQLATSGGQGTMGYSLPAALGAKLAVGEEVVVNFVGDGSFLMNIQELMTASAYKIKVINIILNNSFLGMVRQWQSMFYKERFSNTDLTSQPDFITIAKGFHCEGYNVCNKEEFQKAFKAALESKKTCVLNVAIDRYEDVLPMVPAGGAIYNMILPSYKNKDKK

SEQ ID NO: 12847 - protein, 163 aa, Gossypium hirsutum
MATYEGKVFTEEQEALVVKSWTVMKKNAAELGLKFFLKIFEIAPSAKKLFSFLRDSNVPLEQNTKLKPHAMSVFVMTCESAVQLRKAGKVTVRESNLKKLGATHFKYGVVDEHFEVTKFALLETIKEAVPDMWSDEMKNAWGEAYDRLVAAIKIEMKACSLAA

SEQ ID NO: 12848 - protein, 70 aa, Lolium perenne
SSRAMSIMNSFISDIFEKLAGESAKLARYNKKPTITSREIQTSVRLVLPGELAKHAVSEGTKAVTKFTSS

SEQ ID NO: 12849 - protein, 107 aa, Lolium perenne
MAPKAEKKPAAKKPVEEEPASEPAAKAPAAKKPKAGKSLPAGKTAAKEGGGVDKKSKKKNKKSVETYKIYIFKVLKQVHPDIGISSKAMSIMNSFINDIFEKLAGES

SEQ ID NO: 12850 - protein, 105 aa, Lolium perenne
MAPKAEKKPAEKKPVEEEPATEKAKKTPAAKKPKAGKSLPAGKTAAKEGGEKRGRKKGKKSVETYKIYIFKVLKQVHPDIGISSKAMSIMNSFINDIFEKLAGES

SEQ ID NO: 12851 - protein, 359 aa, Unknown
  Burkholderia sp. 383
MTFNAPTSLAYPARANLQGLFGFDSIRVPRYRLLDGATPIHPLPRLSAYLGGATIHVKREDVASVGGGGNKLRKLELLIGEALQSGADTVITVGARQSNHARLTAAAAAHAGMRCEVVLTRSVPRDDADYIESGNVLLDNLFNARVHDLPASADAMAYAIARADELRAAGHRVYVCPFGGSSPVGCLAYAACAAEIVQQSQALGTRFDRIIVPNGSGGTHAGLVAGFAALGTGTVEVDAYTVYAPAADAYRATLDKAQQTANIIHPDTEISPDAVRVDASQLGPGYGIPTDAMRRAVRLLASQEGLLLDPVYSGKAFAGLIEGVASGRYASDQSILFVMTGGLPGLFAYRREFQMALDG

SEQ ID NO: 12852 - protein, 466 aa, Xylella fastidiosa
MTVASVEQMFSGKIQVGSEVTVRGWVRTRRDSKAGLSFVSVSDGSCFAAIQVVTPAHLPNYETEVRKLTTGCAVIVIGTLAPSLGQGQQFEIQAQSIEVVGWVEDPETYPIQPKQHSLEFLREVAHLRPRTNLFGAVARIRHCLSQAVHRFFHENGYYWITTPIITTSDAEGAGQMFRVSTLDLVNLPRTETGGIDFSHDFFGKETFLTVSGQLNVEAYALALSKVYTFGPTFRAENSHTPRHLAEFWMIEPEIAFADLAEDARVAEQFLKFLFKTVLEERDDDLAFITERVEKTTISKLEGFINSPFERIEYTDAIKLLERSGKKFDFPVEWGLDLQTEHERWLTEKHIGRPVVVTNYPEHIKAFYMRLNDDGKTVAAMDVLAPGIGEIIGGSQREERLEMLDIRMAQFGLDPAHYQWYRDFRRYGSVPHAGFGLGFERLVVYVCGLSNIRDAIPYPRAPGSAEF

SEQ ID NO: 12853 - protein, 75 aa, Lolium perenne
MAPKAEKKPAEKKPVEEEPTTEKAKKTPAAKKPKAGKSLPAGKTAAKEGGEKRGRKKGKKSVETYKIYIFKVLKQ

SEQ ID NO: 12854 - protein, 209 aa, Haemophilus influenzae
MGKKKRSASSSRWLNEHFSDQFVQKAHKQKLRSRAYFKIDEIQQTDKLFKQGMTVVDLGAAPGGWSQYVVSQIGGKGRVIACDILEMDPIVGVDFLQGDFRDENVLNALLARVGEDKVDVVMSDMAPNFSGMPSVDIPRAMYLVELALDMCKQVLASKGSFVVKVFQGEGFDEYLREIRSLFDVVKVRKPEASRGRSREVYIVATGYKG

SEQ ID NO: 12855 - protein, 632 aa, Solibacter usitatus
MCGIVAVYDAEGAGASAEVAAGLKTLRHRGPDAQHVWLSPDGAICLGHARLSIIDLAHGDQPLANEDESIHCVVNGEFYDFERIRRGLEGRGHRFRTHSDSEILLHLYEDLGVECLRELRGEFAFVLWDGRRRVLMAARDRFGIKPLFYSRTGERLLFASEVKALHAAGVPAAWDEQGFLETFSAMYASSPTLFRHVSAIPPGHYLLSRDLGCSLHKYWDFEFPAEGNLPERRDEECVAEFGAVLDEAVRLRLRADVPVGCYLSGGIDSCSVLALMAKHAPGRVRAFSLSFDHELYDEGPIAREMAQRTGAEFTMIPVSHAGMAADLSDALWHNESFFLNAGSAAKFALSRAVRDAGYKVVLTGEGSDEVLAGYAFFRQDMIRHASNNGGAAEAIERLRAANPASGGLMFTTKQVTPVAGYVDRLGYFPSFLEARKAGLEALRALLTIAYETDEVLTRLLNRVDIAGQLTGRHVLNQSLYLNNKTILPGYILSALGDRVEMAHSIEARLPFLDHHVVEYTRRIPVDLKIRGTVEKYILREAMKPMLTTTVYKRQKHPFLSPPALLKPDEPLHALLQDTLRGRALDRVPYLRRTEVAGFLDRAGGLDVAGKIAAEFPLMMMLSACLVAERFGL

SEQ ID NO: 12856 - protein, 100 aa, Lolium perenne
MAPKAEKKPVEEEPAADKAKKTPAAKKPKAGKSLPAGKTAAKEGGEKKGKKKAKKSVETYKIYIFKVLKQVHPDIGISSKAMSIMSSFINDIFEKLAGES

SEQ ID NO: 12857 - protein, 556 aa, Glycine max
HASGKPKEGFDAVKQRQSQEQARRKKMSRAQDGILKYMLKMMEVCKAQGFVYGIIPEKGKPVTGASDNLREWWKDKVRFDRNGPAAIAKYQADNAIPGKNDGCNPIGPTPHTLQELQDTTLGSLLSALMQHCDPPQRRFPLEKGVCPPWWPTGNEEWWPQIGLPKDQGPPPYKKPHDLKKAWKVGVLTAVIKHMSPDIAKICKLVRQSKCLQDKMTAKESATWLAIINQEEDLARELYPDYCPSLTTSGGSGSMVINDCNEYDVEGGDDEPNFDVEDRKPENLHASNLGMDRMRGRLPVQQPSFPIKGEVVTNFDFIRKRKISGDFNMIMDQKIYTCEQPQCPYSETRHGFADRNSRDNHQLSCPYRGAASDYGASNFQVNEVKPVIFPQSFVQPKPTTQSVNLVPSVIDLTGLGVPEDGQKMISDLMSIYDTNFQSNKNLSSSNHVAAENPSLPQPGIRQQQDNFFRSQGITMEGNFYEEANMPNNHHMFAREESQFDRFKALNAPPFESNHNNNFHLMFGSPCDLASFDFKEDMQGGGGMDALQKQADISIWYQ

SEQ ID NO: 12858 - protein, 421 aa, Burkholderia vietnamiensis
MAVHQANAGLPAQAQTVPLRAWSVLAASTLAFMVCFVVWMMFGVLGVQLRADLGLNSTEFGLLTSTPVLTGALMRLPLGTWTDRFGGRIVMTVLLVVCAVPVYVVSYATQLWQFLVIGLFLGCVGASFAVGTPYVARFFPPQRRGLAMGVFGAGTSGAAVNLFVTPLLLNAYGWRVVPRIYAIALLATAVIFWLASAPDPGAGKRGGSLLDSFKVLRDPRVWRLCQYYSIAFGGFTALSLWIPQYLKNEYGMSLVMASAFAAGFSLPGSVLRALGGALSDRFGAHAVTWWGLWVAWISLFLLSYPATDFVIHTIDGTAALKLSMPVAGFVALTFVLGAVFAFGTASTFKYVADDFPDNMGVVTGIVGLAGGLGGFLLPILFGMLLDFARVRTTCFMLLYGIVWVSLILIYLTEVRRTPVTG

SEQ ID NO: 12859 - protein, 442 aa, Arabidopsis thaliana
MPALHPTFPLPETGHKLRPAATPPREKPQHRTTRSVENPPREKPQEKTRSVENPPREKPQEKTRSVETPPQEKTRPVDNPPSKPVEKLGLGRKAVPPSGKIVTPNLKMFTLVELKTATKNFRPESVIGEGGFGQVFKGWVDEKTLAPSRAGVGIPVAVKKSNPDSEQGLHEWQCEVRFLGKFHHPNLVKLLGYCWEENQFLLVYEYLPKGSLENHLFSKGAEALPWDTRLKIAIEAAQGLTFLHNSEKSVIYRDFKASNILLDSNFHAKLSDFGLAKNGPINGFSHVTTRVMGTQGYAAPEYMATGHLYVRSDVYGFGVVLLELLTGLRALDPNRPSAQQNLVEWAKPGLNQKKKVQKMMDPRLEQKYPLLAVTKTAELILRCLEADPKNRPPMDDVLRELEVVRTIRDQPQEERRKRSSGPDTNRVRGNDSPYGRRTGRTG

SEQ ID NO: 12860 - protein, 115 aa, Casuarina equisetifolia
ACLNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVP

SEQ ID NO: 12861 - protein, 459 aa, Aspergillus nidulans
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDVPAGDIGVTGREVGFLFGQYRRIRNQWEGVLTGKGGSWGGSLIRPEATGYGVVYYVEHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 12862 - protein, 399 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQISLGNEKGLTPLINIQGYVLGNPVTDKNIETNYRVPFAHGMGLISDELFESLERSCGGKFFNVDPSNARCSNNLQAYDHTYRYFLSAFWANDENVRRALGVKKENGTDATAKTYHIHLRFSMQFLITGDHDSMVPFSSTQAWIRALNYSIVDDWRPWMMSSNQVAGEEDTQRSILQINALLCSEDGLMENLSKDSHSLLSLSLFVVVTV

SEQ ID NO: 12863 - protein, 414 aa, Cytophaga hutchinsonii
MKDHAKKEDTGLSRRSLLAMAGLATVAFVQTSLGKTVQMLQPPAMFLSDDPTKSIGAPPGLVGNRSAYENPVKKTSDTSSRTPLQDLYGTITPSDLHFERHHAGMPDINPEAYELIIHGMVDKPKKFSLQDLKRFPSVSRICFLECSGNYRTGKETMTAQEICGMTSQSEWTGVMLSTLLREVGIRDTAQWLLAEGGDAAVMTRSIPVTKALDDAMIVYAQNGEALRPQQGYPVRLLLPGWEGNTNIKWLRRIEVSDAPFMTREETSKYTETIKGGFYRQFSFDMDARSIITFPSYPRQVEKGWIEIQGIAWTGRGKVLRVDITTDAGKTWLPAQLQEPVLDKAHVRFRFLWNWNGDETEIASRVTDETGYQQPFLKQLLEARGGVSGGYHFNPVTFWRVKKDGLVVLNPDAMK

SEQ ID NO: 12864 - protein, 550 aa, Wolbachia endosymbiont
MNNNNPVVNLPVTIRKLSSNKFIEEICQGQFEDQDNTLFEDSFVNKIKEGDVVEGVITRINPNDVVVDIGLKSDGRILIKELGCNDEVIIGSKIRVYVERIEDYHGNVVLSREKAIRDEKWNKLEEDTVTRAEVSGVIKRSIKCGFIVDLGDGISAFLPLSHVDLKQVKDAKHLIETEQKFIVLKMDKKQGNIVVSRKLVLEKLHAGEKIKFLESLNEGDIIEGKIKSITHYGVFVGIHESDVVGVIDGLLHITDISWSRVSHPSAVFTCGQTIKVKIIKIDKENAKISLGVKQLEDSPWQDAESKYPVDSVHKGYVTSIEDYGLFVELRPGIEGLVHSSEITWVKSNLPVSSLVTRGQEVYVKILSIDIAKSRMSLSMKRCVDNPWQVFINKYPPGSIVSGEVKNNTGSYVSVAFGDSEIDENVEGTIYVKDFSWSKNGSDEIKKYNVGDKIEAKVIRANVNRARIYLGIKQIEYDPLEELIKKVKVGDKIQVIVDKRENNGLVVEVENDVTLLIDQEHLPENKKFSISEKIEVEVLGVEEYNIALSAK

SEQ ID NO: 12865 - protein, 359 aa, Unknown
  Dehalococcoides sp. BAV1
MSKVCIIGTTTWGITLGTIIAHKGREVMLWARTEDEAVLLSTQRRPADFLPENYHFPEFMNVTASLEEAIAGADMVLLAVPSQRMRPNIRLVAPLLTKSMLICSAAKGLEIGTAKRMSQVITDEISPDFAKNICVLSGPNLAMEILKGLPAVTVLAADTEKTAKKAAKLITAANFSAYTNTDIIGVELGGSLKNIIALGAGIVDGLNLGNNAKSALITRGLTEISALGAALGANPLTLSGLAGLGDLIATCSSNLSRNHFVGVELTKGRSLNDIMYNMSNVAEGVSTTAVAYEMARSMDLEMPVTENIYNVLYNNADPKEAARILMDAQATHELAGRKWNLFKMFRKRKARKTPELNPD

SEQ ID NO: 12866 - protein, 957 aa, Escherichia coli
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLTRAEAAEINLRSDILNAVGITLDETTTRENVMQLFSVLLGDNHGLDIDTLDKDVAHDSRSIQPAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESCNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 12867 - protein, 411 aa, Nicotiana tabacum
MNALAATNRNFKLAARLLGLDSKLEKSLLIPFREIKVECTIPKDDGSLASFVGFRVQHDNARGPMKGGIRYHPEVDPDEVNALAQLMTWKTAVANIPYGGAKGGIGCSPSDLSNSELERLTRVFTQKIHDLIGIHTDVPAPDMGTNPQTMAWILDEYSKFHGYSPAVVTGKPIDLGGSLGRDAATGRGVLFVTEALVKEHGKSIAGQRFVIQGFGNVGSWAAKLINEQGGKIVAVSDITGAIKNENGLNIASLLKHVKENRGVKGFNDARPIDPHSILVEDCDVLIPAALGGVINRDNANDIKAKYIIEAANHPTDPEADEILAKKGVVILPDIYANSGGVTVSYFEWVQNIQGFMWDEDKVNAELKTYMTRGFKDVKDMCKTHNCDLRMGAFTLGVNRVARATVLRGWEA

SEQ ID NO: 12868 - protein, 282 aa, Novosphingobium aromaticivorans
MTEITVAALQLPLGGGEAENIPAVAALVEEAARGGAQIVLPPELFAGPYFCKVEDEGLFGLAYTLDEDPSVREMRKLAKAHGIAIPTSFFERDGHHYYNTLAMIGTDGEVMGIYRKSHIPDGPGYEEKYYFRPGNTGFKVWDVFGARIGVGVCWDQWYPECARAMALMGAELLFYPTAIGSEPYDADLDTSRMWRRAMLGHAVSNCMPVIAANRIGTEDGQKFYGHSFISDEWGDFLGEFGAAETGVLTATIDLARAARHRAGMGFFRDRRPQLYARLAEDK

SEQ ID NO: 12869 - protein, 823 aa, Candida albicans
MTEINDSTENITRIDRNDAKELKHWLAKANCQHHYSKFIENGITMDLLPELDTGSLKELGISKLGDRLRLEIAISNLKAENLKELISVDEIYQLLNLNPQPSGSLTNLNNNNNSLLDVSNSNEGTLTQLSQNNSSNNLPISSMNSSTNNINGNTINSSSGNVVGNSASSKDSSKTITFILQDGSTKRVNATGCFNAQAIKRRVLKKLGFKPDEIQFDTYVHSVPHGVENVLYGKTEPTITLLYDVELVTICYSPERLEKYRIMLVPKNEPPTPAAIETSKKIMSKYKKQVSGSKAELQEEVNQLHTKDVQAHRSTLRNFFGQRPPSELISSNLAEYFPDTRQKDLEQTVRNSVRHSVRLSRRFNLPAGAFSSSVYSLNKRQSILSNSTGFPSNRTMSISSGEQQSGVFNTSGGGSGGLRRAQRTIGDVMVNSITAIDEVVNSNDTFSVFNKPSTSFSNQPVQPLNNHDSRSIISSKSLSGGTALHRISISPNYNDNPAHDRHSTIELLNPSDSEGEDGEEDGEFGISDYAGLSSSSGENGPPENWLKGARIGSGSFGTVYLGMNPFTGELMAVKQIPLVNENGNNSDTENIQNSMQEQQREMMLLKELNHENIVRYFGSTTDENFLNIFLEYVPGGSVQSMLNSYGPFEEPLIRNFVRQVLIGLSYLHGEDIIHRDIKGANILIDIKGTVKIGDFGISKKVSAIDEEDEDFKKTGKRASLQGSVFWMAPEVVKQTTYTKKADIWSVGCLIVEMFTGRHPFPELSQMQALFKIGNHITPQIPEWCTNEAKEFLKKTFEINFEMRPDAIELLAEQFLNPLIMSKQ

SEQ ID NO: 12870 - protein, 178 aa, Novosphingobium aromaticivorans
MSEQATAILAGGCFWCTEAVFRDVIGVSNVESGYIGGTVESPTYKQVCSGSTGHAEAIRVTFDPQVIGYGQILDIFFATHDPTQLNRQGNDIGTQYRSALFPLDDEQRSEAKAAIGRAQPDWPRPIVTTIEGPATWYPAEDYHQEYWEGEGQRNPYCLAVIPPKLMKLRKSFANKVKA

SEQ ID NO: 12871 - protein, 384 aa, Pseudoalteromonas tunicata
MTIRKFHKNNKQENRNVCLIPDSAHGTNPASAQMCGMKVVVVNCDEDGNVDIDDLKNKAEKHSKDLAALMVTYPSTHGVFEEKIMDICEVIHKHGGQVYMDGANLNALVGVAKPGKFGPDVCHINLHKTFCIPHGGGGPGMGPIACAQHLAEFLPTHEIIREAGPKNGMGAVSAAPWGSSSILPISWMYIKMMGAEGLKKASQVSILNANYISKKLSKDYKVLYTGKNGNVAHECIIDIRPIKASSGISEEDLAKRLIDFGYHAPTMSWPVAGTIMIEPTESENLEEIDKFCNALIKIKKEINLVETSKFDKIDNPLKNAPHTYVELASSEWKHAYSREEAAFPTEYVKNNKYWAPVARVDNVFGDRNLVCSCPSMDEYKDEAA

SEQ ID NO: 12872 - protein, 582 aa, Bradyrhizobium japonicum
MNPTAGKTSATGEQMASTSADTYSPSRDDFAAMLDESFAGGNLQESSVVKGKVVAIEKDMAVIDVGLKTEGRVALREFSGPGRDSEIKVGDEVEVFLDRIENALGEAVLSRDKARREESWGKLEKAFQNNEKVNGVIFNQVKGGFTVDLDGAVAFLPRSQVDIRPIRDVAPLMNNSQPFQILKMDRRRGNIVVSRRTVLEETRAEQRQELVQNLEEGQVIDGVVKNITDYGAFVDLGGIDGLLHVTDIAWRRVNHPTEVLSIGQTVKVKIIKINHETHRISLGMKQLLDDPWQGIEAKYPLGARFTGRVTNITDYGAFVELEPGIEGLIHVSEMSWTKKNMHPGKIVSTSQEVEVQVLEVDSVKRRISLGLKQTMRNPWEVFVEGHPTGSVVEGEVKNKTEFGLFLGLEGDVDGMVHLSDLDWKLPGEQVIDNYKKGDMVKAVVLDVDVEKERISLGIKQLEGDPFAEPGDVKKGAVVTCEVLEVKESGIEVKIAGTDFTTFIKRSELARDRNDQRAERFAVGEKVDARVIQFDKKARKVQVSIKALEVAEEKEAIAQYGSSDSGATLGDILGTALKNRDSK

SEQ ID NO: 12873 - protein, 592 aa, Debaryomyces hansenii
MQTVKAEHIDKLRIKLFQSCQILTNLNLFQAAKWCAEALNGLSQTDQNESVPYEYPIIEQDPEDKMDQEKFMLAKAYFNCKEFDRASYVLKDCKSGSALFFRLYCILISVDKKATEETDGSINLGSLFLLGNGNHEPSDNEFNNAASRGKDELVGSLNIKLSKIIQESENYHSKPENKPNAFLYYLNGIVYNKKKKYAMAQHNFFQSLRLFPYNWSCWQELISTLNTFDEAIAFINKLKSAKSSLTNNIMFHFFEVVILQEFYQQLASLKANLDNLINTFPKFNFLKVQQFLIAYHGLDYFQAESIFDQILIEDPLRLDDLDTYSNMLYVMEKRSKLSFLAQFASLVDKFRPETCCIIANYHSMKCEHEKAIMYYKRALTLNKNCLSAWTLMGHEFVELKNSHAAIESYRRAVDTNPKDFRAWYGLGQAYEVLDMHLYALYYYQKATSLQPLDKRMWQAIGNCYEKIEKYDEAIKSFEKALKIDNYSKGGLDNVEEVINYEPHICFRLATISQKLGRSKDTYKYMKLCFDQEYEWGVSDETSKARLWLARSALENHRFEEAYELAKDLNHSNAHDVEEARSIARESRNRMLK

SEQ ID NO: 12874 - protein, 1930 aa, Bacillus cereus
MSTVNLYNKEEFLAFKSLFEANVHSGELSKALTQIEGLLTQYSDHPGLFYLAGLLFLHNQNYDKAKMYFEQALSLDESNSEYMVYLGITYVELNQLNQAETLLLSAYNLGESDITTLMGLGKLYLKQENYEKARFYFNKVLSQDSLHHEANVRMGQAYLFEKKHVQQAITYFEQALKNGKSDELEYYYAKALLQSEMEAQCIKCCKKFLMRNPNSSWADRFRELMLNAQRVNVKQPPKEEYKQQRRRDPNYDSNTGEQNRNNEIDKYKRVFEDGKKRLNSYILGQEEFIDQLCMGYMRSFIYERPDANLKNVIFVSGRKGTGIYKSVKYLTAIMNEYDLYEKPDVHYIDISSSLGASDIESTFLSDVYRGIKSESDVLYFDNVDKCPPDLISKLSELIMDGKIKLKDRYVYNANWQSLEKTYSSLAEKSIDSIQIENKLIILSTEKDLKDIRTMFPATVLEKIIDYPQTSVLPPRTLTKISDRYLKKYQKRIHTKLQVNMNYTHGVSDFIVEKANLTMGVHGIKSYIEDDIYQSITNLRISGKIEPGIIYQLTASDELYLDDGVEKIQVTRKKAGAENLENIKKEFEKVIGLNAVKERVFQLEEFLALQKIRQSRGAKQTRLTMNFIFTGNPGTGKTTIARLVAKYLKALGYLSSGHLVEVDRARLVAQYVGQTGPKTQAVIDSAKGGVLFIDEAYSLARGGENDFGKEAIDTLVKGMEDLREDLVVILAGYKDEMDDFLKTNPGLQSRFNNHIDFPDYTSEELFMISEKIVESEGFTIADDLKDDLIEEFTRKQIPGKNDSGNGRLARNIVEKAIAEQSGRLKNSGESLKFLSDEELNMLTKEDFGLGGENTFDLNAELDKIIGLDQVKEFMREMELQLVAQKKRKTAGLHSTMNQSLNMIFTGNPGTGKTTVARLLGTMMKEMGILKSGHFVEVDRGGLVGRYVGETAPKTTDKFMSALGGILFIDEAYALATDSFGKEAIDTIVKLMEDHRENIIVILAGYEKEMKEFLKTNAGLKSRFPLNVDFKDYSLQELVAIGESMIKGREFILTEEAREALVERVESEMQLSSAESGNGRMIRNIVEEGIRRQSARISKSEYEYADSTELITFKASDFLVDTRDKDFDLEKELETIVGLTDIKDFVRSLEKQLSAEQLRQSAGIKNRVSQNLNMIFTGNPGTGKTTVARVVGDLLKRMGILKSGHFVEVDRGGLVGRYVGETAPKTTDKFMSALGGILFIDEAYALATDSFGKEAIDTIVKLMEDHQGNIIVILAGYEKEMEEFLKTNAGLKSRFPLNVDFKDYSLHELVAIGESMIKGRGFHLSEEAREALVERVESEMQLSSAESGNGRMIRNIVEEGERRQSARISEDGYEYTDSTELITFKASDFLVDTRDKDFDLEKELETIVGLTDIKDFVRSLEKQLIAQQLRQSVGIRQKSSQNLNMIFTGNPGTGKTTVARVVGDLLKRMGVLKSGKLVEVDKSNLISPYAGQTPEKVREVFMSALGGVLFIDEAYALSTDNVGREAIDTLVKLVEDHRDSVIVILAGYEKEMRDFLQANSGLKSRFPNDVYFPDYSVAELVEIAKVATEKAGLVLAEESIAPLSKVLAREVKRLKADAGNGRLVRNVIEKAKRELDNRIVNEGILDGNEMVTLLPEDFEKEQNNATAEFQLEEHLQKIIGLNEVKDFMRSLQDQIRITQTRKNLGLPVDEGSALHMIFTGNPGTGKTTVARVVAELLYQLGILSSNKVIEVDRSGLVAGYVGQTAIKTKEVIQSALGGVLFIDEAYALAKDVNTSHGFGKEAIDTLLKAMEDYREDLIVILAGYTDEMEGFLNTNPGLRSRIPNKIEFKDYSVDELLQMGEKMFKENGYELTEAAYEKLREKTEIARTAEQFGNGRYVRNVYEETKRNQAVRLRGVNLTLDNLMKIEETDIK

SEQ ID NO: 12875 - protein, 953 aa, Oryza sativa
METTVSLLPHLLVKPSSSFSCCFTMFISISAHVHINLISGIGRRYGRIKVYAVLGDDEAQHAKNNMRGALFHVDNPGPMAPIAKGNFLDVNQALEVVRFGIQYCDWRARQDLLTIMVLHNKVVEVLKSLAIEFKSNGTLRKELAELQEELAKAHNQVHLSETRASSALDKLAQADNLVNDRLLQDGGSSASIDNYVSLASRTSSASRFVNKKTLRPSLDVSGPVQPYNPNLKNFWYPVVFSGDLKDDTMVPIDCFEEQWVIFRGKDGRPGCVQNTCAHRACPLHLGSVSEGRIQCPFHGWEYSTDGKCEKMPATKLLNVRIRSLPCFEQEGMVWIWPGDGTPESTIPSLQPPSGFTIHAEMVMELPVEHGLLLDNLLDIAHAPFAHTSTFAKGWSVPSLVKFLTPASGLQGYWDPYPIDMEFRPPCMVLNEDLRLVLGQQERMINGANVWNWPVSYDKLGIRYRLWRDAIERGANRLPFNNQSHSLGARSASILSRRSSRQGSRGSISLSREMGDSILSSMRHSLQSADQLLGDVDGSVLAQVIDSGDRGLAFENDVDEEEENNVEDHQAVPLPDDTSMRIHGRSSQGTSVVAPVSAMKPKDTNVNGPASSSIKVEPYKLSWMQDYASYLIHLAVFGFLGVFTRYGLQKLFGPSCLALTSDQSPLYLDLPSNMLGSFLMGWFGIIFKADIRHISDHLIVGITTGYMGSLTTFSGWNQKMVGLSSKGHWVYAVAGIVLGMFIVNESITVGAETGERLRGWILKCIIEKNSIGSKCGWEDWRVDTRTKHYALLGVMVILMSLIWILSIVLAIVKVHSLGHGAVLWLGCSVAPPGVWLRWYLARLNGGGIGIGKRRHLKWLPVGTLAANVLAAAIMAALAVTAKAENTRRLTTVLNGIQLGFLGCLSTVSTFAAEVYTMRRSGQIARAFVYAAATFVLSFVLGTLIYSVPVWVEHY

SEQ ID NO: 12876 - protein, 435 aa, Dehalococcoides ethenogenes
MKADYLIVGCSAGGIGAAEAIREVDRDGSIVIVGEEPYLAYSRPMIAKYLSGQKTVEKILFRRPEFYTNNNITCLTGVKAEAVDTTAHEVSLSNGEKVAYGKLLLAPGGKPIVPPIDGANKAGVFNFINMKDASLIDSYVKAENVKKAVIIGGGLIGMSAADALTKLGIEVDIIELKGHILNTILDEAAGKIAAQTVTSYGVKLNTGRTVSKVLGLHKVSGVELDNGHQIESQMLVIAIGVIPRTELCKAAGLEVNRGVVVNDNMRTSSPDVYACGDACESFDFIYNSRRVTPIWPNAYIGGRIAGYNMAGLETTYHGGTVMNSLNYFGMDIATAGMSVLPPDAGGLEVISTLTANGYKKLVLNEQGKIVGMLTLGETDTAGIIFGLMRDQSDVRPIKDNILNENFGLAYLPADSREEHLHGNTSGRVAPADFKH

SEQ ID NO: 12877 - protein, 556 aa, Oryza sativa
MTTVASLSLLPHLLIKPSFRQWFQGSVILQTPYLKTCCIEGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERMINGANVWNWPVSYDKLGIRYRLWRDAIERGVDRLPFSNQSESGS

SEQ ID NO: 12878 - protein, 255 aa, Oryza sativa
MGSDASSAADAMGVLRAAVPLQPDADLVLATGGGGGGGERGQVVGLVLVDVSNGFCTVGAGNLAPVTPNKQIEKMVDEAARLAKVFCERNWPVFAFLDTHYPDKPEPPFPPHCIIGSGEENFVPALEWLEKDPNVTIRRKDCIDGYLGAFEKDGSNVFSDWVAKFQIKTVLVLGICTDFCVLDFASSALAARNIGRVPPLEDVVIYSEGCATYNLPVEVARSMQGTLAHPQDLMHHMGLYMAKSRGAKVVDRIII

SEQ ID NO: 12879 - protein, 539 aa, Prochlorococcus marinus
MAFKFPLKKITKNTNREVFKKVLIVRLPCNPIFPIGPIYLADHIHKCFPEIEQQFIDLAIVPSKNISKYLKRKIDQFRPHLLIFSWRDIQIYAPVDGRSGNPLQNSFEVFYSNNIFKKIRGAWGGLKLITSHYEEINRNTSLVKMGLKRAQKYNKSVKVILGGGAVSVFYEQLGKLLPKGTVISVGEGENLIEKIIKGDSISKERCYLAGQKPRNKLIHEQPSGTVKTACNYKYIKAIWAEFDWYIEGGDYYVGVQTKRGCPHNCCFCVYAVVEGKKVRVNPINEVIKEIKQLYEMGVRGFWFTDAQFIPTRNNIKDAKLLLQAIKDQGWNDIKWAAYIRADNIDRELAQLMVDTGMSYFEIGITSGSQELVRKMKLAYNLKTVLENCRMLVDAGFRNHVSVNYSFNVFDETPNTIKQTIAYHRELENIFGKGLVDPAIFFIGLQPHTLLEKYALENNILKPNYNPMSMMPWTARKLLWNPGPLGKKLGEVCLEAFENQDDEFGKTVINILERNYGKASLDDSLKVRKFSERKLSSAKL

SEQ ID NO: 12880 - protein, 167 aa, Amorphophallus albus
GTADAVRQFIWVFEDPRNKNIEHVLILSGDQLYRMDYMDLVQRHMDTRADITVSCVPVDDSRASDFGLMKIDKVGRIVHFSEKPKGSVLDAMKVDTTIPGLSPYEAKNFPYIASMGVYAFRTEILLNLLRWRYPTSNDFGSEIIPSAVNEYNVQAYLFKDYWEDIGT

SEQ ID NO: 12881 - protein, 476 aa, Tropheryma whipplei
MRADIGVYGLAVMGSNLARNFAGKGIRVAIHNRSSDRSNSLAQQHSECNFIVAKDDKDFIDSLSSPRTVLLMVKAGSIVDEVIARLSTFMQPGDVIIDGGNSLYTDTIRREEELKARGLHFIGLGVSGGEVGALEGPSLMPGGSDYAYSIVGPMLEKIAARANGEPCVAHIGHNGAGHFVKMVHNGIEYADMQIIAESYDLLRRGLGLSPTRISDIFREWNSGELESYLVGVTADILSHRDKRTGKPFVDIVLDQAGAKGTGAWTAQNALDLGVPAGSVSEAVFARSLSSDEQRCQVQQKLSRSQASSHEAPLKEAEFIDAVRNALYLAKILAYSQGFRIISVAAAKHDWGIDLSACARIWRAGCIIRAVFLDKVAHEYSKNPDLTSLMCSPGFSDELVGRLRFLREVVASAARLAIPAPVFSSLLSYIDALASDRLPACLIQAQRDDFGAHTYRRVDVPGIFHTLWSSDLSEVPA

SEQ ID NO: 12882 - protein, 165 aa, Amorphophallus albus
GTADAVRQYLWLFEEHNVMEFLVLAGDHLYRMDYERFIQAHRETDADITVAALPMDEKRATAFGLMKIDEEGRIIEFAEKPKGEQLKAMKVDTTILGLDDERAREMPYIASMGIYVVSKDIMLELLREKFPGANDFGSEVMPGATSIGMRVQAYLYDGYWEDIGT

SEQ ID NO: 12883 - protein, 579 aa, Gibberella zeae
MCGIFACHRHPDVEKFKPTALKLAKQIRHRGPDWSGSVISNHTILCHERLSIVGVESGAQPLTNADDSIILAVNGEIYNHRHIRKHLKERYHFKTTSDCEVIIPLYTEFDTDAPNHLDGMFSFVLYDKKQDRTIAARDPIGITTFYQGWSSTEPGTIYFASELKCLHSVCDKIVAFPPGHVYDSKTGETTRYFNPSWWDPKKVPSTPVDYKVLRQALEKSVRKRLMAEVPFGVLLSGGLDSSLTASIAQREVTRLRKQALEANGNVLPVEDPDTGEGLVGVDDDDHLDTLTYLPQLNSFSIGLPGSPDNKAALEVAKFLGTKHHVMTFTIEDGLNALSDVIFHLETYDVTTIRASTPMYLLSRKIKAMGIKMVLSGEGSDEIFGGYLYFHAAPDKDSFHEETVRRVKNLHLSDCLRANKSTSAWGLEARVPFLDKEFLEYSMNIDPQDKMITKEKLEKYILRKAFDTSDEPGEQPYLPDNILWRQKEQFSDGVGYGWIDALKDTAEKQVTDEMMKNPKPEWGNDIPDTKEAYWYRCMFDEHFPPHCASTVMRWTPTWSKQTDPSGRAIATHNAKYDSAA

SEQ ID NO: 12884 - protein, 315 aa, Glycine max
MAEHLASIFGTEKDRVNCPFYFKIGACRHGDRCSRLHTKPSISPTILLSNMYQRPDMITPGVDAHGHPIDPRKIQDHFEEFYEDLFDELSKYGDIESLNVCDNLADHMVGNVYVQFREEEHAANAVRNLTGRFYAGRPIIVDFSPVTDFREATCRQYEENTCNRGGYCNFMHLKRISRELRRQLFGKSHGRHSRSRSRSPYRHRSHEERSHRSHSRKYDDRDHHHESRSRRHRSTSPRHRRGRSRSRSPGGRRHHSPVRDGSEERRARIEQWNREREDQEPGYKVNAEEINNGNASKHHGHQQQEQEPQSPQEGQ

SEQ ID NO: 12885 - protein, 133 aa, Cucumis sativus
SPAVNKATPDGKKTLRKGSVVITGASSGLGLATAKALAETGKWHVIMACRDFLKAERAAKSAGITKENYTVMHLDLASLDSVRQFVDNFRQSGRPLDVLVCNAAVYLPTAKEPTFTAEGFELSVGTNHLGHFL

SEQ ID NO: 12886 - protein, 301 aa, Unknown
  Shewanella sp. MR-7
MNKLTDFERYVIEEKGTERPFSGEYYKHDAKGVYLCKKCHAPLYRSEDKFNAHCGWPAFDDEIPGAVSRHVDADGRRTEIVCSQCGGHLGHVFEGEYLTPKNIRHCVNSVSMVFQAADEAAASTHKTAFATFGAGCFWCVEAIFKSLKGVLNVSSGYSGGEASDADYKSVCSGLTGHAEVVHIEFDPAQISFTTLLQVLFESHDPTTLNRQGNDKGPQYRSVVFAHDAAQIEETNAMITKLTEARVFDAPIVTQVVAFESFYPAEDYHNDYFALHGEQPYCQIVVRPKVEKVRALFAELQA

SEQ ID NO: 12887 - protein, 248 aa, Arabidopsis thaliana
  misc_feature (108)..(108): Xaa can be any naturally occurring amino acid
  misc_feature (131)..(131): Xaa can be any naturally occurring amino acid
  misc_feature (151)..(151): Xaa can be any naturally occurring amino acid
  misc_feature (170)..(170): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYXRSTGNSPGYYDGRYWTMWKLPLXFGCTDSAQVLKEVEECKKEXPQCLIRIIGFNTTRQVQCXISFIAYRPPTFTGNFPFAFGETLKLYPPSLILSPGFSGFFLLPGGLISGLNVCFRFGRTYPFGFSLSDGNKMECSQKK

SEQ ID NO: 12888 - protein, 675 aa, Glycine max
MSFTYFFDSVKKISRHNRIMITKSKQSLTLFLLCTLLLTIAETSASVFNNVSCTSNKTFTPNSTFNTNLNTLLSYLSSNVTNNVRFFNATVGKDSNTVYGLYMCRGDVPFALCRECVGFATQTIPSSCPTSKEAVIWYNECLLRYSYRFIFSKMEEWPRHKINIPLGDPVVLHSNGFYTALGSIFDELPNKAALDLSESNGYAVKQENASASVTLYGLAQCTPDLAAGDCIRCVTDAAAEFVKSCCGGSIGASVLFPSCIVRYETYPFYQHSGTSAPTMIKRGGNIGTEVIVIVVVLLVVLVMLFGFGYCFIRIKARKKRKAGDREKFGPEHTVLESLEFDLVTIEAATNNFSEDRRIGKGGYGEVYKGILPNREEVAVKRLSTNSKQGAEEFKNEVLLIAKLQHKNLVRLIGFCQEDREKILIYEYVPNKSLDHFLFDSQKHRQLTWSERFKIVKGIARGILYLHEDSRLKIIHRDIKPSNVLLDNGINPKISDFGMARMVATDQIQGCTNRVVGTYGYMSPEYAMHGQFSEKSDVFSFGVMVLEIISGKKNSCSFESCRVDDLLSYAWNNWRDESPYQLLDSTLLESYVPNEVEKCMQIGLLCVQENPDDRPTMGTIVSYLSNPSFEMPFPLEPAFFMHGRMRRHSAEHESSSGYYTNHPSSSSVNKMSTTAF

SEQ ID NO: 12889 - protein, 109 aa, Clostridium thermocellum
MAGEKVVILTKENFEQEVLNSDKVVMVDFWAPWCGPCRAVSPIIDELAEEYDGRAKVAKLNVDSEGEVTEKFRIMNIPTIMVFKNGEVVEKLIGARSKTELASAIDKHL

SEQ ID NO: 12890 - protein, 349 aa, Medicago truncatula
MNFSGTITKPNFPFPPTEMPILTFGHSKLTAATLALQLPCNYIRKIRFITKLQCSVAGRTDSYRTSAADSQGSKRDSGEIQRKRRGASSLYAGYARPSLSEMKKDKATLRKVVYEFLRGIGIVPDELDGLELPVTVDVMKERVDFLHSLGLTIEDINNYPLVLGCSVKKNMVPVLDYLGKLGVRKSTITQFLRTYPQVLHASVVVDLVPVVKYLQGMDIKPDDIPRVLERYPEVLGFKLEGTMSTSVAYLIGIGVGRRELGGILTRFPEILGMRVGRVIKPFVEYLESLGIPRLAIARLIETQPYILGFDLDEKVKPNVKSLEEFNVRETSLASIIAQYPDIIGTDLEP

SEQ ID NO: 12891 - protein, 104 aa, Triticum aestivum
  misc_feature (91)..(91): Xaa can be any naturally occurring amino acid
  misc_feature (97)..(97): Xaa can be any naturally occurring amino acid
HGASMQSYQYSPAGMNVHSSHLSTQNVWSSVSSTPILEERHSRSGRRAAALAKSRQKRKDRCFDKKVRYVNRKKVLETRPEGAGQLLSKAXNTRYNXTGWMIFP

SEQ ID NO: 12892 - protein, 256 aa, Unknown
  Synechococcus sp. CC9605
MLVVQVPGRWRRTRNPQAMAVVTLAEMMEAGAHFGHQTRRWNPKMSRYIYCARNGVHIIDLVQTAVCMNNAYKWTRSAARSGKRFLFVGTKKQASEVVALEAARCGASYVNQRWLGGMLTNWTTMKARIDRLKDLERMESSGAIAMRPKKEGAVLRRELERLQKYLGGLKNMRRLPDVVVLVDQRRESNAVLEARKLDIPLVSMLDTNCDPDLCEVPIPCNDDAVRSVQLILGRLADAINEGRHGSNDQRGGDSEG

SEQ ID NO: 12893 - protein, 300 aa, Solanum tuberosum
MAEKNRLVTVAALQFACTDDVSTNVATAERLVRAAHQKGANIILIQELFEGYYFCQAQKEEFFHRAKPYLGHPTIVRMQNLAKELGVVIPVSFFEEANNAHYNSVAIIDADGTDLGLYRKSHIPDGPGYQEKFYFNPGDTGFKVFQTKYAKIGVAICWDQWFPEAARAMALQGAEVLFYPTAIGSEPQDDGLDSRDHWRRVMQGHAGANVVPLVASNRIGKEIIETEHGNSEITFYGYSFIAGPTGELVAAAGDKEEAVLVAQFDLDKIKSKRHGWGVYRDRRPDLYKVLLTLDGSNPVK

SEQ ID NO: 12894 - protein, 106 aa, Bradyrhizobium japonicum
MAVGKVSDTDFEAEVLKANGPVVVDFWAEWCGPCRMIAPALDEIAGAMGDKVKIVKLNVDESPKTASKYGVMSIPTLMIFKGGEMASRQVGAAPKAKLQQWITSAV

SEQ ID NO: 12895 - protein, 1113 aa, Hebeloma cylindrosporum
MAALTTYTLQGGRSSSYGGLGMVGIAFIEKLLNLDDKQKYFIITCGERVHFAYNRVGLTEYFEHRNVENLYLNPPSWYAAQQPDRFRYHLSETVTYLSPRDHLVYTSKGRSFKYDRCVLATGSTASLPLYTSFKDIATTDGVFVYRNISDLDAIIAYAARAEVKHAVVVGGGLLGLEAAKAVYDLETISHVSIINRQAYPLSRQLDADAGEMVLRKIEGMGVQVLTNCSPAQQLTRPATDGSGNKVFTGFTLQDGTTHEADLVIYAIGIKPRDELAQASGIECHPRGGIVVDDNLQTSAPDVYAIGECASWKGNYYGLIAPGIEMADILSFNLTETDSHAPRKMNAPDLSTKLKLMGVDVASFGDFFADKRMTIKTQAATAAFDGTFPGKVVDPAQALVEITTAAGTSATPLIPKRGGRNGNEPIKCLVYNDPFSSTYKKYIFTADGKYLLGGMMIGDVSDFVKLVAIVKKKKALDVPPSQFIIGAKKEGDDDGGDLDDDAQVCSCHNVSKGDIVKRVKGGDCTTIGDLKKKTKVGTGCGGCMPLVTNIFNAEMKRAGYVLNTNICPHFAMARVDLFNVIKVRKLRTFGEVMTTVGIDKNAIGCEICKPAIGSILSSLYNEPIMKPEHHQNQDTNDRFMANIQRNGTFSVVPRIAAGEITPEGLIAIGQVAKKYNLYTKITGGQRIDMFGAMKDDLPSIWEELNDAGFESGQAYGKSLRTVKSCVGTTWCRYGVGDSVGLAVQLEQRYRGVRSPHKFKGGVSGCVRECAEAQSKDFGVIATDKGWNIFVGGNGGANPRHAELFAKDVPPSRVIRILDRFLAYYIMTADRLQRTARWIENMEGGIEKLRQVILEDSLGICAELDAIMTNIVNTYEDEWANAVKDPAKRQQFKQFVNTTERRPQAELIAERGQYRPADWPKSSAGLKITPDQLKTPKSEWTWVTVAQKGDMALSELGTTSVAVKYGDTQLAVYHVPKRGFYATQQMCPHRRAFVLDHGIIGDTPSGELYVSCPLHKRNFTLTDGTCLSDPDYEILAFEARANDADDIEVLLPPVNDIDAVLGTDKWLVRQAESEALGLNEATQVEMVGINGHSVASHEEQGGCASSACGDKRLEW

SEQ ID NO: 12896 - protein, 402 aa, Glycine max
  misc_feature (149)..(149): Xaa can be any naturally occurring amino acid
  misc_feature (301)..(301): Xaa can be any naturally occurring amino acid
MISSLRQPVVGISGSDLPLRQRHATPIKARSFLPSLSREKGQGSLVSVQKPLHIGASLGVGNFASVKSDAKRGDLVKCEAYEADRSEVEGASTPSEAAKKVKIGIYFATWWALNVVFNIYNKKVLNAYPYPWLTSTLSLACGSLMMLIXWATGIAEAPKTDPEFWKSLFPVAVAHTIGHVAATVSMSKVAVSFTHIIKSGEPAFSVLVSRFLLGESFPVPVYLSLIPIIGGCALAAVTELNFNMIGFMGAMISNLAFVFRNIFSKKGMKGKSVSGMNYYACLSILSLAILTPFAIAVEGPXMWAAGWQTAMSQIGPQFIWWLAAQSVFYHLYNQVSYMSLDQISPLTFSIGNTMKRISVIVSSIIIFHTPVQPINALGAAIAILGTFLYSQAKGEVRLNLQD

SEQ ID NO: 12897 - protein, 300 aa, Chlorobium tepidum
MVKMSQILTRKVLHLFFCQALYFLGNNESRKVIHQMAEHGENRVLIVGAGPGDPELLTVRGAAAIREADVILYDCGTVEPVLALASERAAIVRVDRSPYETGEGRREQTPMIVVIREYRDRGLRVVRLKTGDPSLFGGEVDEGDVLTRLGIPWAAIPGICAGAAAASAYALPISRKFESDAVLNLIAAAITDDFALIRDAAHLLGHGATVVLYMATANLPGILRTFREAGVPDAMPVVAVSKAGWPDEAFARTTLGELTAAGCSIALPEPVVYHIGRYVRVRNVPAGSQEFFVKAPENAG

SEQ ID NO: 12898 - protein, 635 aa, Lotus japonicus
MCGICCVIGVPAGAESIRSTVLDRAKRIRHRGPDWTGVYAKGKNIIVHERLSIVDVETGNQPLKSADGKQVLVCNGEIYNHLQLRQSLKAPVQFATNSDSECILHLYNERGVGFVNSLNGIFGFVLIDEAKDTFIVARDHEGIIPLYYGWDETGALWVASELKALHDVCVRFEEFPPGHVLHGKVGSAGKLEKWYQPVWHDEAYVPAATAACDIKGLRESLEAAVERQMMTDVPYGVLLSGGLDSSVISAVAVRVAAKRAAAKADSKHTELGHVDPKSVVHSFSVGLKGSPDLKAAREVAAFIGTEHHEFVFTVDDGINALRDVIYHLETFDTTTIRASTAMYLMSRKIKALGVKMVLSGEGSDEVFGGYLYFHKAPDRVEFHKETVRKLKALNKFDCLRANKSTMAWGLEARVPFLDKEFLDFAMTLDPTHKMCGKHAGGRIEKWIVRKAFEGYLPPAILWRQKEQFSDGVGYSWIDSLKAFADAKVSDAQLAAAAFKFPENTPLTKESYLYRSIFETHYPEPAARACVPGGPSVACSTPAAIAWDAAFQKMADPSGRAVAGVHADAYAVAADDKTPDTSADAKHGTAAEHKASGATRAPFIAAANGIKCSAEAALPHALPKPVALASGKAEAE

SEQ ID NO: 12899 - protein, 200 aa, Mantoniella squamata
  misc_feature (132)..(132): Xaa can be any naturally occurring amino acid
DIYPEFGTYPGGGESPIIPFGSEKNAEREVIHGRWAMLGVTGAWAAENGTGIPWFTAGTLCTPDDCTAVADKFPGAVAPLAPEGSGYPSFWAVLAIEVVLVGLAEAYRTGLSDSPFEELTVGDVSPGGRFDXLGLAESGDLEELKIKELKHCRLSMFAWLGCIFQALATQEGPIANWQAHVADPVHANVLTNAASGFGFY

SEQ ID NO: 12900 - protein, 258 aa, Prochlorococcus marinus
MQIIRNNSQDPISISNWRWACFLDETIKAFSTFQTRPYQIDNDFLFRESFFGSSSNPKKVILETWGLKMEKIRQARCACLQAGEITSVMNLVISPLNNYDLPFFGADFVTLPNGHLIALDLQPALKDDINHTQHVWNKLKPIHAHWQSKIPTGGDIPSDARQYFSPAFLWSRIPLGEEGDNLITQTIKPAFDEYLNCFFDLLRDAKITSKERSFQLLNGQKKYMRYRAEKDPARGMLRSFFGEVWTESYINNILFDLK

SEQ ID NO: 12901 - protein, 450 aa, Leuconostoc mesenteroides
MAHITFDTKNIENFVADHELDEMQPLIKMADEQLRNRSGAGAEYSDWITLPTDYDKDEFARIQTAAQKIQSDSKVLVVIGIGGSYLGAKMAVDFLNPMFNNELADNQRQGVKIYFAGNSTSASYINDLVRVIGDQDFSVNVISKSGTTTEPSIAFRVFKQLLEKKYGAEAAKQRIYATTDANRGALHDEAKISGYETFTIPDGVGGRFSVLTAVGLLPIAASGADIEALMTGARDAQEEYSDSDIKNNEAYKYAAVRRILYDKGYTTELLINWEPTMQYLSEWWKQLMGESEGKNQKGIYPSSANFSTDLHSLGQYIQEGRRDLFETVVKLDNPVSNIDLPHEDGNNDGLQYLEGVTIDEVNTKASQGVTLAHVDGGVPNLAVHLPAQDAYSLGYLIYFFEIAVGASGYTFGINPFNQPGVEAYKTAMFALLGKPGYEEQTKVYRARLGK

SEQ ID NO: 12902 - protein, 583 aa, Xanthomonas campestris
MRCGGSTPARKRGMFHHRCRVAVPHALPRRGRFFSGFCMHSIDVVLAMLLAVAASGYLIRILPFSLPLPLVQIALGAVVSGVFDAGHELEPELFFLLFLPPLLFLDGWRIPKQGLFRDKAAILELALGLVVFTVVGAGLLIHWLIPAMPLAVAFALAAIISPTDPVAVSSIASKVQIPKRLMHILEGESLLNDASGLVCFQFAVAAVLTGTFSVATASLTFLWVALAGLGLGVATTFGLSRIQAWIWRHFGEEPGSAILVNLLTPFAAYLLAEAFHASGILAAVAAGITMSYVEMAGNAPGNMRLQRSAVWDTVQFTFNGIIFVLLGEQLPGILDGAVRSVQEAGHLNPWWLAVYVATISASLMALRFVWVFLSLRWNLFKAQRRGEAHVSPPWRIVVAVSLAGVRGAITLAGVLTLPLVLEDGSPFPARQLAIFLAASVILVSLLVASVALPRLLRGLELPEEEDEQLKEDLAVKAASQAALEAVEKLRQRLVEDSAHAERYNAAANQVSQRYQRKLGAVDMAETDPEEAGAFEQALRQFRHAALVAERNELFKLARRREISDDLSRRLVRNLDLIESRKRA

SEQ ID NO: 12903 - protein, 112 aa, Dehalococcoides ethenogenes
MKKIEAIIREERLEPVRKALELAGFAGLTVTEVSGRGKQKGVPLQWRVGEYRVEFLPKLKLEMICHDDDCQVAVDAIVKAARTGRIGDGKIFIMPVEQVVRIRTGETGSEAV

SEQ ID NO: 12904 - protein, 374 aa, Mesoplasma florum
MAKRDYYEVLGVSKTSTEQEIKSAYRKLAKKYHPDMNKESGAEEKFKEVNEAASVLLDADKKAKYDQFGHAAFDGSSGFGGSGFGGFEDFFSNMGGGMDFGDIFSDLFGGGRSGRSSRRGPSKGQDIGLEATLTFKELVFGVNKKTILNLVKTCTKCDGVGAENPSDVHICTKCNGAGQIIVNKQMGPFQVQNQVTCDKCNGVGKEFKSKCKNCHGKGVESKREEVEIPLPKGLWPGQQFVMRGKGHASLEGGIPGDLYITIGIVKSDVFELIPNSNDLIMNYNISYLDAILGNEVIIKTLDGPVRLKIPKGVYSGQLIKVHDKGLYKNQTSDKRGDLLIKISISIPTSVSKEEKKILKELEQLSNFEPKNIID

SEQ ID NO: 12905 - protein, 497 aa, Nicotiana benthamiana
MKKATVGAAVVGAATVCAVAALIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIIHQEFAEASIPPNLMVGTSEELFDYIAAELAKFVAEEEEKFQQPPGKQRELGFTFSFPVMQTSINSGTIMRWTKGFSIDDAVGQDVVGELTKAMKRKGVDMRVSALVNDTVGTLAGGKYTHNDVAVAVILGTGTNAAYVERVQAIPKWHGPMPKSGEMVINMEWGNFRSSHLPLTQYDHALDTNSLNPGDQIFEKMTSGMYLGEILRRVLLRMAEEAGIFGDEVPPKLKSPFVLRTPDMSAMHHDTSSDLRVVGDKLKDILEISNTSLKTRRLVVELCNIVATRGARLAAAGVLGILKKMGRDTPRQGGPQKMVVAMDGGLYEHYAEYRTCLENTLKELLGDELATSIVFEHSNDGSGIGAALLAASNSMYLEDKS

SEQ ID NO: 12906 - protein, 206 aa, Brassica napus
GIEMNASAVSDAERNAKINGISNCKFICSKAEDVMSSLLTEYLDVSETEEAKPPSDDLDKQNSSAEEISNSEVQNNEQKDSSSEPERSAKPQFKNVVAIVDPPRPGLHPDVIKALRTHPRLKTLVYISCNPETLVANAIELCTPSFEKTGQENKGYRRQSRMGTAALARHRAKKMPASEPFKPVKAMAVDLFPHTDHCEMVMLLNR

SEQ ID NO: 12907 - protein, 165 aa, Oryza sativa
ALVEDNNAVAVSFSEEQEALVLKSWAILKKDSANIALRFLLKIFEVAPSASQMFSFLRNSDVPLEKNPKLKTHAMSVFVMTCEAAAQLRKAGKVTVRDTTLKRLGATHLKYGVGDAHFEVVKFALLDTIKEEVPADMWSPAMKSAWSEAYDHLVAAIKQEMKPAE

SEQ ID NO: 12908 - protein, 600 aa, Prochlorococcus marinus
MSDISIGLLAENQNLSEFEITDNFSCVRFLDKKKERFELEFNLEKGTSFNTFFIRSNAELFIIHPPEKQYLNLFNKVISRFCDQFKLDNINFISGHINPQIIETIKNISTQFQNTTITCSNPGYKLISELWNQRNPNLENFIEIQLPEINIIKKELNLELDKVSLELIPIPTARWPGGLIIYERNQEILLSEKIFSAHIASKYWSETNRISTEIDRKHFYDCLMAPMSNQVVSITEKISEYEIKTIAPLHGPAIEYSLKSFLNDYIRWGENLLTNNPKIALIYASAYGNTASIGDALAKGINRTSVEVESINCEFTPNDVLVKSIQNADGYLIGSPTLGGHAPTPIVSALGTLLAEGNRDKPVGIFGSFGWSGEAIDLLETKLKDGGFKFGFDPVRIKFSPNKPKIKELEEIGTHFGRKIIKKAKIKPRKSDTGMITSKTDPKLQALGRVIGSLCVLTASKGKDENNIKGAMLASWVSQASFSPPGLSIAVAKDRSVESLLQIGDSFALNILSEKDYKEPLKRFTKPFAPGEDRFEGIKIELTPNEQIIIPESLAWLDASVKERMECGDHWVIYAEVLHGNILKSDSLAAVHHRKTGANY

SEQ ID NO: 12909 - protein, 428 aa, Mesorhizobium loti [sequence omitted]

SEQ ID NO: 12910 - protein, 357 aa, Oryza sativa
MRLLFAACQGDVAGVEELLRDGVDVDSIDLDGRTAMHIAACEGQGEVVRLLLSWKANMNARDRWGSTPAADAKHYGHFEVYNLLRARGAKTPGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIETSFREIAWLPSRFPPFLHM

SEQ ID NO: 12911 - protein, 591 aa, Prochlorococcus marinus
MIASAQTSNSKLAPNNSKLTVQSQNFADDSCAIRSLDWDRSRFDIEFGLRNGTTYNSFIIKGEKLAIIDTSHAKFEELWFEELLKKVNPQEVDYLITSHTEPDHSGLIGNLLELNQNITVVGSKLALKFIEDQIHIPFKRLEVKSGEFLNLGTNPNSGLQHNIEFISAPNLHWPDTIFSYDHSTNVLYTCDAFGLHYCSDEFFDTDQKEIYDDFRFYYDCLMGPNARSVMQAIKRIDKLPKVKTIAVGHGPLLHNQVNFWKGKYLEWSSNKSKGNDFVSVCYISDYGYCDRLSQAISHGISKADAQVQLIDLRSSDPQELTSLISESKAVVIPTWPVDSDNELKESLGTLFAALKPKQFTAVYDAFGGNDEPIDSLANKLRELGQKEAFSPLRVKNIPDPIVYQQFEEAGTDLGQLINKKKNIASMKSLDSNLDKALGRLSGGLYVVTASQGEGSTFRQSAMVASWVSQASFSPPGITVAVAKDRAIESYMQVGKGFVVNILREDNYQKMFRHFLKRFAPGADRFADVDVISNIAEGGPVLSDSLAFLDCKVSSRLETPDHWIIYGIVENGNVSDLSCKTAVHHRKVANHY

SEQ ID NO: 12912 - protein, 165 aa, Oryza sativa
ALVEDNNAVAVSFSEEQEALVLKSWAILKKDSANIALRFWLKIFEVAPSASQMFSFLRNSDVPLEKNPKLKTHAMSVFVMTCEAAAQLRKAGKVTVRDTTLKRLGATHLKYGVGDAHFEVVKFALLDTIKEEVPADMWSPAMKSAWSEAYDHLVAAIKQEMKPAE

SEQ ID NO: 12913 - protein, 421 aa, Neisseria meningitidis
MSEALAKETLNPFEIARKQVKTACDRLKTDPAVYEILKSPTRVLEVNFPVKLDDDTVKTFTGYRSQHNNAVGPYKGGVRFHPSVNLDEVKALSIWMTIKCCVAGIPYGGGKGGITLDPRDYSEAELERIARAYAEAIAPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEALFKEFQEKGFITNEAGYGKEITNAELLALDVDVLAPCALENQLTSENAGKVRAKIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 12914 - protein, 161 aa, Dendrobium nobile
ELDEFMEMYCDVLVKYRRDLERPFDEATAFLNTMEVQLSDLCKPTCRPTLGPYVSDEAVGSSDEELSGGEGEAPESHLKGEERDLKEKLLRKYSGYLSSLKQEFSKKKKKGKLPKEARQILFEWWTAHYKWPYPTEADKIALAEATGLDQKQINNWFINQR

SEQ ID NO: 12915 - protein, 420 aa, Bacillus halodurans
MGAIAEKGKESSILSSTQDVIQQALGKLGYEEGMFELLKEPVRMLTVRIPVRMDDGTVKVFTGYRAQHNDAVGPTKGGVRFHPEVTADEVKALSLWMTLKCGIVNIPYGGGKGGIVCDPRTMSFPEIERLSRGYVRAISQIVGPSKDIPAPDVFTNSQIMAWMVDEYSRIREFDSPGFITGKPIVLGGSHGRETATAMGVTICIEEAAKLKQLDLREATVIIQGFGNAGGYLAKILSDRGAKIIGISDAYGALYDETGLDIEYLLDRRDSFGTVTTLFKNTITNEELLEKKCDILVPAAIANQITEANAREIKASIIVEAANGPTTTEATNILTERGVLIVPDVLASSGGVTVSYFEWVQNNLGYYWSEEEVSEKLRSKIVEAFHQVVETATRYNVDPRLAAYMVGVRKTAEASRFRGWI

SEQ ID NO: 12916 - protein, 135 aa, Pinus taeda
GGSSEEEFSCGEIEVHEVDPRAEDRELKDQLLRKYSGYFSSLKQEFLKKKKKGKLPKEARQKLLEWWNVHYKWPYPSETDKVALAESTGLDQKQINNWFINQRKRHWKPSEDMQFVVMDSLNPHGASFYMDGAEC

SEQ ID NO: 12917 - protein, 512 aa, Triticum aestivum
  misc_feature (337)..(337): Xaa can be any naturally occurring amino acid
MPPRRPNTGAGGGGTSSAAPPPPPSRKVPLRSLLRAASVACGVQFGWALQLSLLTPYVQELGIPHAFASLVWLCGPLSGLLVQPLVGHLSDRIAPANSPLGRRRPFIAAGAASIAFSVLTVGFSADLGRLFGDDIVPGSTRFGAIIVYLIGFWLLDVGNNATQGPCRAFLADLTENDPRRTRIANAYFSLFMALGNILGYATGAYNGWYKIFPFTITESCSVSCANLKSAFLLDIIILAITTYVSVVTVQDNPTFGSDEAAPPSSHEEEAFLFELFGSFKYFTMPVWMVLIVTSLTWIGWFPFILFDTDWMGREIYRGSPEIVADTQKYHDGVKEDXKGSFGLMLNSVVLGITSIGMEKLCRKWGAGLVWGVSNIIMALCFVAMLIITYVAQNLDYGPSGAPPTGIVAASLIVFTILGAPLSVTYSIPYAMAASRVENLGLGQGLAMGILNLSIVIPQIIVSLGSGPWDQLFGGGNAPSFWVAAAASFVGGLVAILGLPRARLGPKKKTTQR

SEQ ID NO: 12918 - protein, 539 aa, Schizosaccharomyces pombe
MPSSNGSSDFVRKLFNMLEEPEYRHILRWSDSGDSFIVLDTNEFTKTILPRHFKHSNFASFVRQLNKYDFHKVRHEEGAPSIYGEGAWEFRHDDFQLHHKDLLDNIKRKAPSKRNLANENTAPVIENLKQQVDSILDFQKLLDRNLSGLATSYQTILLKMFELKRGIESRDLLMSSIISYLCDLEGSTQRQANPGAMFVPSHPLQELLNAYQALAKGQVATTSPQQIPNQIQQASAATTASSKMTVDTNLGTAQPSLYNTPSSDYELANQEKPADSMASAASLNTPLSSNDHSLNPHAHGSYPMYEKFQPIQHPNPGSFTTHLDSNASMAKSFSQISNDSLAKASSVATSMSQMGAAVPTTGLWKRQPRILLVEDDELSRRMTIKFLTSFDCQVDVAVDGIGAVNKANAGGFDLILMDFILPNLDGLSVTCLIRQYDHNTPILAITSNISMNDAVTYFNHGVTDLLVKPFTKLTLLQLLKKQLLNLLQADNSINMSDVPSTKEAKDDKAPVTFYLENDAPMYPQQMLQDPIQADLQHPH

SEQ ID NO: 12919 - protein, 124 aa, Pinus strobus
EIEVHEVDPRAEDRELKDQLLRKYSGYFNSLKQEFLKKKKKGKLPKEARQKLLEWWNVHYKWPYPSETDKVSLAESIGLDQKQINNWFINQRKRHWKPSEDIQFVIMDSLNPHGASFYMDGAEC

SEQ ID NO: 12920 - protein, 491 aa, Haemophilus influenzae
MDAVELLMNVTPNETRIALVETGMLREVHIERQAKRGIVGNIYKGRVTRVLPGMQSAFVDIGLEKAAFLHAADIVSHTECVDENEQKQFKVKSISELVREGQDIVVQVVKEPLGTKGARLTTDITLPSRHLVFMPENSHVGVSQRIESEEERARLKALVEPFCDELGGFIIRTATEGASEEELRQDAEFLKRLWRKVLERKSKYPTKSKIYGEPALPQRILRDFIGTNLEKIRIDSKLCFGEVKEFTDEFMPELSDKLVLYSGNQPIFDVYGVENAIQTALDKRVNLKSGGYLIIEQTEAMTTIDINTGAFVGHRNLEETIFNTNIEATKAIAHELQLRNLGGIIIIDFIDMQTDEHRNRVLQSLCDALSKDRMKTNVNGFTQLGLVEMTRKRTRESLEHVLCDECPTCHGRGRVKTVETVCYEIMREIIRVYHLFSSEQFVVYASPAVSEYLINEESHGLLPEVEMFIGKRVKVKTEQFYNQEQFDVVVM

SEQ ID NO: 12921 - protein, 425 aa, Desulfotalea psychrophila
MHKTERGDAMTALQQQDPEIFSLIQQEEVRQHNKIRLIASENYVSSAVLEATGSILTNKYSEGYPGKRYYEGQQLIDQIESIAIDRAKAVFGAEHVNVQPYSGSPANMAVYLAFLKPGDTILGMALPHGGHLTHGSKVSISGKYFNAVSYALNEEGILDYEEIRNKALECKPKILIAGHSAYPRILDFAKFREIADEVGALLMVDMAHFAGLVAGGVHPSPFPYADVVTTTTHKSLRGPRGAMIMCKAEYAKAIDKAVFPGMQGGPHDSTTAAIAVALKEASTDSFKKYTAQVVENAASLADVLIEKGFNLVTGGTENHLMLIDLSNKNITGKQAAKALDAAGIVLNCNSVPFDKRKPFDPSGIRLGTCAITSRGFAKAEMVILGNMMDRVVNNFEDSAVLAEIAQEVQALCDKFPAPGLEHIAK

SEQ ID NO: 12922 - protein, 549 aa, Buchnera aphidicola
MKNINFNNTQSYQDLKNHFRKIKNIHLRDLFASDLNRFKKFSIIFENEMLIDFSKNRITDETLIYLLNLAKETDVKSGIKLMFSGAKINKTENRSVLHIALRNRTNRPIILNNCNIMLEVNALLEKMKNFSKMVIHGEWKGYTGKSISNVVNIGIGGSDLGPYMVTEALRPYKNHLNMYYVSNIDGTHLTEVLKKINPENTIFLIASKTFTTDETITNAHSAKKWFLHYSQDQSALDKHFFALSANIKNALNFGININNIFKFWDWVGGRFSLWSSAGLSIMLSIGFDNFEKFLDGAHAMDNHFYHTNYKENIPILLALISIWYTNFFGSETEAIFPYDQYMHRFSAYFQQSNMESNGKSINRNGQRINYQTGPIIWGEPGTNGQHAFYQLIHQGTRLIPCDFIAPVFSHNDLNNHHMKLISNFFAQTQALAFGQSRDSILHRLILSKKNQDDIKRILPFKICKGNQPTNSILIRKITPYNLGALIALYEHKIFVQGYILNIFSFDQWGVELGKELSQNIYNYLNINVKNKSYDASTEGLINFYKSFMI

SEQ ID NO: 12923 - protein, 135 aa, Picea abies
GGSSEEEFSCGEIEVHEVDPRAEDRELKDQLLRKYSGYFSSLKQEFLKKKKKGKLPKEARQKLLEWWNVHYKWPYPSETDKVSLAESTGLDQKQINNWFINQRKRHWKPSEDMQFVVMDSLNPHGASFYMDGADC

SEQ ID NO: 12924 - protein, 1322 aa, Aspergillus nidulans
MVSRSNEGPEAPHPASRTPGAPAKGRLTRLGSSPSKRDDKAKDDRMGKTSAKDVAELKDYIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHSTDDGLGVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 12925 - protein, 265 aa, Methanococcus maripaludis
MRNDFPEEGDIIIGNVIDVKSFGAFIELLEYPGKEGMVHISEVSSGWIKNIRDHIKKGQRVVAKVMRVTPHKNQIDLSLKRATDQQKKVKVQEWKRFQRAEKLLQFASEKLGKTIEEGWEAAGYPLIDEFGELYDAFESIVIEGKEVLDELETPLPQEWADVIYEIASENIELSSVKVSGIVTLTTTEPTGVKIIKNGLKKALKANPYEDVEVNITYIGAPKYRVEVLSPDYKSGEDVLRRVSEEAIDFIKKHAGGTGSFVRVEE

SEQ ID NO: 12926 - protein, 611 aa, Streptomyces lavendulae
MKHDLGLAPSAPKPGTLDLSLDPRITDPASFRVSFLILLDGDLVMSPEHLGVAYMAGVLRHTGFTAEIREVEHGDDQAAATVEALKEYRPDLVCFTLMSLNLGSCLTLCRMLREELPGTTIACGGPAGTFAGLDVLRNNPWTDVVAVGEGEPTILDLVQRLYLKEPLSACKGICYRDEDGTPRQNPARPLIHNLEDLPFPARDQLRQHGDKLEYVRVSTSRGCVANCAFCSAPHLKNRVQAGKAWRGRGPEQIVDEVAEIVERHQFRTFDFVDSTFEDPDGGRVGKKRVAAIANGILERGLDIYYNVCMRAENWHDTPEDHALLDLLVASGLEKVNVGIEAGTAEELLLWEKRATVEDNVTIIRMLREHGIYLAMGFIPFHPYATLETIVTNAAFLRDNSGHNLRRMTERLEIYPGTAIVSRMRADGLLGESYLEGLDPYGYAFKDPRVGRLAKHFAQLYNNDDYHRHGVITEQSSVFAFETYNVVLQTFISRLHRRFTTLPGVDEVMEAFKARVHEIRQEMGRHNYGFFMSNVEAVMNDTLDPEKQRRQVVDVEHFFRDRLDVLRSEQLRVGKALTRLGARVTEVSSTIPKERPGGLPRQYTGEGSGATW

SEQ ID NO: 12927 - protein, 546 aa, Triticum aestivum
MGLDLGALALKYTGLAVSDHDSIVAINIFIALLCGCIVFGHLLGGNRWVNESTAALVLGLITGGVILICTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFGLLQFIGKFLYLFFTSTVLGVAAGLLSAYIIKKLCFARHSTDREVAIMILMAYLSCMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSAHRVWRKFDDKFMRPMFGGRGFVPFVPGSPIERSVHGPGLLGTVTEAEDRS

SEQ ID NO: 12928 - protein, 659 aa, Haemophilus influenzae
MFKIYNNGNPIPMGYSQAVENNVQITNFALFSAAAIGVELCLFDEQNQETRLPMVRTENVWHLAVTGVKTGTEYAFRIHGEFANPQKLILDPYAKAVNGKPDLSSEESRSWFLLSDNRDNAHLAPRAVVISEEFDWENDTSPNTPWAETIVYELHVKGFSQLNEKIPAALRGTYTGLAHPVNLAYLKELGVTAVELLPVNFHINEPHLQARGLQNYWGYNPLAMFAVEPKYAATNNPLAEFKTMVKAFHKAGIEVILDVVFNHSAESEQTYPTFSQRGIDDQTYYWRNDQGRYINWTGCGNMLNLSSDVGRKWVVDCLRYWVEQCHIDGFRFDLATVLGRDTPDFNSSAQLFTDIKNEPSLQNIKLIAEPWDIGHYGYQVGNFPSYFAEWNDRFRDDLCRFWLWKSGEIGAFAERFAGSSDLFKKNDRLPHTTLNFITAHDGFTLKDLVSYNQKHNETNGEENRDGRNENYSYNHGVEGSTESLSEPQKSAVENNRTFAQSGLLMSLLLANGTPMLLAGDEFGNTQYGNNNAYCQDNEITWLKWANFNEELFELTKQTIALRKQIGSLNKDQWWSDENVQWLNIVGEPMTVEDWQNQQTKALQVVLDNRWLLLINAKAEGQMFHLPNRKWKPQIGTHNVTLEAQQAELSSMGFCMLNDE

SEQ ID NO: 12929 - protein, 444 aa, Haemophilus influenzae
MTNNNKTMEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 12930 - protein, 175 aa, Arabidopsis thaliana; identical to SEQ ID NO: 457

SEQ ID NO: 12931 - protein, 133 aa, Arabidopsis thaliana
MASFTASASTVSAARPALLLKPTVAISAPVLGLPPMGKKKGGVRCSMETKQGNVSVMGAGVSAAATAALTAVMSNPAMALVDERMSTEGTGLPFGLSNNLLGWILFGVFGLIWTFFFAYTSSLEEDEESGLSL

SEQ ID NO: 12932 - protein, 444 aa, Clostridium thermocellum
MKLLAGVMEQVIKRNPNEPEFHQAVREVLESLEIVAEKNPEYLKAGIFERIVEPERQIIFRVPWVDDNGKVQVNRGFRVQFNSAIGPYKGGIRFHPSVNLGIIKFLGFEQIFKNSLTGLPMGGGKGGSDFDPKGKSDGEIMRFCQSFMTELYRHIGPDTDVPAGDIGVGAREIGYMFGMYRKIRNEFTGVLTGKGLTWGGSLVRTEATGYGLCYFMEEAMKTIKGKSFEGATVVISGSGNVAIYATEKAQQLGAKVVALSDSNGYVYDPDGIKLDTVKQIKEVERKRISEYVKYHPNAKYTEGCSGIWSVKCDVALPCATQNELDGNAAKTLVENGCYAVGEGANMPCTPEAIDIFMKNGVLYAPGKASNAGGVATSGLEMCQNSMRYSWSFEEVDAKLKDIMVNIFRNVRAVAKEYGQEDNLVLGANIAGFLKVANAMMAQGV

SEQ ID NO: 12933 - protein, 1427 aa, Burkholderia thailandensis
MTSASVKTVCPYCGVGCGMVLHVEGGEVVKVSGDAEHPANFGRLCTKGSSAHVALRNAGRLERAFVRDARERDPAPVPIADAIAETARRLRATLDAHGPDALAFYVSGQMSLEAQYLVNKLAKGYVRTPHIESNSRLCMASAGSGYKLSLGADGPPGSYQDFDCADLFFVIGSNMADCHPILFLRMMDRVKAGAKLVVVDPRRTATADKADLFLKIRPGTDLALLNGLLHLLHANGQTDADFIAAHTEGWAAMPDFLGDYTPEKVAAITGLTEADIRLAAQWIGDAREWTSCWTMGLNQSTHGTWNTNAICNLHLATGKICRPGSGPFSLTGQPNAMGGREMGYMGPGLPGQRSALDGDDRRFAEDVWGLPAGTIRADAGGGTVDLFARMAAGGVKACWIICTNPAATVANRKNVIAGLQAADVVIVQDAFLDTETNRYADILLPGALWAEAEGVMINSERNLTLMRRAVEPPGDAWPDWRIVAAVAREMGYGDAFDYGSAAEVFDEIRRFANPKTGYDLRGASHAALRDAPLQWPCPPHDGRDRHPIRYLNDGVSQARATLADGRVPPLAFPTPTGKARFFARPHVAPAEMPTPEFPIVLNTGRLQHQWHTMTKTGKVAMLNKLNPRPFVEIHPDDAAALSIAAKDAVEIRSARGRAVLPAVVTDRVRPGACFAPMHWNDVYGDDLCVNAVTNDAVDPVSLQPELKFCAVALARVDAMGNADVDADDETDDRVRASRAALHETGSHEADAHEADAHAAPDAHGASRAEADASEEHHMSDIDTFAALLGIPAAASAPQLTDAQRVYAAGFVSGLRSAEGRRAAGVPMLPASAPFDANTRLWVDGLLAGLFSRAPGGAAARVDARAAAQPAAIAAADASSAPSGVRIVRTRPKVVLLWASQTGNVESLTERYATQLMDSGFEIRVACMADYPAASLAKAQYALLMTSTFGDGDAPDNGQEFWAALNAADAARADGLRYAVLAFGDRNYDQFCGHGRRLDARLAALGATRLAERVDCDAEFQPAADAWLDRAIARIKEEDAALHAVPADGMIPSGAIPTKTRPAASRLVANLRLNAPGAAKDTRYVSLSTDGAAIEYEAGDALGVWPTNCPELVDELLTLTRLTPDAPVTVAGVGELRLADALAKHFDITRPHPDALAFVAARSRSGDALARLLGDDRKTDLKHWLWGQQLADVLHEFPLELSAVELVGMLKRLQPRLYSIASSPNAHRGEIHLTVSAVRYGNGRRQRKGVASTFLADRAADAPVPVFVQKSAHFRPPASGDAPIVMVGPGTGVAPFRGFLHERRARGAKGRNWLFFGEQHADTDFYYRDELAQMRADGFLTRLDVAFSRDQAEKVYVQDRMLEQGAALWAWLEEGAHFYVCGDASRMAKDVDAALKTIVARHGGMTDEQAADYVARLAKDKRYARDVY

SEQ ID NO: 12934 - protein, 129 aa, Chromobacterium violaceum
MSEVQEMTPYQLLGGEGVVRWLTDRFYDIMDSEPSVKPLRDMHPADLAGSRQKLFMFLSGWLGGPSLYMEAFGHPRLRMRHMPFAVDEDARDQWMFCMRRAVSELVVEDWLKDKLLEAFHNTADFMRNR

SEQ ID NO: 12935 - protein, 450 aa, Hebeloma cylindrosporum
MVKPFEPEFQQALDELTTSLQPFLDANPQYKKALEIVQVPERVLQFRVVWEDDQGVAQVNHGFRVQYNSALGPYKGGLRLHPSVNLSILKFLGFEQTFKNALTGLSMGGGKGGSDFDPKGKSDSEIRRFCFSFMGELFRHIGSDTDVPAGDIGTGGREIGFLFGAYKKLRNEFTGMLTGKGLTWGGSFIRPEATGYGLIYFVEHMIAKACPEYSLDKPSTLVAISGSGNVAQFTALKVIELGATVLSLSDSKGSLISDKGYTKEFIRKVADLKLKGGSLASLANEEGYTYHAGARPWTLIPTIHIALPGATQNEVSAEEAEALLKAGVRIVAEGSNMGCTADAIDIFESSRKAGPGGVWYAPGKASNCGGVAVSGLEMAQNSQRLAWTTQEVDSKLKDIMAECYGICLTAGTKWSGEELTDEVLPSLLSGANVAGFIKVADAMKAQGDWW

SEQ ID NO: 12936 - protein, 451 aa, Gibberella fujikuroi
MSHLPQEPEFEQAYGELASALENSSLFNEHPEYRTALAVAAIPERVIQFRVVWNDDKGNLQVNRGYRVQFNGALGPYKGGLRFHPSVNLSILKFLGFEQIFKNALTGLNMGGGKGGADFDPKGKSDAEIRRFCQAFMTELSKHIGAETDVPAGDIGVGGREIGYLFGAYRKFANRWEGVLTGKGLSWGGSLIRPEATGYGLVYYVEYMLKHANRGTFEGKRVALSGSGNVAQYAALKIIELGGSVVSLSDSKGALVAKEGSSFTPEQIHNIAALKIKHQALTTFEHDGQFTWIEGARPWVHVGKVDIALPSATQNEVSKEEAQALVDAGAFIVAEGSNMGCTAEAIDVFEAHRKEKGAEALWYAPGKASNCGGVAVSGLEMAQNSQRIQWTEKEVDDRLKAIMKDAFVAGLETAQKYVEAKEGELPSLIAGSNIAGFIKVAEAMHDQGDWF

SEQ ID NO: 12937 - protein, 339 aa, Tropheryma whipplei
MQLSGYPMRQASCDMKEGGLRNKVAVIGSGSWGTAIANLLCKAGNETILWGRDENVIDEINNARVNSKYLPGVELFLRATCDLDYAVADASHVYIALPSFALSKVLPKLSLDKFSIVISLIKCLEPDTGRRMSEVISEALDLGHNRLAVISGPNLALEVANDEPSVSVVASANIATANIVAGTLKCPGFYCIPSSDIKGVEICAASKNLVALISGIARGMDLGDNTRAALITLGFRELLRLVLENGGTEETVFGVAGLGDVVATCNSHLSRNNKAGVLLAKGAPLDEVKQTAEGVVAISGVLALAERSGVYMPIAQALSQVISGKRTAHSLLDICFSLA

SEQ ID NO: 12938 - protein, 457 aa, Tuber borchii
MSNLAPEPEFQQAYNELVHSLRDQNSSRLPQILRLLCLSSPPERVIQFRVTWEDDKGNFQVNRGYRVQFNSALGPYKGGLRFHPTVNLSILKFLGFEQTFKNALTGLNMGGGKGGSDFDPKGKSDNEIRRFCYSFMRELSKHIGQFTDVPAGDIGVGGREIGYLFGAYESYKNQFEGVLTGKGITWGGSLIRPEATGYGLVYYVAHMISYASGGKETFAGKRVAISGSGNVAQYAALKVLELGGKVITLSDSKGALIATGEEGFNETDIELIAKLKLDRGYLTQLHAAEDSFKSRFKYLPGERPWCHVDKVDVALPSATQNEVSEQEAKELIASGCKFLAEGSNMGSTQEAINVYEEDRKSRKADGLWYGPAKAANCGGVAVSGLEMAQNSQRLTWTSEQVDKELAGIMERCFWNCLNPAKEYFDIAEGELPSLVAGANIAGYVKVVNAMKAQGDWW

SEQ ID NO: 12939 - protein, 1064 aa, Unknown
  Magnetococcus sp. MC-1
MGIQRRVLGLIAFFLLVAFSAVEVRSYYQLKAYAEESLRTQAEIVQGLLMSIRRVYHHAFLDSHIPLSSDTVPLLPAHAINRISKEFPTWFKGGVSFNNVSDKPRNEQQRAKGIEQQAMAHFRQNPEEKRWFTQYQEENGEAYYHYATPIWIEPYCMQCHGAKEKAPAAIQKMYSTGFDYKIGDLRGVVSIKLPAAHINRLVKQQFLENSLIHLLIFGSAFFAISFFLRRDVGQPLEAISHAVRKFGQTRELPKFEEQPGEFQILLHTLTDMASTVVLRESEVQERQLQIELLLDSAGEGIYAIDTQGICIQCNPAAVALLGYASSTELVGRDIHTLCHRADEQGTHMPHSDCPGCKVIASGEPVHLAQEYLQRQDGSVFPVEMRIHPMHQGGRVVGAVVLFDDISRRLDAEQKLRLSERHFRTLVQALPGTFYKCAPDPLCTMYSLGDNIAELTGYAADSFIENHERSFSSVVHAEDWPRVREALDQALAQGVVYHLEYRVNHTDGKPRWVMDRGQAVYDEAGRAEVLYGVLLDMTERKQYEQRLESARQQADAGNRAKSEFLAVMSHEIRTPLNAIMGMGDLLGETALSPVQRHYLSISQHAGETLVELIEDILDLSRIEVGELELEPAPFEVEALVEEVCEVVTSSAHDKGLILLMRIDPLLPPVLIGDKKRLRQILFNLLFNAVKFTKHGEVMLDIRHDAARSAAGAVLLQVRDTGVGMAEEMIERVFEPFTQGDSTITRQYGGSGLGLTICKRLVSKMGGDIQLESALGRGTTATVQLVLPVGRHGMVAAVRQQVPLHGANLLLVDDNANNREIYTELLQQEGARVVGCATGETAMQQVSEANFDLAVLDFHMPSEDGLTLAGRIQEMVPNMPLLMLSSDQQPAAAARANSMGVTFLLKPVKRQLLRQTIAQLMQSGKGVKDAPVLGQGVESGPQKGLKILLAEDVPENALLIEAYLEETGHQISVVGDGQQAFERFQEEPFDLVLMDLQMPVMNGLQATRHIRAWEQAQGVKRTPILALTAHAMKEDESKSLEAGCDGHLTKPIRKQVFLQKLQGFLG

SEQ ID NO: 12940 - protein, 389 aa, Halobacterium salinarum
MSEDFYDVLGVSRDATEDEIMQAYRDQVSEYHPDVSDDPDAEEKFKKIQKAKDVLTDEETRQQYDQLGHERFEEAEKRGATGNGGGGAGGMGGAGGPFGGGMGGGAGGGMGDIFEQFFGGAGGGGGRGRSGPEQGRDLRTDLTVTLSEAYRGVSKQVTVRRPESCADCGGSGYPEDADVRTCPQCGGQGVVTQVRQTPLGRVQQRQECSRCGGEGELHSETCSTCGGQGQTRERATLTVDIPEGIRTGQTCAWTGEGATGEPERGDLLVDVTVEEHPDFERDGTTSITATPFSFPQAVFGAEIEVPTLDGAATFDLDAGTQSGETFRLKGKGMPRLRRRGNGDLYVTVQVVTPESLSDEQRDALEQFAEAGGEEIDVEQGFFEKLKNSF

SEQ ID NO: 12941 - protein, 454 aa, Neurospora sitophila
MSNLPSEPEFEQAYKELAYTLENSSLFQKHPEYRTALAVASIPERVIQFRVVWEDDNGNVQVNRGYRVQFNSALGPYKGGLRLHPSVNLSILKFLGFEQIFKNALTGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAIMAIKEARQSLTTFQHAGHVKWIEGARPWLHVGKVDIALPCATQNEVSKEEAEGLLAAGCKFVAEGSNMGCTLEAIEVFENNRKEKKGEAVWYAPGKAANCGGVAVSGLEMAQNSQRLNWTQAEVDEKLKDIMKNAFFNGLNTAKTYAEAAEGELPSLVAGSNIAGFVKVPQAMHDQGDWWSKN

SEQ ID NO: 12942 - protein, 435 aa, Deinococcus radiodurans
MHFGGRVPLFLSCCRLHLSGVPMKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 12943 - protein, 454 aa, Neurospora intermedia
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALTGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWLHVGKVDIALPCATQNEVSKEEAEGLLAAGCKFVAEGSNMGCTLEAIEVFENHRKEKKGEAVWYAPGKAANCGGVAVSGLEMAQNSQRLNWTQAEVDEKLKDIMKNAFFNGLNTAKIYVEAAEGELPSLVAGSNIAGFVKVAQAMHDQGDWWSKN

SEQ ID NO: 12944 - protein, 461 aa, Penicillium chrysogenum
MMQNLPFEPEFEQAYKELASTLENSTLFQKKPEYRKALQVVSVPERVIQFRVVWEDDKGQVQINRGYRVQFNSALGPYKGGLRFHPTVNLSILKFLGFEQIFKNALTGLNMGGGKGGSDFDPKGKTDNEIRRFCVSFMTELCKHIGADTDVPAGDIGVTGREVGFMFGQYKKIRNQWEGVLTGKGGSWGGSLIRPEATGYGVVYYVEHMIQHASGGKESFAGKRVAISGSGNVAQYAALKVIELGGSVISLSDSQGALVLNGEEGSFTAEEINTIAEIKVQRKQIAELATQDAFSSKFKYIPGARPWTNIAGRIDVALPSATQNEVSGDEAKALIAAGCKFIAEGSNMGSTQEAIDVFEAHRDANPGAAAIWYAPGKAANAGGVAVSGLEMAQNSARVNWSREEVDSRLKKIMEDCFNNGLSTAKEYVTPAEGVLPSLVAGSNIAGFTKVAEAMKEHGDWW

SEQ ID NO: 12945 - protein, 201 aa, Chlamydomonas reinhardtii
MLLTRKNVAVRPARAARRDVRAMSLLGNLFGGGSKPTSSTSNFHQLSALDIDKKNVDFKSLNNRVVLVVNVASKCGLTAANYKEFATLLGKYPATDLTIVAFPCNQFGGQEPGTNAEIKAFASARGFSGAGALLMDKVDVNGANASPVYNFLKVAAGDTSDIGWNFGKFLVRPDGTVFGRYAPTTGPLSLEKYIVELINSR

SEQ ID NO: 12946 - protein, 459 aa, Arabidopsis thaliana
MASGCALHGGCPSDYVAVAISVICFFVLLSRSVLPCLIHKAPRTNSSSFWIPVIQVISSFNLLFSIMMSVNLLRFRTKHWWRYCYLWAVWIEGPLGFGLLMSCRITQAFQLYFIFVKKRLPPVKSYIFLPLVLLPWIFGAAIIHATKPLNDKCHMGLQWTFPVAGLHALYVLALIAFTRAVRHVEFRFDELRDLWKGILVSATSIVIWVTAFVLNEIHEEISWLQVASRFVLLVTGGILVVVFFSISSNQPLLSQISLKKRQNFEFQRMGQALGIPDSGLLFRKEEFRPVDPNEPLDKLLLNKRFRHSFMEFADSCYAGETLHFFEEVYEHGKIPEDDSIRRIYMARHIMEKFIVAGAEMELNLSHKTRQEILTTQDLTHTDLFKNALNEVMQLIKMNLVRDYWSSIYFIKFKEEESCHEAMHKEGYSFSSPRLSSVQGSDDPFYQEHMSKSSRCSSPG

SEQ ID NO: 12947 - protein, 578 aa, Kluyveromyces lactis
METKTLIHSGAAKEMSYTERYNVAPLIPLPEYLFHRLFQLNCRTVFGVANYSTAKLYQAIAASGIQWIQTINQLNTSFAVDAYGRAIGVSCYVTSESAELGHVNGFFGSFCEYVPILQVVVLEQSHDLERLIGDVSIFHDVVDDPSEIDSCVRTLFWGKRPVYMGLRSKDATKLVPSSSLNGNIADKMGIKNTFFQTDTIKRVIDKIIAEVYASSRPLIVVDALIDRYNYNSTIQNFLTETGIPFVTTLMSKGSIDESLPNFVGTFLGTMSQPIVREYMNNADCTLILGCMIENFKNSYCRFNYKSKNQILLWNDRVKIENNIIPDILLHELLPQLIASLDTTKIVNSRPVTIPNMIPRVEPQPVTFLRQEYLWFKMSTWLKQGDVIISESGTSAIGLLQQKFPDNTRLVSQAIWNSSGYSIGACLGILAAYRDMGTLDKHRIILMVGDGSLQFTFQELSTILTHGFKPYIFVINNQGYTVDRTLNREKTHLNATYFDIQPWELLKLPSLFYSQEYFKRRCMSVGELNSLLSDKEFNKSDQLKIVELILPSMDVPVLLDPRDDSSDDESSPQHKRPRT

SEQ ID NO: 12948 - protein, 651 aa, Blastopirellula marina
MHSTPPASDHTREATALRRLLPRLKKTFADRIEPNEWETYTRRIDEHFPELFRQLYALYGHQYDFYFHLEGILTSITEMWLDRPSELKALDALREADPQWYQSQRMTGAMCYVDLFAENLQGVRDNIPYLTEMGITYLHLMPVFRSPKGDNDGGYAVSSYREVNPALGNMEELADLASELRHRGISLCLDFVLNHTSDEHEWARKALLGDLECQEYYRMYPDRSMPEAFEKSMGAIFPEEHPGAFTYRSQLRKWIWTTFHNYQWDLNYENPALFNRMIEEALFLANQGVEILRMDAVAFLWKRLGTTCQNLPEAHSILRAMNAAVRIAAPAMVFKSEAIVHPDDVRSYISEKECQLSYNPQLMALLWNSLATRETRTLRDALEKRFRIDPGCEWVNYVRCHDDIGWAFSNEDVEGAGFDASSHRRFLTDFYCGKFEGSFARGLPFQEDPITGDARVSGTCASLAGLEKAIAEKSDKEIDLAIKRIHLLHGVIMTIGGIPLIYLGDGIASLNDYAYEQDVDKLGDTRWVHRGKFDWDRAKERHDPESIVGRVYEDILRLVHLRGQTRALNRAQTEFVDAGNIHVLGYFRNAVDSSVLVLANFSEEEQQIEGRHLRMLGLRKTVIDILSGQTVTATHELKMGPYQMLVLMRPS

SEQ ID NO: 12949 - protein, 323 aa, Symbiobacterium thermophilum
MPKIRKIGVLTSGGDAPGMNAAVRAAVRRGISLGAEVVGVRRGYAGLIAGEFVDLGVSSVGDIIHRGGTFLQTARSDHFLTPEGQAQALAKAREAGIEGLVVIGGDGSFRGALRLTELGLPAVGVPATIDNDIYGTDLTIGFDTAVNTCLDAIRKIRDTATSHERTFVLEVMGRHSGWIALAAGLAGGAESILLPERPMPMEEVVTRLKRGVERGKRHTLIIVAEGVGSGFEVGRQIREMTGYDTRVMVLGHIQRGGSPTALDAMLASRMGAKAAEVLLEEGRGGLFIGVENEQMVTRPLEQVLGRRKEIPDELVDLAEILAI

SEQ ID NO: 12950 - protein, 730 aa, Blastopirellula marina
MVGDIILARDGHLTRQLLLEPAKFGLGKTRQSESPDATTTSVCGFCSTGCGLEIHLKEGRSVNLTPSTDWPVNLGMACPKGWEALNVLQSSDRATRPLRRGASGELEPTSWDEALHYFCQQMKGVQSRHGNDAVAFLSTGQIATEEMAFLGSLAKFGMGMQHGDGNTRQCMATAATAYKESFGFDAPPFSYADFEESDTLIFVGSNICIAHPILWERVLRNRHQPEIIAIDPRLTETAQAATSHLKIQPKSDLTLLYAVANYLIQKDWIDREFIAAHTNDFEPFAQHVQSYTIERAMELTGLSEQAIVELAEKIHRGQRVSFWWTMGVNQSHEGVRTAQAIINLALMTGNIGRPGTGANSITGQCNAMGSRLFSNTTNLLGGHSFTNEADRQKVAGILEIPIERIPTENSWAYDQIIEGIRQEKIKGLWVIATNPAHSWIHQNDLQEIFQKLDFLVVQDMYSNTETAQLADLVLPAAAWGEKEGTFINSERRYGLHKKVSPAPGEALADFQIFRAVADYWGCGEMFSKWTEPERVFETMQQLSEGQPCDISGIAGYAELDDRRGVQWPCATGETDRSVERRLFETGRFYHADEKAKFIFEDSRRPGETADDEFPFVLLTGRGAAAQWHTQTRTAKSSVLRKLYPNVLQVDLHPADAKALGIAPHELIHVESRRGIVQAHANLTAAVGRGQVFMPMHWDTVNQLTFAEFDPYSRQPSYKNAAVRLRRRQDV

SEQ ID NO: 12951 - protein, 507 aa, Unknown
  delta proteobacterium MLMS-1
MAGLATTFGSGAMTNSVNEIEAADVILLSGSNTTEAHPQVARRIISAQDRGARLIVIDPRRTEMAARADVHLGLKPGSDIPLLNAIQRIILDENLADELFIEMRTENFATLRDQLFRLELSATIASCGLEPAAVRQAALLYGRARKAVICYCLGVTQHVCGTANVEALANLAMLTGNVEKQECGVDPLRGQNNVQGACDMGGLPAMLPGYQPVADEECRRRFEQAWGVEIPTRPGKTLLEMTHGRLPPDHRRPAAGRQQPATPLRGLFIMGENPLLSNPDLTRVRKNLAGLELLAVSDIFLTETAARAHVVLPAACFAEKDGTFTNTERRVQLIRQAVAPPGQARPDGEIIAALARRLGYEMAGSPAHEIMEEIALLTPIYGGIYHDRLASGTGLQWPCWDRRHPGTPYLHKYYFTRGKGRFVVAAQEEPAEAPDADYPLLLNSGRLYHHYHTGAMTRKSPLLEREARVARLQVNPADAESRGIRDGERVRLRSRRGQVELAAELTT

SEQ ID NO: 12952 - protein, 1271 aa, Coccidioides immitis
MSRAPAGFADFFPTAPSVLQKKRSKAAQDRHAANTPKAADPLPNLGLSSTPDIKGGVGTSADNPVRAVGERSAETTLALGDTNGATSSSSLSTGSSGFFSASAPPGVAKPNGISSCALTPLTNTDSSPPCKIESPLGSKSGSTDAAPQLAPTCEAHGGPEPVTITPLHTPPTPRVQARPANSEVKGHKITYDPDLDRKFPSKARRRKPQYETFGVDDEKDPPPCDPRMAIANYTRGAACKQKTKYRPTPYILRPWAYDPTTSVGPGPPTQIVVTGFDPLTPIAAISALFSSFGDIGEINNRTDPMTGRFLGVCSIKYKDSRAFRGGISLSASQAVRRAYLECKKEQRIGTRRIRVELDRNGVVSGRMVAKLITAQKAEFPSLEESRKESVGDNDNRLPIGDGAKKDNEQSKDNLPPSTAPKGPSGRSSLHPSLLAPDGPRAVLKSPVPSRIEETPILQQIKRDPYIFIAHCYVPVLSTTVPHLERRLKLYDWKAVRCDKTGYYIIFENSRRGELEAERCYRMCHMTALFTYVMNMECQPYGNPNYERSPSPERIKAEKREKAKRERLHREMELDIEEEKRLRVENLDPAREALSVLIIELRDKLLDDVKSRVAAPALYDFLEPDRHNAKRQQLGIPAPEGTGRPSFRIDASTDGTVVHSQPDAYSRHHRPGGVSSLNVLALPRIRKVKGFEQGNAVYIDERRRAKPRKREFRPLYHRLQQLHEIEDSDDDQQVSFARDTEEVESRPLSRLSSESAESDNEDDLMRKSPSLLDAKPLDVPLPESESLAGGIEQSGLPDREKSIIEELERGINTLPTSSKKRKRLIEELATRKKRKEVDNLFELDAKPLESLVEETAQEALPADSTDALRTVTPVLKDKKRKVKGQSGKQIFEERQAPKRKEIDSTQPLLFEESVELLPEGEIEISEPAIEELKPEVEWGVSTDEPRPTAEDDDTIVLDLDGWQSLIKDDEDINFLKKALSEHLAADIGNLAAWTWKHKEIKAINRGGDRGPVHSETRIDGYYVPNPSGSARTEGRKRIRESEKSKYLPHRIKVQKAREERLAKAKNDPHAAAAEAARLLAAKSLSKSTSRSTRVNNRRLIADINAQKQALPMQNGDSDVLRFNQLKKRKKPVRFARSAIHNWGLYAEENISANDMIIEYVGEKVRQQVADMRERRYLKSGIGSSYLFRIDENTVIDATKRGGIARFINHSCTPNCTAKIIKVDGSKRIVIYALRDIDRDEELTYDYKFEREWDSDDRIPCLCGSAGCKGFLN

SEQ ID NO: 12953 - protein, 189 aa, Rubrobacter xylanophilus
MSEMSSMMPDVQEVLIPSEEIQQKVKDLGEQITRDYREHRRLLLVGVLRGAVIVMGDLMRRIDLPCEIDFMEVSSYGAGTTSSGVVRILKDLEEDISGRHVLIVEDIIDTGLTLSYLRRSLLARKPASLEICALLSKPARRRVELDVKYLGFEIPDEFVVGYGLDYAGCYRNLPDICILKPEVFGGAAS

SEQ ID NO: 12954 - protein, 427 aa, Dechloromonas aromatica
MNAPLLPSYISAQNIGPWHIFLQQVEQVAPLLDKSLWPWVETLRRPKRSLIVDVPIRLDSGEVAHFEGYRVHHNTSRGPGKGGVRFHQDVTLSEVMALAGWMTIKNAVVNVPFGGAKGGVRVDPRQLSISELEGLTRRYTSEISSMIGPDKDIPAPDMNTNAQVMAWMMDTYSMGEGRTVTGVVTGKPLSLGGSLGRQDATGRGVFVTAREAARKLNLPIEGARVAVQGFGNVGEASARIFAQAGARIVAVQDVSATLYCEAGLDIAALKRYLAENKTLLGAPGCEVIDNAAFWAVPCDFMVPAALESQINRYNAGQITARIVVEGANGPTTPEADVILAERGITVVPDVLANAGGVTVSYFEWVQDFSSFFWSEDEIYQRLERIMSEAFNAIWQLAEARQMSLRSAAFVIGCTRVLEARATRGLYP

SEQ ID NO: 12955 - protein, 1132 aa, Xylella fastidiosa
MKRMLINATQAEELRVAIVDGQSLYDIDIEQPSKEQKKSNIYKGRITRLEPSLEAAFVDYGTDRHGFLPLKEISKDYFQAGLDHHKAGIRELLREGQEIVVQVDKEERGNKGAALTTFISLAGRYMVLMPNSPSAGGVSRRIEGEDRAALKEALEKLNIPNDMGVIIRTAGVGRDTQELQWDLDFLLHAWRAIAEAALSKPAPLLIYQESRLIIRALRDYFRADIGEILVDTEEMYQDAHQFMRHVMPQSLRKLKYYKDDIPLFNRFQIESQIEGAYERNVRLPSGGSIVVDQTEALTAIDVNSSRATKGNDIEETAFQTNLEAADEIARQLRLRDVGGLVVIDFIDMSSSKHQREIETRLQNCLKYDRARVQLSRISRFGLLEMSRQRLRPSLGESSQIVCPYCDGHGRMRSIESLSLSIIRIVEEHAMKESTGQVLVQTPVEIANYLLNEKRRAINEIEKRHDAPIIIIADEQLHTPHYEVTRLRENELSEETGKPSYQRNTPRKLPVHALTKSQLNIPPAPAVKSITPPQLAPTQENIPTIREQSAENRAHPIPELVSSLASWLKRIFGNTDKRQTASNSSHPAPLQQNRNGNVQRNERNRRDGQIATSNTQPQQQSSSHRDNYRHNESNNYPQIQNQCTADTNGKLRNESQTPKSSAYVSKLPQMPRQPQPQLPKTPRTQSQPTQNSTKTILDKQPAPVLHGEDNTLQKAKPIPLTAEAVLNNIPAPSMTATPSGKDQDALPTTSNVTQGTSNALIEAKSTTKTNINTNTDIEPQQNNHEGTGNNDGSNRRRRGRRGGRRRRRNTSLGNETNAVSESNSIKLSNDTETDNADNIESPQALRPAMQENKRQPEFEFDDLAPAAPITAPLRKAIAAEREGISADLTTTAPQSIMETASRTHIASQMAPQSETSAASTTPNASVQATKTHTHKDVVSDSPSRTPYNAHSNTTRHSSGRRLETLSTAHPSAKAPPSEHITPTSRSNANTKTTKTEIPNKPTNANSDTAARPTTTDVLVVTNQPVIATKPSTTIEKAQTKVIPSTTYNNEHIETKRKIVTTESETTQPPVRKQRLPMQNPLPKVVAPLEDKKQAPFVENTTQRNINNATTTSQNDKSLGFTKNNEENSDNNTL

SEQ ID NO: 12956 - protein, 636 aa, Arabidopsis thaliana
MPTLYKKAGCHLQMTTMGKGRAPCCDKNKVKRGPWSPQEDLTLITFIQKHGHQNWRSLPKLAGLLRCGKSCRLRWINYLRPDVKRGNFSKKEEDAIIHYHQTLGNKWSKIASFLPGRTDNEIKNVWNTHLKKRLTPSSSSSSLSSTHDQSTKADHDKNCDGAQEEIHSGLNESQNSATSSHHQGECMHTKPELHEVNGLNEIQFLLDHDDFDDITSEFLQDNDILFPLDSLLHNHQTHISTQEMTREVTKSQSFDHPQPDIPCGFEDTNEESDLRRQLVESTTPNNEYDEWFNFIDNQTYFDDFNFVGESSMILVRFSARFTQTTLLFSFSITLMAALRVSVFRGQNRSQVDGWQWQHRLLPVCRDQAPHQASSPEIELGVCGRYAPPETLDKKLTRPKPIYLRVSRDLTLTDFGSKSLNFGLTVNLQFYINRDSLAMEQSEEGQQQQQQGVMDYVPPHAYQSGPVNAASHMAFQQAHHFHHHHQQQQQQQLQMFWANQMQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQEQHPDES

SEQ ID NO: 12957 - protein, 551 aa, Coprinopsis cinerea
MAAPATTPQSSINDLRVSLESLFSIVNPFNNSSAVTNSTETPLPTISESISSIVTFLSPALATCPTWLLYTSLAIISIFLLIHFTIFTPPSNLRHLPRVSPYPIIWSYIVRESVDQRMKRCVLPLAERGESVCAVWMLGKWGVHVLDGDILKYLTHNPALFPKKNYQEHLHFSFLSGPNVVFSNGEQWKRHSESVKAAFDREIPVYRFVSLAGDVMNMIGGSKEKGVVKIFSDLVQKYTLDVVGTTLLGHNFEALKTSSDDEELSFVDHFNQVMTSIATPVRLIFPFLDTYFPRTAVIAEVDALNARYDAVLEKKKGELGLDLLSYLLEDDRLSHEELRSNLSILFSAGHDTTSGAIASCVYFLSRHPEYQQRARQEVLDVLQDRKEPAYDDHPKFKFLYACIKEAMRINPPISLLPARWTTEAVVLSNGRGGTEYPIPQGISLVPNVWVVHNNPKVWKEPAVFDPYRFMPGEEKRGKVRPVHHIPFGTGPRQCVARQFSLYEQRTLLAMLLIEYEWRVPTDSEHREWVKNEFGAFGLSIPHHLDIEFVKL

SEQ ID NO: 12958 - protein, 299 aa, Erwinia carotovora
MEKNPITLLILNGKSAGNDELREAIGELRKDGYTLHVRVTWEYGDAKRYVEEAIQLKADNVIAAGGDGTVNEVAAALAVQPEAVRPCLGIVPLGTANDFATSCQIPMEMHNALTLAIKGRATAIDIAKVNDGHYFINMATGGFATRITTETPAKMKAALGSASYVLHALFRMDMLQAERCEIHGPDFHWSGDTLVIAVGNGRQAGGGQQLCPEALINDGLLELSVLSATELLPNMLQAWFTGSENQNMISATLPWLEISAPDDMTFNLDGEPLTAKRFRIEVLPAAIHCRLPPQCSLLE

SEQ ID NO: 12959 - protein, 471 aa, Unknown
  Candidatus Desulfococcus oleovorans Hxd3
MNGVDQPVSPVRKGQAVDLEIETLAFGGRGLARVDGLAVFVDHTLPGDRVSARITRKKSNFAEARLLEVLSPSPFRVLPQCPYCGHCGGCRLQILDYDKQLDCKHEQVADALRHIGLVENVPVHPVMPADPVWGYRNKMEFSFADRRWLLPEEMEMENIDTSFALGLHVPGTFHKVIDVDACLLLPEPGNAILGDVRAYARASGVPAYGLKSHQGFWRFLMLRHSVAHDNWMVNIVTAAEDRRLLQPLADLLADRYPEVVSVVNNITARKAGVAQGEYEILLHGAPFISDRLGRFSFDISANSFFQTNTRGAERLYTVAREYAGLTGSQTVVDLYCGTGTIAIWLSGAAKEVIGLEINDSCLADAVNNCRTNNVSNVRFVAGDVKETLPRLDCRADVLVIDPPRAGMHKDVVEQVLAMAPPRIVYVSCNPATLARDVAMLSEAYTVAEVQPVDMFPHTPHIECVARLDKKA

SEQ ID NO: 12960 - protein, 352 aa, Cryptococcus neoformans
MAAARFLSSARIARPSVISRTAAQYRGYSSAAPSGGANWPLLLSVAGATGVGAYAYLQYNPSVKKEVEAKIKGAEAEKAAAERTAAGISAFVKDTWIPFTLEKVEKYNHNTNIYHFSFGEEGKDKISGGEVASVVLLRSPEGPEQIKDEKDKPIIRPYTPISPPDQKGSIEFMIKSYSGGKFTPFLSNLSPGQQVLFKGPLQKFKYQPNSFEKGLCIAGGSGITPMWQLINHSLSIPEDKTKWTLIYSNVSEADILLRKEFDALAQKYPGRLDIKYVLDKGPWGWKGETGYVTADLIKKTFPKNEGENIRAFVCGPPGQMKAVSGEKDGMKQGELAGALKELGYTSDEVFKY

SEQ ID NO: 12961 - protein, 1089 aa, Fusarium oxysporum
MTATTQKRVVVVGLGMVGIAFIEKLLKYDAKSKEYAITVVGEEPYLAYNRVGLTTFFEHRKVEELYMNPAEWYTEAGSSLNCHINTKATHINTEDKIIECANGESYPYDILVLATGSDAILPRMLKGWDANGVFVYRTIEDLNKLIKFSNDKKGTNGAVVGGGLLGLEAAKAMLDLETFNRVDVIEKAQWVLTRQIDETGGKMVADQVSQLGVNLNLGKGVSSMKTDENNNLTGVIFDDGSEISCSTLCFAVGVKPRDDLARSANLEVGQRGGIVVNDDLRTSMPDIYAIGECASWRGMAYGLIAPGVAMAEVVAFNLTQAKLHSPQTFKTPDMSTKLKLLGVNVASFGDCFADRDGPVTLPPKYARTLVNGDAKEPKAVQALTYKDPFSNVYKKYIFTKDGKYLLGGMMIGDVCDYVKLLPMVKAQKELEISPSELILGAKKDGGEDTDDLDDDAQVCSCHNVTKGDIVKVVKDGTCKDVASIKKCTKAGTGCGGCVPLITTIFNKTMASMGQEVTNYVCSHFNHSRADLFNIIMVKRLKNMGEVMREAGNDKEALGCELCKPVVASIMASLWNRHVMDKTTHGLQETNDRFLGNIQRDGTYSVVPRVSGGEITPDKLVVIGEVAQKYNLYTKITGGQRIDLFGAQKQDLLDIWGQLVAGGMESGHAYAKSLRTVKSCVGSTWCRFGLSDSVGMAVRLEERYKSIRAPHKIKGGVSGCVRECAEAQGKDFGLIATEKGWNIFVGGNGGANPRHAELLAKDVPPADVVTILDRYLMFYMRTADKLQRTARWIENLPGGIKYLQEVILEDKLGINASLEAQMEELVDSFFDEWAEAIKSPAIAAKFKQFANTNDTTRNMELEDDRGQKRPAFWPADAAATDNFSGLKDKWSMTSWEPIIESSYFDGADELPNGISATVKRGDTQLAIWRIKGVYYATQQMCPHKRAFILSDGLIGQEPNKAVTNGDKDGASPWVSCPHHKRNFDLGNGACKTDESLSIATFPTEARADGMLYLKLPPVEELDAALGTKKWMVKKGEAGEAPLAKLDSKIKFVGLRGKKPYVKPTGGAKMTTKPLDLMMAANGCGGGAPEW

SEQ ID NO: 12962 - protein, 451 aa, Chlorobium tepidum
MDDDSNQKPLFHMALGVLTSLTPPQHHIELVDEHFHDKINYDGDYDMVGITSRTIEATRAYEIADEFRKRGKTVVLGGLHISFNPEEAAAHADCIVVGEADNLWTTLLDDVANNRLKERYDSKDFPPVKAITPLDYARIAKASKRTKVDGTKSIPIYVTRGCPFNCSFCVTPNFTGKQYRVQDPKLLKHQIEEAKKYFFKANGKNSKPWFMLTDENLGINKKKLWESLDLLKECDITFSVFLSINFLEDPTTVKKLVDAGCNFVLAGLESIKQSTLEAYNKGHVNSAEKYSKIIEDCRKAGLNIQGNFLFNPAIDTFEDIDELVQFVKKNHIFMPIFQIITPYPGTQMYHEYRESGLITIEDWEKYNALHLVIKSDRYEPLLFQYKVLKSYVEVYTWKEILLRTLYNPRKLINLVTSIAFKKHLAAQLKAFERNHKMNPAMLSGVKPVMNG

SEQ ID NO: 12963 - protein, 170 aa, Zea mays
MSMSKTGQAAEKDEQQQSRGIALMQGICAVVYRKADNTPCPIKQGLYLGSVGAAFNKDALKSLNITHILIVAKSLDPVFPAEFNYKKIEDEAISSGGNVLVHCFAGRSRSVTIVVAYLMKKHQMSLESALSLVRSKRPQVAPNGGFISQLEKFQKSLQVEQEWRMQPVQH

SEQ ID NO: 12964 - protein, 286 aa, Pseudoalteromonas tunicata
MTNLDQTTWFTEVSDRDGSAFSLRINKKLEEKQSPFQKVEMYETTDFGNLMIIDGCTMVTTRENFFYHEMISHPALYSHTNPKNVVIIGGGDCGTLREVLKHPAVETVHQIDIDAVVTEMALKYFPELCESNNDPRATVMFDDGIKFMADAAPESIDIIIVDGTDPVGPGEGLFNHAFYTSCLKALRSGGILVQQSESPLMHMPLLVEMRDAMQDVGFADLQTLPFPQPIYPSGLWSVTLARKDENFAGFREHDANSANFDTEYYNTGIHLGALATPNFMKRAFNK

SEQ ID NO: 12965 - protein, 249 aa, Chlorobium tepidum
MPTKFQLEEMLRAGVHFGHLARRWNPKMKPYIFMEKNGVHIIDLKKTLVMAEEALKAIEAIASTGREIMLVGTKKQAKVIIAEQAERAGMPYVCERWLGGMLTNFSTIRQSIRRMNAIERMETDGTFDMITKKERLMLIREKDKLVRILGGIANMNRLPAALFVVDIKKEHIAVKEARSLGIPIFAMVDTNCDPDEVDYVIPANDDAIRSIDLMVKAVADTILEARTLQVEQEVLAEMDEAAEEETAND

SEQ ID NO: 12966 - protein, 523 aa, Solanum lycopersicum
MFKTNNVTARLFERQICTPAPGTSIHRARRFYENVVPSYTIYDVECPDHSFRKFTDDGLYFVSFSRNHQDLVVYRPTWLTFSCKEEDCDTHDLPLKARKFESFFTQLYSVTLASSGELICKDFFLYMESNQFGLFATSTAQIHDAPPTGGAIQGVPSVEKITFHLLRLVDGAILDERVFHNDYVNLAHSIGAFLYDDLLAIVSLRYQRIHILQIRDSGDLVDVRAIGEFCREDDELFLNSNSQVLVNHVGNGFHHSLPQSETSFLSGIKQRLLSYIFRGIWNEADQTMRVQCLKKKFYFHFQDYIDLIIWKVQFLDRHHLLIKFGSVDGGVSRNADIHPSFFAVYNMETTEIVAFYQNSADELYFLFELFSDHFHVSSKSSLHMNFMSSHSNNIHALEQLRCTKNKATNFSQFVKKMMASLPCSCQSQSPSPYFDQSLFRFDEKLISAIDRHRQSTDHPIKFISRRQPNILKFKMKPGPEAGSTDGRTKKICSFLFHPILPLALSVQQTLFLQASVVNIHFRR

SEQ ID NO: 12967 - protein, 170 aa, Ustilago maydis
MSTSSYAELNPYEEARLYSNNHDRERYENMATLFSLIVALDYLERAYVRESISEKEYAPTCTRLLAQCKTMLKLIVDQEKHSSKPITDLADFMRIYKMNYLAAVHRLTVGVPATVEHASSSSLQSSSDRAKWVAETTQNFITFMDALKLKLLAVTRSERIRTQAIPEQSS

SEQ ID NO: 12968 - protein, 546 aa, Rhodospirillum rubrum
METITVVLFLLFCVVVSDLLARTLPIPVPRPLYQIALGGVIGLFADLRVVLEPDIFFLLFLPPLLFLDGWHIAREEVFKDRFVILELAFGLVFLTVLGAGLFIHWMIPAMPLAVAFALAAVVSPTDPIAVSAIAKHAPIPKRMMNILEGESLLNDASGLVCLRFAVAAALTGGFSLTDAALEFLWVALAGIAVGISLTWAVTRSKNMLARRIGESSATQTLISLLIPFGSYLVAEHLDCSGILAAVAAGVTMSIEESSGQAQAATRIRRNTVWDTIQFAANGVIFVILGEQLPAILESAAETVRVTGHHEPWWLGIYVVAICLGLAALRFLWVWASLQVSLLRTGQKRPPRHWRLITAMSLSGVRGAITLAGVLTLPLTMTDGTAFPARDLAIFLAMGVIIVTMVVATVFLPLLLNGLEMSQDSTADDQEAAARIAAAEVAIAEIERVQHSMAEGAKDADLFVTVGASLMDVYRERVRSRSQEGEAAVLVRRVDWIEREMRLAALRAERSEIFRRVRKYQLGSERARKLIRELDLLETRYSAEPKG

SEQ ID NO: 12969 - protein, 553 aa, Mycobacterium avium
MSSMGAQTALTLLLAAIAVIVLVDWISERTRLPSATLLVLVGIGQALLPGPTIGLEPDVVMTCILPPLLYHAALESSLVGIRRNLRTVVSLSVVLVLLTAASVGVAFSLLVGGATLAVGMVLGAAVAPTDPVAALAVARKEGLPLNIVTLIEGEGLLNDATALTTLAVAVTVARGAAFSAPSAIREFVLAAVGGLVVGQVFAYARRLLRRWRHDVLTANAISLATPFLTYLVAEKLSASGVLAVVVCGLIVGHDSPRVESGASRLQTRAVWRLVNFLLEGVVFLLIGHQVPVILDELGGYALSTILVAVGVTVAVVLLVRPLWLLLTQALPRSLHTRLGNVDDSATDDAEPRPERTRERLSGREIVVLSWAGTRGVVSLAAIFAVPVLTEGNAPFPDRDLLLFCTLVVVLVTLIGQGVTFGPLVRALGLRAKTTDELRLRNRARAAALRAALDRLDSLDPEDGADVDPRVIDVVRQQLSAQLERYEHRLTLLSDVDELPAAPAYEAAVGLRRVAIDAQRDELVRWRDAGMLPDQSLRAIERELDHEESMLPMG

SEQ ID NO: 12970 - protein, 756 aa, Unknown
  Silicibacter sp. TM1040
MEQTQPDTDGPLSQHNARFSPRGLLIRYAVIRARMYYARMFAAAGLTSVLAVIFGPFWPLVFFVLYLITDKAETTYLRGLPERLENGTSLAKAKRIIFVFSVLYAGSVCGFAAIPYVQMHTEAGAHEILAEPFFALCIVLGPALSAALDLRYVPLAASVRLLMLSLLPFGLTAHILLQNQTHGADLQLMVAGLVAFFFTQIWFVVMVQKRHRNSRRNLRSQALQRQALEDAYMRLFDQKQEARRLAMIAEHANDGVMLIGRDGIVRWANDGFSRLTGYTFDELVGQNPGKILNSENTDPAALRVIEAGREKGEPFRAELINRRKDGKEIWIETNQVPVFDDTGQIETYIAVERDVTATKEYERQLKEARLAAEEGARIKEEFLATMSHEFRTPMNGVIGMAQMLQATDLSEDQRLYTDTILGSSRALLALINDVLDLSHMNAAGVSLFNVDFDLHACVGDIVRLLSGQADEKHLELSVEIDPDVPVWVTGDDRRLRQILVNLLGNAVKFTTSGSIFIRLRGVVTGDQVALKIEVEDTGIGIPADKLEKIFERFSQADNAISRKYGGSGLGLSISRGLAQAMGGDIDVTSVEGEGACFTLMLDMGVADCPSIVADEAEDADSLPALDQLQGLRLLVAEDNRVNRLLIRKFLDDAPLELRFATNGAEAQELAKRFRPQVILMDMSMPEVNGLEATRAIRSFDITQPYIAALTANVDETSRQACVDAGMDTFLSKPLSRKELLNLLLTFSERARASERG

SEQ ID NO: 12971 - protein, 112 aa, Zea mays
IDSELYHAQSPIATDLCREDFDLYHLSESSLHIYPLNIVIKTCGTPDLLLTIPRILQLAEDLSMPLADVKYFCGTLMFYVTHPFPYKYFCDEVAVLNRYYSCLKYRDHADIN

SEQ ID NO: 12972 - protein, 535 aa, Rhodospirillum rubrum
MRILFVHPNYHSGGAEVAGKWSPAWVAYLAGYLKAGGYSDIRFVDAMTDDMTEEELRAIFAAEQPDVIGTTAVTPAIYKAERVLEIAREECPNAVTILGGIHATFMFQQVLVEAPWIDTVVRGEGEAVTLNLIRAIDEGRWPADRASIKGIAYLEDTKVVATPAEPPIRDVDSIIPDWGVLEWKKYIYIPLGVPVATPNMARGCPFTCSFCSQWKFWRDYRVRDPKKVVDEIEILVRQHGVGFFILADEEPTINRNKFVEFCEELIRRDLGVMWGINTRVTDIMRDEDLLPLYRKAGLIHISLGTEAAAQLNLDIFHKETTVAQNKRAIELLRKHGIVTEAQFIVGLENETAETLEETYKMCMDWNPDMANWSMFTPWPFSDLFHELGDKVEIFDFEKYNFVTPIMKPNAMDRAELLDRVMHNYRRFYMRKSFLGYPWVLNRVRRRYLLGCLKAFLLSAFQRKFYDLGRAGYWGPQSKKKVDFHFDHSRTLVKPQEDNWKNAPKHKRPAAAMKACGGGDEQLAESLTPPPVKVKI

SEQ ID NO: 12973 - protein, 646 aa, Oryza sativa
MESKGGKKKSSSSRSSLMYEAPLGYSIEDLRPAGGIKKFRSAAYSNLLPSDREGHQSCFLSSSSLASSFETMAVLSVADSPPVSAIGFEGYEKRLEITFSEAPVFADPNGRGLRALSRAQIDSVLDLARCTIVSELSNEVFDSYVLSESSLFVYPYKIVIKTCGTTKLLLAIPRILELAEELSLPLEAVKYSRGTFIFPEAQPSPHKNFSEEVAVLNRYFSGLKSGGNAYVIGDPAKPGQKWHVYYATQHPEQPVVTLEMCMTGLDKKKASVFFKTSADGHTTCAKEMTKLSGISDIIPEMEVCDFDFEPCGYSMNAIHGPAFSTIHVTPEDGFSYASYEVMGFNPASLAYGDLVKRVLRCFGPSEFSVAVTIFGGRNHAGTWAKGLDVGAYSCSNMVEQELPSGGLLIYQSFTATAEIATGSPRSVLHCFADENTEKAGKMEALYWEDDAVEDIDGTEGNELSTLYADLILCTNTTAIGKYDFCSAPISDPSGSATGTETGSFGGGGEEQCKRIVVQKSISCEKCVILYYTDEKRLQLLPLHGKAGRDAAAAAAASVTDACMLVGDVTATADLLLLHPQHIRFIFRLLLKLNGTSIQLVQGNKCVIGLCLEAEVSCCIFKDSSHSFSNAAIARARCVGFFIWLPR

SEQ ID NO: 12974 - protein, 503 aa, Desulfovibrio vulgaris
MKVYLIGAGPGDPGLLTLKGKEILERADVVVYDFLANDAFLAYAKPDAEIIYVGKKGGDHTLSQDGINRLIIEKAKEGKVVARLKGGDPYMFGRGGEEAEELLDAGVPFEEVPGVTSAIAGPAYAGIPLTHRSYASSVSFITGHENPDKPDSAHNWQALAAGTSTLVFFMGMKNLPDISRKLIAAGMSPDKPAALVRWGTTPRHRSLVATIATLPEEAVKHGFSNPSLIVVGDVVRLRDRLNWFEHKPLLGKGVVVTRAREQASGLAAALRELGADVIQFPTIDIHPLDDYAPVHEAIRALDTYDWVVFTSVNGVKHFWNQLAALGLDSRALGGRKVAAIGPATADALRDKGIAPDFIPEKYVAEGVVEGMLARGMGGKRVLLPRALEAREVLPEELRKAGATVDVLPVYVTVPSAARRDDVLARMEAGEVHCVTFGSSSTVENFFSLVPADTVKAHPEVKLACIGPVTKKTLEGFGFTCHIQPDDYTIPALVDELTRVLPEL

SEQ ID NO: 12975 - protein, 240 aa, Pasteurella multocida
MAQVSMRDMLQAGVHFGHQTRYWNPKMKPFIYGPRNGVHIINLEKTVPMFNEALVELTRIAGNNGKILFVGTKRAATEAVKAAALDCQQYYVNHRWLGGMLTNWKTVRQSIRRLKDLETQSQDGTFDKLTKKEALMRTREMEKLELSLGGIKEMGGLPDALFVIGADHEHIAVKEANNLGIPVFAIVDTNSDPDGVDFVIPGNDDAARAIQLYLSAAAAAVKEGRHQDAVTEENFVAEAE

SEQ ID NO: 12976 - protein, 256 aa, Brucella melitensis
MALPDFSMRQLLEAGVHFGHQTHRWNPKMAPFIYGERNNIHILDLSQTVPLLNSALKVVSDTVARGGRVLYVGTKRQASDIIADAGNRSAQYYVNARWLGGMMTNWKTISNSIQRLRKLDELLAGEAQGFTKKERLNLEREREKLDRALGGIKDMGSVPDLMFIIDTNKEAIAIQEAKRLGIPVVAVIDSNCDPDQIDYPIPGNDDAARAIALYCDLIARAALDGIARQQGAMGIDVGAQVEAPVEPALQAPAEGA

SEQ ID NO: 12977 - protein, 108 aa, Buchnera aphidicola
MNKIIELTDQNFEEQVLNSKSFFLVDFWAQWCNPCKILAPILEEISKEYSNKVIVGKLNIEENPNTAPVYSIRSIPTLLLFNNSEVLATKVGAVSKLELKEFLDENIN

SEQ ID NO: 12978 - protein, 256 aa, Pseudomonas fluorescens
MHPYFSLQGRTALVTGGTRGIGKMIAKAYVEAGARVYVCSRDAEACHQTAEELSALGTCLGIAANLATEEGVKELAARLGEQITHLDILVNNAGTTWGAPLESYPVKGWEKVMQLNVTSVFSCIQQFLPLLRKSGSAANPARIINIGSVAGISSFGEQAYAYGPSKAALHQLSRILARELVSQHINVNVIAPGRFPSKMTQHIGSDQQALADDTALIPMKRWGREEEMAALAISLASTAGAYMTGNIIPLDGGFSL

SEQ ID NO: 12979 - protein, 551 aa, Zea mays
  misc_feature (508)..(508): Xaa can be any naturally occurring amino acid
  misc_feature (521)..(521): Xaa can be any naturally occurring amino acid
MNTVALLSLAPQLLIKPSLTCFSRKGVGRYGGIKVYAVLRDDGAEFAKNNNLEALFHVDDPGPRVPIKKGRFLDVNEALEVVRFDIQYCDWRARHDLLTIMVLHNKVVEVLNPLAREFKSIGTLRKELAELQQELAKAHNQVHLSETRVSSALDKLAHMETLVNDRLLPPDGASSTSTAQPTSLVPSTSSTARVRAKKPPRRGLNVSGPVKPYNPSLKNFWYPVAFSSDLKDDTMVPIACFEEQWVIFRGKDGRPGCVQNTCAHRACPLHLGSVNEGRIQCPYHGWEYSTDGKCEKMPSTKMLNVRIQSLPCFEQEGMVWIWPGDDPPKATIPSLLPPSGFTVHAERCVLLIIQQIVMELPVEHGLLLDNLLDLAHAPFTHTSTFAKGWSVPSLVKFLTPASGLQGYWDPYPIDMEFRPPCMVLSTIGISKPGKLEGKSTQQCSTHLHQLHVCLPSSRNKTRLLYRMSLDFAPWLKHVPLMHLLWSHFAEKAFLNEDLRLVLGQQERXQWRQRLELAGIIXKLGVRYRLWRDTVERGSERLPFSNQAESGS

SEQ ID NO: 12980 - protein, 563 aa, Chromobacterium violaceum
MTTLSMENFAQLFEESLTLHDMRVGEVITAEVVAVDSNFVTVNAGLKSESLIPAEEFKNDQGVVEVAIGDFVTVAIDALENGFGETKLSREKAKRMAAWVELEEALEAGTILSGMISGKVKGGLTVMVNGIRAFLPGSLVDVRPVKDTTPYENKQIEFKVIKLDRKRNNVVVSRRSVLEETLGEERKALLETLKEGAVIKGIVKNITDYGAFVDLGGIDGLLHITDLAWRRVKHPSEVLAVGDEVEAKVLKFDQEKNRVSLGLKQLGEDPWVGLSRRYPSGTRLFGKVTNLTDYGAFVEIEQGIEGLVHVSEMDWTNKNVHPSKVVQVGDEVEVMILEIDEDRRRISLGMKQCLANPWNEFADNFHKGDKLKGAIKSITDFGVFVGLPGGIDGLVHLSDLSWNEAGEEAVRKFKKGDEVEAVVLSIDVEKERISLGIKQLEGDPFNNFVAMNDKGALVKGTVKSVDAKGAVIALDADVEGYLRASELSRDRVEDARSVLKDGDAVEAVIVAVDRKSRNISLSIKAKDAQEDNAALKSLAVDSASAGTTNLGALLKAKLSGSNE

SEQ ID NO: 12981 - protein, 129 aa, Triticum aestivum
  misc_feature (38)..(38): Xaa can be any naturally occurring amino acid
  misc_feature (51)..(51): Xaa can be any naturally occurring amino acid
YVYLERRQLLSWCGMIRSECIRLFSSIRIWYMYDRSSXHQQEMLSSPDGFXIRKEVMYGVRQRKKMTATKVVMTVEAQHRYVTWRDEKDHGFLLGKKLSGESHIKDLVNEFMFEGVHYLELSIFPVIFE

SEQ ID NO: 12982 - protein, 635 aa, Aspergillus oryzae
MTQLFASSPSNVSNEKRGSFPSLSLPSKKHTNESSHLPTKIKNFFRINSSSSNSSHHSHSHSGDRDREGSPHTGAKTESKSAFRQSRFLPTIGRNRSTTVASEGNPLDEGVSPTATANPYFVHQGQPSLQHRNDGSEPSSPPDTPELQVDGVSAAEQATTANKTELARKLRRVASAPNAQGLFARGDNDGRPQTAETGNQPPVEETDSQITIAEDTVGSLAVPKLGADGKIPSPGEIRNQVAFRRTYSSNSIKIRNVEVGPSSFDKIKLIGKGDVGKVYLVREKKTSRLYAMKVLSKKEMIKRNKIKRALAEQEILATSNHPFIVTLYHSFQSEDYLYLCMEYCSGGEFFRALQTRPGKCISEDAARFYAAEVTAALEYLHLMGFIYRDLKPENILLHQSGHIMLSDFDLSKQSGPGGAPTMIPGRSGNSTTSLPTIDTKSCIADFRTNSFVGTEEYIAPEVIKGCGHTSAVDWWTLGILIYEMLYGTTPFKGKNRNATFGNILRDDVPFPEHGGAQQISNMCKSLIRKLLIKDETKRLGARAGASDVKTHPFFRQTQWALIRHMKPPMIPHQSRGTDTLNFRNVKESASVDIGGSNPTKMKGVPMDSGLATPNGEVNDPFEEFNSVTLHHDGDM

SEQ ID NO: 12983 - protein, 280 aa, Unknown
  marine gamma proteobacterium HTCC2143
MNDNVFSLIKSHTNTDTNNGKIKSVGHVYLVGAGPGDEELITVKAMRLLQEADAIVYDRLANPALLSYGKPHCDLIYVGKKKDQHSLPQEKICDLLAALAGCGKNVVRLKGGDSFIFGRGGEEIDYLRRQGIQCSVVPGITAASGCAAATQIPLTHRDYAHAVVFITGHRQNGKMTINWDLALQKDCTVVFYMGLSNLEEITKQLIERGCPTDKPFAVVSQGTSSEQQVVLGTISDIAQRLMHRPLLSPALLMMGDVIHANGYALGLANQTAAEYRGVNQ

SEQ ID NO: 12984 - protein, 566 aa, Agrobacterium tumefaciens
MSVSTPTRDDFAALLEESFASNDLAEGYVAKGIVTAIEKDVAIVDVGLKVEGRVPLKEFGAKSKDGTLKVGDEVEVYVERIENALGEAVLSREKARREESWVKLEAKFEAGERVEGVIFNQVKGGFTVDLDGAVAFLPRSQVDIRPIRDVTPLMHNPQPFEILKMDKRRGNIVVSRRTVLEESRAEQRSEIVQNLEEGQVVDGVVKNITDYGAFVDLGGIDGLLHVTDMAWRRVNHPSEILNIGQQVKVQIIRINQETHRISLGMKQLESDPWDGISAKYPVGKKISGTVTNITDYGAFVELEPGIEGLIHISEMSWTKKNVHPGKILSTSQEVDVVVLEVDPSKRRISLGLKQTLENPWQAFAFSHPAGTEVEGEVKNKTEFGLFIGLEGDVDGMVHLSDLDWNRPGEQVIEEFNKGDVVKAVVLDVDVEKERISLGIKQLGKDAVGEAATSGDLRKNAVVSCEVIAVNDGGVEVKLVNHEDITSFIRRNDLARDRDDQRPERFAVGQVFDARVVNFSKKDRKVMLSIKALEIAEEKEAVAQFGSSDSGASLGDILGAALKNRGE

SEQ ID NO: 12985 - protein, 887 aa, Unknown
  marine gamma proteobacterium HTCC2143
MSQDCTVKTTCPYCGVGCGVDVIVDDNQIIAVSGDQQHPANFGKLCVKGSALHETMGQHGRLLQPQINGMTVDWPTAIETVAEKLLSIREQYGPNSIAFYLSGQLLTEDYYVANKLAKGFIGTSHVDTNSRLCMSSAVASYKRAFGADAVPCNYEDLEQCDLLVLVGSNAAWTHPVLYRRMAVAKENNPQLKIVVIDPRRTATCDLADLHLDLEPGADSFIFTGLLHYLADNKYTDTDYIADHTEGFADAVDSAEVATLAFVAAKANLEVEDLTTFYQWFASTEKAMTFYSQGINQSSTGTDKCNAIINCHLATGKLGKVGAGPFSITGQPNAMGGREVGGLANMLAAHMDYTPDNIATVSEFWNSTAVSQQVGLKAVDLFDAVADGQIKAVWIIGTNPVVSMPNADRVKAALENCDTVIVSDCIAETDTTATANILLPATGWGEKSGTVTNSERRISRQRSLLTAAGEAKHDWWILSQVGQAMGYGQAFSYSSPRDIFVEHAALSGYENSHEHKRLFNISALSHLSEPDYDQLQPIQWPVTAAKPEGTPRLFSDGLFATPSGKAQFITSVSKLPKQQLSADYPLALNTGRLRDQWHTMTRTGRASRLLDHTDQPFVAVHPATAAHYDLTDGDLAAVKTAHGTIEVVVQFDSNLKRDQLFVPIHWNQQFASNARVGTVIAPITDAVSGQPEFKFSAAALCKISATGNAVLVSRNRLMCDSFSNWSVSPLDNNQGYLYRVVVQEAFNWQEFIATKRLLERGPAQAYEHYSNVSCADHRFICYSDQQIELAIFSHVDKRQLPGRVWLQQIFSQTVKGDYWSLIAASDQADPGKQICACFNISEQRIIQAIEEGASSAVELGRQLKCGTNCGSCIPELNNLLSQTEHAID

SEQ ID NO: 12986 - protein, 516 aa, Bacteroides fragilis
MLDSAIKEQLRTIFAALEANYTFDITVSPQHESRTELLELLNDVASCSEKLSCRINEGKGLEFTLLKGEHRTGITFRAVPNGHEFSSLLLAILNTDGKGKNFPDEGICNRVKSLKGPVRLTTYVSLTCTNCPDVVQALNAMTTLNRQIQHQTVDGAINQAEVEALKIQGVPSVFADGKLIHVGRGDFGELLAKLEEQYGTETNSAETSIKKYDVIVAGGGPAGSAAAIYSARKGLNVAVIAERIGGQVKETVGIENLISVPSTTGSQLADNLKTHMSQYPIDLLEHRQIEKIELDGKDKVLTAKGGERFSAPAVIVATGASWRKLNVPGEAEYIGRGVAFCPHCDGPFYKGKQVAVVGGGNSGIEAAIDLAGICSKVTVLEFMDELKADQVLQEKLKSLPNVEVLVHSQTTEVVGNGDKVTGIRVKDRKTEEERVISLDGIFVQIGLVANSGIFRDVVEVNRPGEIVIDAHCRTNVPGIYAAGDVSTVPYKQIIIAMGEGAKAALAAFEDRMRGEI

SEQ ID NO: 12987 - protein, 841 aa, Unknown
  marine gamma proteobacterium HTCC2143
MINVVVIGNGMVGHHYVEQLAAAEVEAHITVIGGEPRPAYDRVHLSEFFSGRTAKDLALTTREHYAEIGVDAYFGDPVISIDRDEKKVRTESGREFTYEKLVLATGSYPFVPPVKGNDHKPCVVYRTIDDLGNIQAQAKEAKVGVVVGGGLLGLEAANAVQNLGLETHVVEFAPGLMGVQLDAGGSAMLRRKIEAIGVYVHTSKATEVIEESENGAGRLLMKFADGGSLPTDMIVFSAGIRPFDQLARDCGLKVGERGGIDIDYHCRTSDSDIFAIGECALFGGRIYGLVAPGYRMAEAAVSQLGDDPIAFHGADMSTKLKLLGVDVGSIGDAHGKAEGSVAYTFSDERIEVYKRLIVSADGKKLLGAVLVGDCSDYDTLLQYFLNDIDLPANPESLVLPYSVGEAPSLGAAALPASATICSCHNVSKGDIVASLDAGSCSLADVKSETKAASGCGGCAALLKSIVDHEMAARGLEVNTSICEHFAYTRQELFHLIKVGCIKSFDVLLEKHGSGRGCDICKPAAGSILASLWNDYVLKEKHVGLQDTNDTFLANMQKNGTYSVVPRIAGGEVTPDKLIVLGQVAKKYNLYTKITGGQRIDLFGARVQHLPAIWRELVDAGFETGHAYGKALRTVKSCVGSTWCRYGVQDSMAMAIYVENRYKGLRSPHKFKSAVSGCTRECAEAQSKDFGIIATENGWNLFVGGNGGMKPRHADLFATDLDDETLIKYIDRFLMFYVRTADRLQRTSVWMDNLEGGLDYLRAVVIEDSLGIARELEEQMNSIAGSYQCEWKTTIEDPERLKRFTEFVNTDAEDDHVVFVQERQQPRPATEDERLQLLAIEV

SEQ ID NO: 12988 - protein, 745 aa, Debaryomyces hansenii
MDEFEHRQRQWYRMVIFDLVLWMFSVVCDCFFREIRPRGAFRLPRQGPVIFVAAPHANQFVDPIILMGQVRKEAQRRVSFLIAAKSYKQRIIGFLSRCQFSIPVIRAQDNLKKATGKIFIDVELDPCRVTGKNTKFLLECAVRGMLALPQSLGASEILEIISDTELVIRKEFKRTDQITTLLKNGTSFKLADRIDQKKVYQIVFRHLSLGNCIGIFPEGGSHDRTDLLPLKAGVAIMALGAMEYNPDCNVKIVPCGMNYFNAHKFRSRAVIEFGHPIDIPKELVKKYLNPETNRESVKELLDLITTGLKAVTVTCEDYETLMVVQAARRLYAGNFVQFLPLPLVVEMNRRLVLGYQTFRNEEQIKNLKEKIIIYNNQLKQLYLPDHHVEACDESHKLRVLPILLFRIVKLFLLMLLALPGATLFSPVFICTKWYSTRKAKTALANSTVKIKANDVVATWKILISMGIAPLVYSFYASIGTWYCHRYKKFEDWNVSLFFVWFILYMLGVIVTYSALLTGEQGMDIFKSIRPLYLSITSGSSIKDLKKLRNELSEEITYVVNHFGPDLFPNDFDLLKLKEHLKISDNVDYVDSDEEEERKTQEVRKRRMKNRKAARRKQALDDSISGLSLDEKNSSSVSDGISLMNSDNSLTNIPMFSDYHLHMNAKNPDIKIEQQSVVHLSASIADDFNYKVHNSPAGKPSVSRYDSNSHIELNFGNLKEEQPSKSKLSDKIKYKIRESRDKAAGN

SEQ ID NO: 12989 - protein, 376 aa, Oryza sativa
  misc_feature (18)..(18): Xaa can be any naturally occurring amino acid
WTISIDQPWPAVVFDAAXLSKQEAIPAQFVWPADEAPGADDGVVEEIAIPVVDLAAFLASGGIGRDVAEACERHGFFQVVNHGVDPALLAEAYRCCDAFYARPLAREAAAPRRRPGENHGYASSFTGRVDCKLPWKETMSFNCSAAPGNARMVADYFVDALGEEYRHMGEVYQEYCDVMTRLALDVTEVLAVALGLGRGELRGFFADGDPVMRLNHYPPCRQPHLTLGTGPHRDPTSLTLLHQDDVGGLQVLPDDAAAAAGGWRAVRPRADAFVVNIGDTFAALTNGRHASCLHRAVVNGRVARRSLTFFLNPRLDRVVSPPPALVDAAHPRAFPDFTWREFLEFTQRHYRSDTNTMDAFVAWIKQRNGYESLDKY

SEQ ID NO: 12990 - protein, 244 aa, Pseudoalteromonas tunicata
MLLARSTQIAANLWQFTTATNSHFAFNCYLIVGDKTALIHTGKPSQFNQMLKLLEQALAGQTLDYVLFSHVEADECGALATLFTQFPNCQVVCNKVAAISLNEMLQNPPRVLKDGESLSLGQYQLTLLDTAHFPHNWDGHLWYCQELACLFSSDYCSLGGIHPPTVQEDLSQQMLAFMEQGNFITHGAGISQITERLAHLPVQLIATMHGPATQGHAAASVLKNIHNAWLKKAQLALNELKPLQ

SEQ ID NO: 12991 - protein, 218 aa, Glycine max
MDAASGAAPAALAAPQSEGSPAAPSRYESQKRRDWNTFLQYLRNHKPPLTLARCSGAHVIEFLKYLDQFGKTKVHILGCPYFGHPNPPAPCACPLKQAWGSLDALIGRLRAAFEENGGRPESNPFATRAVRIYLREIREGQAKARGIPYEKKKRKRTIVTTTVTAAATVMSTITGSSPNNTITNGAGSSTGNTTNGAGVSEPSAAATATPNVTTAAAV

SEQ ID NO: 12992 - protein, 433 aa, Oryza sativa
MAAAGASALRPHLALLPAGGGGGGGGGTRSYALQALSFVSPLLPHCGRRRRCVLRSKASSSPSPPPSPGKEAVAVPTAESCVNLGLELFSKGRVGPGINSIVKDALEQFENALELNPNPVEAQAALYNKACCHAFREESNKAADCLRTALRDYNLKFGTILNDPDLAPFRASPEFKELQEEALRGGEDIGSGFRRDLKLISEVQAPFRGVRRFFYVALTAAAGISTFFTIPRLILAVQGGDGAPDLLETVGNAAINIGGIVVLVALYFWENKKEEQQITQISRNETLSRLPVRLSTNRIIELVQLRDITRPVILAGSKASITRAMQRAERYRTELLKRGVLLIPVIFGASQKAQTKSRLKAEERFKADIVSPEQWESWIRDQQESEGVTPGEDVYIILRLDGRVRRSGRGMPNWNDILQELPRLEELLSKLER

SEQ ID NO: 12993 - protein, 720 aa, Bradyrhizobium japonicum
MFNKHSVEIDWGGRPLKLETGKIARQADGAVVATYGETVVLATVVAAKAPREGVDFLPLTVDYQEKTYAAGRIPGGYFKREGRPTEKETLVSRLIDRPIRPLFVDGWRNETQVIATVLSHDMENDPDIVALVASSAALTLSGAPFKGPIGAARVGFVNDEYVLNPTLDEMVDTQLDLVVAGTADAVLMVESEAKELNEDIMLGAVMFGHRHFQPVINAIIELAEKAAKEPREVTVIDNAALEKEMLGLVEQELRAAYAIPVKQDRYAAVGKVKEKVIAHYFPEGQEPKYDKLRIAGVFKELEAKIVRWNILDTGKRIDGRDSKTVRNIIAEVGVLPRAHGSALFTRGETQAMVVTTLGTGEDEQYIDALSGTYKETFLLHYNFPPYSVGETGRLGGTKRREIGHGKLAWRAIHPVLPPHHEFPYTIRVVSEITESNGSSSMASVCGASLALMDAGVPLKRPTAGIAMGLILEDKRFAVLSDILGDEDHLGDMDFKVAGTESGITSLQMDIKIEGITEEIMKVALGQAKDGRIHILGEMAKALTNARAELGEYAPRIETFKIPTDKIREVIGTGGKVIREIVEKTGAKVNIEDDGTVKVASSDGEAMKAAIKWIKSIASEPEVGQIYDGTVVKVMEFGAFVNFFGSKDGLVHISQLASARVQKTSDVVKEGDKVKVKLLGFDDRGKTRLSMKVVDQTTGEDLEAKDKVAEGEKAPREAAGE

SEQ ID NO: 12994 - protein, 472 aa, Unknown
  Synechococcus sp. CC9605
MSKSHFGLIGLGVMGENLVLNAERNGFSSVVYNRTYAKTEDFLQGRGKDKNIQGATDLEDFVGKLERPRRILMMVKAGPAVDAVVDQLSPYLEEGDLLIDGGNSDYHDTERRVKQLESKSFGFIGMGVSGGAKGALEGPSMMPGGTKTSYEAIEGLVNKMAAQVEDGPCVTYIGPGGSGHLVKTVHNGIEYGIEQILAEGYDLMKRVKGMSGVQMADVLGQWNATEELSSYLVEITEVCLRTKDPVDGTDLVEKITDQAGQKGTGLWTVVTALQMGASVPTIYASLNARVMSSMKPQRMAAESILKGPAIKDFDLGTPDDAMAPLMDATVLSCIASYAQGMELLRIASQDLDYELHMPSIAQIWKGGCIIRARLLKRIQDAFDADPQLPNLMVDPWFAEQINRRLPGLAQVVAGAAEAGIPVPCFSSTLDYVNSYRSGRLPQNLVQAMRDCFGSHTYQRVDKEGTFHTEWLS

SEQ ID NO: 12995 - protein, 947 aa, Oceanicola granulosus
MTFKPTDYLPYDFANRRHIGPSPAEMDEMLDVVGADSLEALIDDTLPPKIRQAAPLDFGKPLSERELLHRMKVTASKNEVLVSLIGQGYHGTVTPPAIQRNILENPAWYTAYTPYQPEISQGRLEALLNFQTMVSDLTGLEIANASLLDEATACAEAMTMAQRVSKSKLKAFFVDESCHPQNISVMKTRAAPLGIEVIVGAPDTLDPGSVFGAIFQYPGTHGHLRDFTDEMSALHEHKAIGIVAADPMALCLLKEPGAMGADIAVGSTQRFGVPIGYGGPHAAYMATKQAYARNMPGRIVGVSIDSHGNRAYRLALQTREQHIRREKATSNVCTAQALLAVMAGFYAVFHGPEGLKAIAQRIHRKTVRLAEGLAEAGFDVAPKSFFDTITVEVGGRQSAILQAAVDEGINLRRVADGRIGITLDERTRPATIQAVWRAFGIDRRDDDYTPRYRLPESLVRSSAYLTHPVFHMNRAETEMMRYMRRLSDRDLALDRAMIPLGSCTMKLNSAAEMMPVTWDEFSLLHPYAPREQAAGYTEMIDDLSAKLCDVTGYDAISMQPNSGAQGEYAGLLTIAGHHRARGEGHRNICLIPMSAHGTNPASAQMVGWKVVPIKSAANGDIDLDDFRAKAEQYADTLAASMITYPSTHGVFEETVIEVCRITHEHGGQVYIDGANMNAMVGLSRPGDLGGDVSHLNLHKTFCIPHGGGGPGMGPIGVKSHLVEHLPGDPATGEGAVSAAPFGSPSLLPISWAYCLMMGGEGLTQATRVAILNANYIARRLDGAYDVLYKGPSGRVAHECIIDTRPFADSAGVTVDDIAKRLVDCGFHAPTMSWPVAGTLMIEPTESETKAELDRFCDAMLAIRAEIADIEEGRADREANPLKNAPHTMEDLVRDWDRPYSRETGCFPPGAFRVDKYWPPVNRVDNAWGDRNLTCTCPPMEAYKDAAE

SEQ ID NO: 12996 - protein, 259 aa, Ralstonia metallidurans
MENASTAHPFSLTGRVALVTGGAQGLGQAIAAGLAAAGAHVLICARNAARVDEAVAQLRANGLGAEALVLDITDEAAVAAAFDDIVACHGRLDILVNNAGARNRNSMAHLDAADLRQMLETNLVAPYALCRHAAQWMQRGGYGRIVNVTSIAGQVARANDVLYPATKGGLDALTRAMAADLGRQGITVNAIAPGYFATEPNQTMVADKTVAEWLRNRTSLGRWGQPEEVAGAVVFLASPAASYVTGQVLAVDGGYLGHF
